United States Patent 7,868,149 (PLANT GENOME SEQUENCE AND USES THEREOF) - sequence listing, part 117

SEQ ID NO: 64577 - DNA, 36794 bp, Oryza sativa
ttgtcactatagttgcagttttctgaaatttgctcaccaaaaaaaatgcaatatgactagcaattttgagcaatattttgggtggatatgaagtaaagaagtagcattgatttacgtgccagtttcactgacagaagggattacctctagctgggtgaggatttcaatagtatggttgaagtcacatccattagcatagtacagctctgcaaggctctctgatgaaaaatcaggaaactgtgaagctaaatacgctagggggtcaagaacatcgtctgttgctgcagcataatcgctagcaaaactgtcagaaaagcctgcagcactttcagaatcataatgaaggccctgatttccattcgtaaaatggagatcccctacaaaattttgctcccaattgcttgaacccatagttggaaacgatgcttgtgaattatcttcataaagtaaactggtaagccccagttccaggctcttgttagcttgagaagataaatcatgctctcttgaaaagcggctagctgttgttccatagaaagggggtgcattcaaggataatccagcaagagacaattcttcaggttcttgttcaattttctcaaaactgaagtctggaataatgtcatcaggaagctgcttacgccaaaactggtgtgcctcatcatccgagttatttgactttgatgactcggacctatctaggatagttttcccagaagccctaagatctgccttacttacatctgagacagcgctactctcaaaagatggtctaatacatgaaggtacaaattctgctgcgttgggattcaatgctgtgactttatttggcaacattgaccttgtatctccattggaaacaactttattgagtgaagtcatttttaatagaaattacatgtgatgttacatgtacaaggggaaatttgcaataagattttatccaagccctgcaaagatatcaacaaggattagcatgaacatggctgagcacttgatgtaccacaatcacgtcaacctttaccaaaagattatatatgaacaaataggtgtaatttaacagaaaatataacttccataatattaataaactagtatttgtcaactcaaaaaaagaaactagtatttttgttaataagcaagacaatatgctaacctacaggtaaggctcactagagctagtaatctttgtcagactcaataaaattgatagtgttgtgggaaatttcatttcaaccctattataaaataccaaaaacaaataaaccaactacaagaacaacagctagttcttgctattagggcaataaatatttagaacaaaacaatttaattacttcatagtatgtccataaattaaagccagcaagccgctgcatcatacaaagattgaagataacacaataggatatataaggctggacaaatggacaaggattcagttatacaagttcttaaaaagtaaaaatctacaagccgtttactttccgttaggattcataaaatattttgtttgtttgttttcactgccagggagaaataccacaatcaatgcgactgatactgataatagaaatttccacattcacagaagacccaaaatcagtagctctgtcaaccaaaaaaagaagagaacttctaatgatttgctcccagtttccacaaaattggcgcgactcttcttagtaactcatatagctgccgtcgcaaaagaagcaagttttctgacacattatctcaatatctcctccataaattcatcaattaaataggctcaatatctcctccttccgtccttcgttctcacataccgacacgctgttctctcacccaaacgtatatagaaaccatcaaatcagtaagaaaggaaccataacaaaagaaacagaagcttattgctgtttttttggaaaggaaagagaagatatcctcaaaagtccacgcaactccatctctaacacagaaaagggaagattgtacaatcaaaagaggcaaaagagcaacggaaagacgagcaaacagtacccccttgcttttcctctccgtccagcacacgcacgctaaacaccccacgccctcctccccgtctccccggccggtggcgagatgcctcaatcaaaaaaaaatcacgccttttccgggttttccctaacccggacaatcaacggaacaaaaaaaaaaatcctaacgccgggcgagatctacacccccagatctacccggaacccggggggagccagcgccagatctggagaggagaaaaggccgggagggtgttaattaattacctttccgccggtcgatgagctgatagtgatatatcgctggcgaccggcccatggggcggcgtcccccccaacgccgacggtagatgagaaacggacgccgccgcccgcagggggattcgggtttcaccgcccaatcgcgcaacgggagtccggccccccgctccgggagaatcgggggcggaatagggttcgccttcttgggaggcggaggcggaggcggaggcgaggagaggggagggaggagggagaggttggtgcggatggggtgggggtggataggtgagggatggtggagtttgacccgtcggggcggggggtgggggtgggggcccaccgtggcgtggaggagaagcgggtgggtggtggtggcggcctcgggatcgggggcgccgctgcgaggctgaggtggcttggcttgggttggttggctggctggttgcgttgttgcgcggcgctgcggggtgcggggggaatatgcgggcgggtgatgcgagcgagcgtgccaggaaatctctcgaactatgggtggctccgtccctgactggctcagttggctcgcctgctccggctttgcttccggcgctggaccacaccagctgatgatgatagcttgggtgcgttcggcgatttttcgcgcacacactctcgcctgtcacatatcccatccttaaaatttttcaccgtgtcacattaaatatttaaatacctacataaaatattaaatatatgctaaaaaataactaattatacatattgcgactaattagcgagacaaatcttttaaacctaattattccataatttgacaatatgatgttacggtaaacatttgttgatgatggattaacgaggcttaataaattcatgtcgcggtttactgacggattctgtaattagttttttatcttatgtaacacgccaaaactttacacccctaatctaaaccctctctaaattattagatgacgtattttttatagaatagttattttaaaagattatattaatccaacttttaaattcctctaaaaaaaactattaaacttatttcaactaatatatcactccgttgtgcttgtagggaggtggagtttctaaagctgtgtttggcagcctgtgttggaaataaatctcctgaacacagaaaacagagtggtccattagcgaatgattaattaagtattagctattttttaaaaaaatggatcaatatgtttttttagcaactttcgtatagaaacttttaaaaaaaacacatcgtttagttgtttgaaaaacgtgtgcacggaacacgagtgagaggaattgggaacaaatgctgccgaatatagcttaagatcatcccaacccaaaaactatattagttttcatacttgtcatgttgtcatggttacagataaggcatacctcctatcctaccacttatagaatatacggatacggcatacattcgtatgtacgatatatttccgtatacattaagaaaattaacaatagatcatggaaattagcctcatgggcaagtgaacaacagagtcctacttggaaaggattaggtttatactatatcgtgcgggggcctataatctctgatttttacttggagactaaggtgattcacggtttaggggatcgaatcataacaccaacacaaccaccatagcctacaatccgaaggacgtgaagcctactcgccaggagatctcgtcgaaaccatctcgatagggatctcgccggtaatctcagaatcattggttctggttctctattgcaatatgtggtctttccatatcaatctcatataaactggattagggctattaccttacgagggacttgaaccagtataattcttgtattcttgtttgcttgatgtcgtaccaacataccccaataccctgttcatccgatctatggatatcccctgtcgacacatgtcgtatatacactatgtatagaaactacttcatccgtcctaaaaaagtgcagctgtgcgtttccgcatccaacgtttgaccgtctttcttatttgaaaaagaattatgattaatatttttgttctcattacacaatagaacatgaatagtactttgagtgtgactaattttatttatttatttcataatttttaaataagacaaacgagcaaactatggacacgaaaaaccacaattgcacttatattgggatggaggtagtatatatctaatagaaatcatctatcttctctatccttttatctacatatcttgttttcattctagtttttatatggggatgatttcttgcatgagaaatgatttatttatctttttatctctcttctcattaactcttttaccacatcagatttttccatatgtgacaatatatttaatgctatggacactgaatgataaggagagttggggatggcctaacctctaccttcgaatgaagcctaagctagcttggttctatttgctacttcggccttgtttagattctaacttttttcttcaaaatttcaactttttcgtcacatcgaactttcctacacacacaaactttcaacttttccgttacatcgttccaattttttcaaacttttaattttaacgtggaactaaagccttcctgttcttttattcttgattaagatatagattttatctcaatttttgttgctaggctttttaatttgttaaacggtgaaagagtgtgtttcgtgtgaaaggcttttcacaatttgaacgggccactagctactacggcatttaaaagaaacagcaaaaaagtattagtactgtttttatgctagttagataatctgatgacttgccccttcgcaattgggagtacggaaaatgtcatcctggagttggagtgtggattgaaaaggtaaacaaacaagaggtcgccagatcaaataaagttgttaaatatggggaagaatattggatgcctacaccaataatttcacctcccttatctgaacttgtccaacaaccaatctatctttatcctttattagacattgtacactcaactattgtgtccctggcctttttttttctcaataattaacctatgtttgtttacatgaataaatgtaaagtttgttacacacaagtgatttgcttacttattacacacaactctattttttctcgcggttgtatatacttgtatgcaacatttggggttaatgctaatcatattaataaggatgttcgctggcaataacaacatatggctatatagcaagccagcaggaaggcagcagccaaccatgaatcacataatcacacttcagatgggttgcaattgaagtttcaaacggctgggcttgatttgtaactccagcccaaaatattgcagctaccggtactgaatggcctcatttacgatcgagttctttgtactcaaacggcaagaagaatgatcgtaagattttcttacggtatcattagttgacccgtctgagaaggcattttttagttggagaatctaattggcgcaacatttgcgactttttttagtacaattataatagtaattgaatttgcacgagattagtcgtgttttgtttacaaaacggcaggagctctgcctaatttaatttaaggaaggggtgaaagatacaaggttcgaacgtacagcaaagggaaaaaaagagaggcaaaaacgactagagattacaagagcagagccactaaagaagctctaaatatcgtcgtagttttcctgaaaagaaatatcgtcatagtaagtagccaacgcgagcaagccaagattatgtgaaaccaggaaaagaaatatgagtctcatcctgattattttgctggaaatcctcctattacgctccagcaagatgttccaccacgccgtcatcaaagtcattgcaatcacttatcttatactccctccatctacttttgatagtcatatttcatcttaacacacagaccaatgataagtgattctacttatcatccatttaaacatgctactagtcattcctcgtaaacaaacgattcattaacatttacatttctcgatgtccatgcaaccaatcttgtgtggaagaatggagagtcatgcattaaatctgagaaaatcattaagatgatagattattggattgaaatatacctatcaaaaatagatttttcagatttggaaatatgactatcaaaagtagatggatggagtaatgaacaacaaattaagttacccacacaatgagttcatttcagaggaattatagcacaagcgaagagagtacataaacatggatttttgaatagctaacattacaaaccccatgtacaaacatggtacaacgaaacttacagctctaatacaatgttttcaactactactaatttacaaggtggccacaattaatatccaattgaacggtgtccaaaacaactggacacagttacaaattgcaatgctacacacacaacttcatgctcgatcacacggagcttaatcatgctcctctctcgagcaatcatcaatcagatcacatattattattattctttgagagccaatctacacatgctcccaagtttattcttaatttattattaattgattcaataataaactcgccattgacgagctcaacatcccaatcattgtggcaagcttcgccgccggccgggaaagcaagcaatgaatcagtcgtcgtctccgccgccggggcatccggaccccgcggcgaccttcctcccctgcggcggcggcggtggcgcggccggggacgccggtggcgagtcgaggcagcggcggagcagcctcgagacggcggcgacgaggtcgtcctccgccgcggcgccccccgcgcgcggcgcggcggagcgcgcgaacgcaacgtgccggtcgagcgcctccgccgtggtgatggtggccttcccggcgccggcgcggcggatctcgtcgcccacggcctccgcgcagaggccgcacacccaccgccccatgtactcctcccgcaccgccgcgatgtaccgcggcgtgcactcctccgtgaagccgcagcactcgcacctggctgcctccacctccatgtcgacgacgacgacgacggctactcctctctccttaccgctccttctcccagacggcgtaggcggggacggtggcggcgctcggcgccgtgtggcgctctccctcctcgctccggacggtggctacggctgcggctgcggcggcgatgacggtgtcggcggcgggtgaggccggtgtcatcgcaggcgacgtctcgctctctcctcttctcttgcaccgccgctaatctttcactgcttcctctccaccgaaacgtgtggtctccatgtggtatttatccgcaaaacggcgtggagcgggtggggcccaccacgaaacggtcggggttcctcccccttagacgcggacacgtggggccatcccttggagggcccacatgtcagtgagtacgagtggtgtatgtggcggtgagagttggagagtggaagagggacggggacgcgaaagggaggcccacgtcagggggctgatgagctggaagggtccccaccctttttaatgtgtggaccttgacagctggcgacggcaccgaggaagagaggaggggagggagtggcggccgccgcgccaccaccacttgactagtcgactactctttctctgagctcctgctaggtggaattggtgcaagttcggataccgtgtcgttgtcgttgggccctctcgtcattttcgtgtgcgctatttatcgtttttttttgtttcaattgataaaaatgatttgtcgcgattgctctttttttttatgtagatgcctacaaccataagattcataatgaaacgcatctcaaccaaacaaggaaaaaggttttgtgcccactctagaaaattgaatgacataggagtatcaaagcaacctacattattatcttgccaccaaacataagctatcgtccggttctataccttaattgttttacaaagttaatctcaactacccataaagatcacaccaaatacaatgaggttattcggtaattttgttatgtagctgttcaggctacacgggatagcgcagccactcggctactcggctacaggtctagactacatcctagccattcatctgttgtagctactgatttatccgctgagctactgttgtctgtcgcaggctcgcagcaggcagcgctgcagtagctaactctttcgaacagatttaatatgaaagttcaatctatatataaagattgaactacatttggactacatatataaaggcaaaaaaaagataaataaaaaaacgagtcccatctctatacattacatgcattaatccttcccgcttaccatagaaacaaagtggcctaggtcatgtgctgcacggtgcttatcattgatgcagaaaacctgtgagcaaatgtacatgaaacatggcacgtactcaccgaaagaacagaaaagaatcgcatatccatgggaaaagaaatggagagcatcctgtgataaagccatgatgcattaagacgacgtacattgataggatcctgtgaagaaagagagagaaaagacgatcgtcacatactggtgttcgagtggtgacccaaaaaaaaaaaaaaacaaccaccagatgatcagtccgtgcatgcagggacgccccggacagtccagccatgtgacacggacagattggtcatgattcatcctactacacgttagtacgtactcatccgtaaaaaaaaaactcaaatttgttatactacatgacatatttctagattcatttttttttactgagggagcaggaataccagtactaaccagggttaatattaccatcggtaaacgcgcggttaccgggcttaccgcggggtacgataatataaataccacggtaacctccttaaattcaaataatttttaaaaataatttgaattttttgataaattttgcacggtttttcacggtaaccgtccttaccgccggggccggggttaccacgccccggcggtttggaaaaccctggtactaaccatgtgattgagcaatgcacgtacattgcgcgtgcgcatatatatatatatatatatatatatatatatatatatatatatatatatatatatatatatatatatacagagagagagagagagaacgaacaaacaaaacatacacgaaatatattcaatgatagaccagatcatatacggtaattcaggtgaggtgatatcgtagtttcgtataagcttgtggtgagactctgacgtttgttctcatttttgcaaggaatttcgaggaatggatatataaatggacttacggaaatgaatcccgaggtatactaatcaaaactacgtgattttgtaagagtattatatatatatatatatatatatatgagtttatgagatattactattttaaaactgcttttagctttataaaagttaatttatttatggagtatttatattctcgaataattattacaaatattttattcttgtttttttcctttttaggctacaatagtgagctcttaagaggcaacatgatctgttcttgttatctttttattttctttaaggctatgtgcatcttgatgcagagatcggtcgtaattttactgtttaatgaaatataaccattctctatagaaatttatatatttaaccatcacgtagaaaaggaaccaatacagtcaattcgtacagctatgtgtatactctctctgtcgaaaaaaaacttaacctaggagtagggctgtcaatgagccgagctcgagcgagtttggctatgtaggcttgagcttgacatgaactcaagccgagcctggatattgatcgagcttgggagtgagctcgagttcgagctccagcaaacttcgagcctactcgagcttgacagcttgacttggtgaaactccaaagaacttactcttgtataagagatattaatgcaaattatcagtagtaaaaaataatgggtgctacttgtctttaatgaagcctctgcagcttttctcatgaattcatggctttgaaacgttgcaattaacaaaagctagctgctacatctaataggaatagtagtactattattagcaaccggataattgctttattgagaagcattaatgagatcttgaaacttgagcaggtcatgcacgatgacaaatatacattgacccatcaaaaatatattcatacatgcaatgcatcttacgctaatcaaaccctgtcgagctattcgagctcgagcttgctaggcttgcgagtctcagtctaggcttgagcttggtttgtttagtattcgagccgagctcgaatcaagctcgagcagcttgcgagctccgagcttttttaacagccctacctagaagcgaggggatgtaccatctcctagtacaacaaatctcgataaaggatagtccagatatattgtagtagaaggtgtcaggttgagttttttataggatggagaaagtatgcgtgttcaatggaattaacaataggccatccagagttctctagatgtatggaccaaatgtggggcgtacatccatgtgtactcttgcacgtacttcacaaaatccttaaaaaaatgtttttttgcaaccgcgcggacgcgtcgaatcgactgagcgatcgatccaccgcaccgtaggagcggcgcgtttcgctgtacgtttggaaggtatcgcgtgcaagaggacacagagcgggcggggtcacatactcacatgacgatgacgagatcgatcgacgatccggctgggatccgatcgatcgatcgcctcatcgccggttgacgtatgctaaaagttggtggagatcgaccaagtgatccacctacatcggaacgtacctgtacgttaatttttacctggctaagcaaatgcatgcatgaatgtaccgtgggatagcgtcattgtgtccgtgcacaagcttaggacatgtacagcggtttatattagtggtatctttattgccatgcaattaaatttgatgacatggaagaaaaagaaaggagcatggttgttatgcatgataatgctcagagtcgactcttagcatttattagagcaaattttgttgcatggtgatgaaagaaaggaaagaagagtaagaaaaaaatattttgatacattatgattaaagaccatattgtctctaactattgtagggtgctagtctctagataatatagagctcatatctgactttaactttgtacatgtccttagctatatatattccgattcttactaaggttaaattgattttatgtaaaaagaatccctaaaaagattatgtgaaattctcgccttagaaaagataatatagcaaatgaaccaaaacgtttgtactgtaaatagaaacatatatataccctggttcatgtcggatcaataaaagcataaaaggagtaacaaaacacaagcaacgctaaaaaaactctaaaagataaaacttgtacgatagacgattaaataaaaagcggtccattaatcattaagaatggagtcttaccttcatgaacgaatgataattgtaacccgtatcatattatcgaactttcgatttcaaactcagtaattaagacgtgaaaatgctagtcgtcagtattaagcgataccgatggtatgtttatgatggattttctttctccaatttgaaatactgatggtttatgatagtgggtttcccatagaaaatactccgtatttaggatcatcactctgctttgcccttgctcgaacattcgttatgtctatctgggacactaccgactaccgtgcattccaacttgcaaattaaggaccgtgagaggtcgtaagaaccgagaacgacgtgacgacgataagcaaatgcgatctgccttttcaaaatcgtgatctccgaatcggcccaccatagattatacagtaattaaccgtgacccgtcgtgacatgacctgtgtagtgatcgatcaaacggaaagcaattgctactggtacagtggtactaatcaagtactgatagctacagtatctatacagtagactagcatagtacgccgagtacaggagaccagggtacctcatgcacgactagcctgtccttataagagcaggtacaatagcaggctataaatcagctacaaacagatttgtagctaattatagcacggacttcaagacacagcgtgtgtatgacaagtaggaccaggtattaatagtatagtatgcaactattgtatgaataaattattagattggctatagataaattggagctagtagttagctatactattaaacttgctctaagagcacccgcaatggttatctatatgctctctacaagagatccatgtcatcatattttcctacttggaagagattaaatgaagagagagagtaaaactatctactaacttagagatagtctatagagaaaaacgaggcaatggatgagagacctatagatacccatgtagacatactattgaggtgatttactattaatctaatctattgctgagatgtacatattttatagagagcaccttactttaccattgcgggtgctctaatgcggttgctatcgacttcgttttaactacaggcaggctctgcctgctccccgttgttatctgtatatatcgccacggattaattgcttgatgtctagtacatgatgcggtgcagcattgcgatcgatcacatgcatgactgacggtaggggacaagccaacacacctagtatactccatccacttcataaaaaatcaacttctaagctatgtctatatatatataatcagaaattcatttttatgagacggaggggagggagtagctcggcctgatgttaaatccgttcatactgtgcttttcgttgagtgtaggcacctgatatagagttgaaaaccatatttttagattatcatagattatgcgtggattaccatggctgaaccgtacactttacatcataagaaattaaaataaagtttaaaccatatttttagattatcgtggatagattatgcatggattaccatcattgaaccgtacactttacaacctaagaaattaaaataaagttattctcattataaatatttaggttatattatttgtcatcatttttacctgacttcaaaactttcttttccctcgtttgatgacttgaggttgaaaaagagacaaaagtccacccacctgaagtggtggtgggtggtggcatattcaccacttaccattattattggggcttttaaaaaagtatagatacatagatgtttctaaaattatgatttattcgaaagttccttttccaacatagtatagatacatgtgcccatacaaatgcgcacacactcacctcttatgaatgcatatacgcacattaaaactaagcacatctgaagagtgaagactgagtcggcatatcttatatttacaaagtcaccatatttacctcactggcgatgtcatctaatatttgaactcgggtaatcagccttcacgacaaaaaatctaaccagttgagctacacttgctttgctattcaaaagttttttacatcaacattgtttagatattagctatataatatataactagcagggtggcccgagcagattgcgcggctagtatcattatatttttttctcatataatagcgtatatgttttctcattatattattcaaatatattaaaatgacaatataattttaaattttgcaataattttataaaactactaatgtgtaatattcatattatattttatatacgtgttagttattaattatttttaatatcaaattttagttatttgtaaattatatatattcatatatggactctatactcgtcttttaatatttctttttttaaaattccgaattttctgtaaattgtatttctatatagactctatactcttcttccaatattatttatttttatttctgaatttttattatttctaattgtatttctatgtggactctaaactcatctttcaatattctttaatttttaatttcgaatttcagttacttctaaattgtattcctatatttatattcctatactgaccttaaacttttcttcctatgtttttcttaatttcgaattttagttatttataaattgtatttttatacggactctaaactctacttttaattttattatgtttattccaaattttagtaagttttaaattcctaatggactctatactctacttctaatattccttattttttaattccgaatttatatttttttcttaattatatttctatatggattctatactctacttctaatattccttatttttaatttaaaatttatattattttctaattgtatttctatatggactctatactctacttctaatattccttatttttaattccgaatttcagttatttcctaattgtatttttatatggactctatactctacttctaatattccttatttttaataccgaatttcagttatttcctaattgtatttttatatagactctagtctcctcttctaatattccttattttttaattccgaattttaactatttctaaattgtatttctatatggactctgctttttctttttcctcgattaatgtgagaatttctagaccatgagagcgaacgtggaggctcctttttctattcctttaattatataatagatattttattcgtctctataagcaactgtccatctaagttattatctaaccatccgtttcaaacacataaacccacttggctgagctgattttaaatttctagacttggttttagaattaattaagatatttcttcatcatgtcctttgcccattctttttacaaggtcagtaagaaagaaattaaataaaatctatctctaattatatattctaaaaacttactttaaaagtcaaagcattttgaattatattctgcagcaaagccaagttcagccaaataatgtagctttatcaaccgactagccgtcgcttgataacacacacaaaattttctgtgtggattgagctttagaatactcaaacatagcttttttaaaaaaattcccctgaagttgacactcagacgcttcacactgctatggattctacaattcaaattgctcttgagttcttccaaggtccgcttctttttgtgtggtcagagagctgaaaccaatgggggaattacggtgtgagcttcttagaccttgcatatacttgtcttaatcaaatcatcctcaacgaaataaattaatataacacatgtgtagtgaaacaaatcaagtcgttttagctgcgcgagacagagaaatggtgatttgaccccctttttcaatcccaacataatctcagaaaagttgtgaccggccatgtttattagtttgaggccatgaaagcgccaacgcagtgcgctttcacgatcttaaagatgacaagcgtaggggaattttatggtttttcttgttatactttcaatttttttaggctggaaagaacgtagaccagttcagaatcaactgatcaagatgtaccatgcagttcaacttcaacaccactgtgttactatttcaacatacaccatggccaaccatatgcagttcaacttcaagttcagtcatgctgattgataaatatatgcatggcattttttgtgttactcctctagttgagctttatcatgcataccatataggcagaattatccaaaagagtcgatgttgaacggtcataatctttccaattgatcggtaaaccattcctcaccatatccttgtggggtgcagatgatgactaaacttgaaacgccaccttcacccagcttgttgcaatcccctaccaaatgcttatctgaacttggcattatcttcttgcttagtcaccattttcttttttgcattcacagggcttgcctgccacatgtcattctcagtttgttcctgcaccagcttcaagtgatccatgcgacaaatcaccagtcatcaacgagagggaagcgtagatcgaaacaaaggattcaggtaagccgtcatgtccaagctttagcggctgcgtatccaagcaggaaagtgcagcatttgcacaccagacaagttcaccttccaatatacgcatgctgcacaaaaagaaaaggatgaaagaacaacctgctacattttgattccatcacgagtctttgcaaacatttgcagaaaaaaatagtgctacaacatgaacatattcatcagcaccttagcattatgtcacaagaaatttggaaaagcaacattaaagtgctgggacaatagcctttctccaatctccacgtcctaccatatcactaatagtagtacaacaactggccaataaaggtgctatgttggccgacatagacatcacttaacatttcattttgtgacacgaagtactctttaccatagaaaactaggtccagagtttaatcttgaacagaatagttgccgcatcagctagatgggaggtttctgccggcaggaaccacaggtgaactatttgtattaagtggctgtctcttgcaagcaagcctgacggtggaatcgatcacagaaggctcagccattgcaccattaccataatcaccacaggccagccttttggtaatgggagggaccaaagatatacctagcaggttgattgtctcaagatgacgactggtgaacgggttgttccacatgaaggtgttcatagctggggcaacaaagagtggtttgctgtagtcccatgctctcactatgcatgtcaagaggttgtcacataaaccaccagcaatctgaacaaaactaatccagtgtcacttttttgtaggcagcgaaaacaagttgacattgtcaaacaaatccaggattcaacataaaaaatatatggttcacaccagaaaaagaaaagaaaatcacataccttagctagggtattagctgataatggcgcaatcaccatgatatctgcccattttcgcagttcaatgtgcaaaacttcatcccctatcttcttccaggtagaccattcatcatcatcagtgtaaagaataatattgctaggcagagacgttctatcaataaaatgtaatgaagccttggtggcgacggctctgacttctgcccattccgagaagctacggcaaaggctctcaaattttatagcagcgacgcttccagaggcagcaaggaggacccgaggtttgctaggatgagggaaatccaatcccaaggtttcttgtactgactctgatgtagtcatcacctcagtacttcacctgtaccgctccactacattagaattacatgaattcagaagatctttatgctgctatacgaaaactctattcacaatgaatttctggaatgaaatgaaagtgaaacagaaaggggaaatgccatttcattcacggattccatatctaagctaaagattagttcaaaaacaaaggtaattgcatcatgataaatacattagcaaactggtcactagtttctgttcctaccttgcaagcttggattgatgtagcggtctaactaaaactaaactcagattggaggtggaaataacctcacctagtacaaattaatactccgtagtgtcattgtgctaagatggccagaaactaacgccggccatggttctcagctgagccccccaattcctctaggaaacaaacgctaccattcgaaccaagatggaggaaggtcgcacccctggctccaacgctgctccccggccgcgcaagcgaggatccggcagtggggagaagagaaggctacgttgggggtgggacaacgataggaggccggccgcacacagcgcctctgggtgttcgccggccgtgcgcttgaggaggcggggcgcgggggagcaaggaggaggacgggaagaggcggagactcaccgagagattatgggaaggagcgggggactcaccggcggtgaagatccgggggaggagggggtggccggcgccgtactccggtggagatccggcggcggaggagggtgccgcgacgggggcctcgaagttttggtgtgggaggacttcggttcagaatagcctttggactttggttactagaagatttgggccttgggcccagtaatgtattgggctgtgaggttgcagacttaggaatttttttaatttttaattttttattaaaatatttaaaaaaatagttttctatttgaaaaatttacaaaactagtcgcctttaagcgatgggcgactagttttgcaatattttcaaaacgaaaattattttttaaatattttaataaataaaattaaaaactaaaaaaaatcgcagagttagaggctcatatattaggcccatattacaaaaatcaaacttgtttttaaacaagtttgattttgtaatgtggtctaatgcataaatgtattttgcatagcataaacacagttttgttcagtatccacacttaaaacatttctttagataatgattcagacttaaatatgtcttgttcttcatctctaaaaaaaaagaatctcctgttcttattgcaaacaagagcctaaaaaaaactaaagataaaatcatcctgcataattgcaatttgcaacgatcaaaccatcaacagctaatttgtgacaagatttactacttattactacgtccaaaacgaggaaagtctgtacaaaatacgattcaaacaaagacagaattcacataaaaaagacgccatgatttccatgtgggttaaacatgctatgcacgcacacaaacacagggcacagaggctcactgagctcctatgctcgcaccgacacggccacggtgtgcggcggcggtcaccggcggacggatgtccgcgcgccgtccgtacgtctcggtctcagaacccgacggtggcggcggggccgaacgcggcggcgtgggagtactcgatgccgacgggcgcgcgcagggcgccggcgagcgcggcgccgtcgatgaggtcgcggacggcgttggcgtagcacacccgcagccgccgcagcgcgcgccggtacatcgccgccagccaccgcacccgcagccgccgcagcgccccaaacagcctcctcttcgtccctcctcctcctcctccgccgccgccgagcctcaccaccgccaccttcttcctcctcatccgcccagccgtcgccgtcgccgtcgccgtcgccgtcgacgccgacgccgacgccgacgccgacgccgaagccgccctcctcctcggcatccggaacagaatggctcgcctggcgacctggaccacgtcgtccaccatttcttggctttctcctatatacctcactagctagctcagcttgatctctaatctctctcgcttttcttcttaccaagagaagaagctaagctaagccagcttagctagcttgcttgcagagtgttctaattatactccttttctgtgaccttttctgggtgtcaagctaatttaatcactagatgaattaacttaactattcttcaataagtccaaacgactgatcggtgacgatgatgtagtagcagttaagtatcaggtcatctcgagaatggtcttttctttttctggaggggtactggtacatgctgatgtgttgtcttatggaggccggaaaagttagccggtgtgctacgttgacctcaacgacgagcggttagatctcgatcaaaaattaaatgtgacgtattggttagttaccgctttctccgttttagaatataaaaaagttttacaattggataatattatacaaaaattagataaactaaatagaaagatgttgtgattgattgataaggaaatattgatgaaaacattattatattttgagaaaaattcaaagtgttaaaagttgttatattttagtacgtagagagtacatactctatataattgatctctgtgaagaaacaaatagtatcttccaaaacaaattaaagcaaagcgtatataatcagcaagggaggttatgattaattcgatcaaggaatgtagcataaggtgcgatcgaagggccgtttgactaatggaattattattttttggatgcattaaactcgataatgcatccgagctaagaaaaatattactgctgtactggtagcccacaagttaattaaattaactaggccataaggttatggctcacatgggtgcatataaatttggacactgtatctgtacaaaattgtgtgaaatctgtctgttgaagtacacgcctcacagtcacagtcgttgcatattcaccccttaatccttatgtatacagcactagtagtattttagtccttggatcaaacctaaaaaatgtagtattttgccatcgagaacgagcggtgtagtaaaggaaatcgcgactttgaccatgttcaagaaaacaaaatcatgatattttaaagagtgaattgcatcttgaactatgttttcttacccatgtttcacaatgaactaggtgttatcaaacattttcactttcaaccaactatagttacttgagcatgcaatttggacaagaggcccacatgtcagccagaccatgtgtgtctctccctcttccccttctctcttcctcctcaagaccagtccatccctatccccactatcgctccctccacttctctttccagtttgcctatagcagtctagctgtccatctgttgtttcccttgagcttgagcatctagattaggagcttatgactagatcaagcactagatcagatcatgctgcctctactgttgcaagagcaatgagcacaatacatggaagaaaaaagagtagctacggagcagggctgttgaggcgccacgacggtgcaagtggagctcgagcatggggcatggaaggcggaggttaagctcaagcacgcagctagcaaaggtggccacagatggagcttgagctcaagctcaggggcaacgtagacagagctcctctcttcaacgccattccccgcggctctcaataccttaggctagtggtgttgtgctcctctgctagcttgacccaatgtcagtgccaaagttagagacgattggcaacagtcagcagcttgatgtagaagcaagcagtggctgagtggaaacatggaatgtgaaaatggatagagtggtctaatgtgcaacccaaggtaaaagactcttgtataaactaaaaatgttggatgtgccatagtccaaagtgaaactttagtcataataactagcccaatatacaattcactctattttgaaactaacccactttatagagaagcatcatatactatttacggaggggagtatatactttatttatagttttagaagcacaaactaatatacatacatcctataaaaaaggaaatcgatagagcatacacgttctaaaaaatcttacaaaaatgatcccaaccttttggttaaataaaatctagatacgatctaagcatgacccatcagtgtcagtaataaaaattcattaagaaaaaaaccttttccaaatcagtaatcttaggttgcattcttttctccccttttctaatttatactatctcgtttctcgcacacatgtatggtgtgtttttcttaaaaaaaattctatatcaaagttgtttaaaaattcatataaatgtaaattttaaatttattttatctaatacttaattagttatgtgctaatgagtcactccattttggtgttaaggaaaagttctcaactggagctaccaaaggcagacttataccgagttcatccatggatgggcccatacacacagaaggcccaaaaagcaatacgtctgtacgctggctcggcccattagactaaccaccagacagaccaagtaaaccacagccttcgctacgaaggcaggcaaatccggtccaaaacccaaacccaacccaacgaccaaaccaccgaccggccgttccactgcgccattccttccttccccccacctcctcgtcgacgcggagatcgctcgctcgccggcgacggcgatggcggcatcgcggcggctgcggcggcggtgagccaggcgctgagggaccgcgacgtcctcgacgccgtcggcacctccgccgccgcgctttcgctcgcgggctcttccttcatcgtgctctgctacctcctcttccgcgagctccgcaagttctccttcaagctcgtctacttcctcgcggtctcggtgagcggctcagatctggaactacttggttttggggggttctgggttcgggaggctagcctcgtgatctgcgtaactgcgttgggttgcgatttggaattggggagcgcaaagtggggatctgagggcagtgcggtgttcatttcgcctccgattgagaaatattgggggttcacgccgtcagtttaaccaacggatgctctgtttttgctgcttatgcgtgcgagctgaagcagttctcgacaattttttttttgtaagatgtttgctatctgatcggcacttgaagtagcatagggcatgctccattttttttttagtgaaccgtgtgaggatgtttatgtcatagacccttacttcaatgtggcaagtgatgtccctataagtatccatgtaggcaattgctgggagatcacatttcgtgctactgtcttcttggattggaagtacagttggtttgttatctaattatcatgttggtttgttaatattattaattgctgcaagacaagctgatgtctctaatctcaatttcttcaagacatttggaaatttgtttgagagaaatgatatcacatttctattcaaggtgtttttctgacagcttctgtctaaattgcaggatatgttttgcagcttattcactattatggggtatgcttctgactgtgttattcaaattgtatttgataatgcacgtagttacttcctgacttaaataactgcaactaatgtaggagaaagtgtattactgtgaaggaaaaaacatattgttctttattttgttatttttggaactgttactcatgattacccctttttttgctgactttctattatgcgctagtgaaatattcttacacacatgcttttcatattgcaggggcccatcaaatgcattctactgttttgctcatgactacagtgcacacttcttctgtgtggcttcttttctatggacaaccactatagcgttcactcttcatcgcaccgttgtcaaacataaaacggatgttgaggagtttggatcaattttccacctgtatgtgtggggtatgcaattcttttgaccacttctctgcctttcttggagcttgtgcgtgccaaattagctggtgcaatattattaagaagttagaaatgcttgttgatttggtatagtgcttctttttcatttgaagtattgacaattttatagctgtttcatctatttgaagtgtatgtgattgataagagggaacaagcgggagcattttgatttcttatatctaagcattatgtagatttgatgcacatacttttgtttctccttttctgttattgttgtctgcattgtttgtcatctaagaaccaagtatgcaagttccagtttctcatgcatttttcattcctgtctgctaatgtatatactgaatggtagacaacttaagacatttgttgacttgacataattgcgaacatgtgttgtaactcatcctattaatcttgttgccctgcttgaatttacagttcttgtgacaataattttccttttatatgtttctcaggaacttcactagctacaactgtattacgttcaattggaagtgattatggaaggccaggcacctggtgttggatccaacaaggaagcatgggaaaggcatgtgaccttttgtgttttgtcatgaatcagttaacttggttctaacactgctaacacctatctacagcttacatttgaaccttatccatggtagtcagagtggcccaaattggtgctaatgacgttcctatatgtttttgctttcatttagtatttgagctgttatcaaatgatccaaaacaaactccactcaacagaataagtactacctttgtctcaaaaagacttcatttctagctatgaacctaggcaagtattgtctatattcatagtcagaaatgaagtctttgtgggatggaggtagtaacatttatttatttggaattgcttacgtaccttgcacaagacagatggtatcataaagtttagtgagtctctgagagtatacgcatgctttctcttagtttgtatgtttgactttttgtgcattggcttctttcttttccatatctttactgcaatctatgtcttctgttaatttgccatcttgatcctagctagaccactcattcaaaataaaaatattgtcactttgtcagaattttagcaattgttcattatatgtcttttatatgcaggtcttgcacttggtaaccttttatcttccattgtggggtgccattctctacaatgggtatacatactttcaggttaatcgcatgataaacaacgcgacaagggtatgcatacagttttctattttatattgatgataaataaggcttgtattgaatccttgtaaattctgctctttttgcttatatgttctgattttcataagataatggatgaatttgtagatggctgttggcataagtgatcgatcaattcaatctgacgtgagggcagacaagaaggtataaatttcctacacatctcttctcattatgtgtactgaaatattttcccctaatgtgctactgtattcttcctactatcatgaattcagagagtaactcatttgatcctattattttttttatacctccagtcttgagatgaactggagtataataccttatgttatcatgtttggagcaaaaatgatgtgtaaattctaggagtacttatattatcatgttacctggatgtctggatcagcctcgcaccactgtctactgtctggtagcagataggaatgtttatttgagcagatacagcttattgacttgttttcttttgcaggcgtttaatcggtggggttattaccctctcattctaataggttcatgggctttcgcaacaatcaatcgtgtgcatgactttgctaatccaggccacaagatattttggctctctattcttgatgttgggtttgccggacttatggtgagtattttcatcctagatgctagttacccagttctgaagagttttcataacatattgaaactactttgataatgtgggttgagccaaccttttaagtttagggctagagaaagaggcttagaggactccacgtatcttgttgtcagtcctgttgataattttttataaatgggagcgctggagttccaaccctactctttcttgaaacaggcctatgaaattggttgtatttcatacttagccttcagtatccaaagaattggctctatataatgcatagatgagtcatggtctcgtggagtcctcttgaagttctgtttgtagaagtgtattgttgttttgtttccttgtgaggcttacctcagcttgagcttatctcacaaaacttctctggcgttacatcatctgtgaacacattttccatggattctaatgcttcatggtatctttaggggctttttaattccatcgcttatgggctcaactcgtcagtgcgcagagcgattgctgaaagacttgacatgtgagttattttctagactttacaatcatctgttcctcctgtatcacctcatttccgtttatcatttactatattggtttatgcactatataacattttgtttcctgaattgtccaggtatctacctgagagatttaaaaggagcctccctactctgacacgatttaaaagtcagcaagaaaatgaacttacttctcttattgtcgatgcgagtaacacataggaatttttctagcacactaagtttgttcatatcttgtgggttcttcaatccagaaagggtgtatgacattactgtagagccagatgtttagcattaaccatttgttagcatgtggaatagttcccctgcggtcctttgttgattgccttgaacacgagcagtgtaatatattgaagttgcattgtccggagtacataagagattaggagatagccagagttgtagatactactatgacgttgatctgtatccctttttttgtggatgtatcagtgtaccaccctctccatgttttgctttcatatgtttgtctcaaaatactggccacaggccacatacggtacgacttactaatgtttcggttctcctgagtcctaacagttgacagtgtcaaaacagtttttcccattgatgattattttcaccttagtgaaagcgtagttcttgtaaactgcctcgtggccttgtccatgggaaaggaaaagcactaggctattgctttgagatggtgttggctcgagctctcgtccatagtggaaaaggagaagcggcaaaaggtgaatacatggggaaaggaaggaggctggcaattgctttgagatggtgttggggataggattcaacatgtttgaaggaagaattgaatagggcttgccttgcttaggagttacggtgttggggataggattcaacatattcgaaggaagaattgaatagggcttggcttgttcaggagttactcgaatatttctcggtcttgcacactctcgtcaacagcgacaatcgatttgtcctctattttaaatttaaacgtacattcaaatgaacatccagtaaaactctaatataaaatatgatgcatggtgcatgaacatattcagcgtatatagggtgatttaatataaatttaggagaaataattgcctaaatctgatgtatgtgcaatttatcgcgtttctaagatttaaattacagtaaatactaaggttgctattcaaatttaaattaatgaaattttacagtatggtggtgctaagtttgagtgtacaataccaaagagaaaattattataatctaacaaaatttggttaacctcaatcggagttaaaatgttttttatataatttttttcaaaagtttcagaatttctcagtacaaaaataattaacagaaaccttttctcagatttaataatttgtttacaaaagaaactaaagcgcactatatagagtacgttttcctacagggaaaacgttttctaattgtgtgcatcgatttaaaacagtgggtccacatgtcagtgaaaggcactcctctaatcattcggccaatcattaaagtttccagaaattacatatagatcctatgcctacctatcagtgtcttgcatttcttaaaaagacactgggcctcttcactttacatcattttcaaccatatcattttttttaaagttattaaaaaatatatatatttagtttgttgttaagtttgataaatacataagaaattctgctaaaattttaacaatattatcatcttatcaaaattttaaaataataaaatttagtaaggtttatttaaaataacaaaatctgaacagccccctatcttttcctccttcaacctacaggcagctcgatgggcagagaggcgcggcgactcgggaagggctcgccggcgacgagcggccgcggggatggctcggccgaaggccgtggaagctataggaggtccttgcgcacatcctagaggcggtggcgcagccgggggtggctggaggcggcgagcgccatggccggcagtgcaggcggttcgggacggcggcgggcagtgtgctacggcgaacagtggctcgattaatggataggggagggcctagggactacgaggaggcttactccttgcttgattcggggcggaggtggtgcgtgacggcgcggcgacgggttcacgaggcggcggacggcggcaatggcggcggcggcgctccggcgagggggggggtctaaaattagttgatgaaatgggttcaaggggctcccggggtcatgctggcgcaaggaaaaggaagggggctcaccgacgcgacggctcgatggtgtaggtgatggcggtggctctgttcggccggctcgggggtgcggtgatggcgcggccgttcccgtcgaaacagagaggttagggcttcgtctagggatgttggagaacgagtgtggtgtggggagtcagccggcgcgaggtctcgatttataggcgagggaggagcgagaagcaggcgcgcgcggttgtctcgccgttggtgcgcacgggcgaggccgacgggagacatggcgtgggcggcctcggcgggaatcgcggcggaaggctggggacgcagccttcccagaggctttttgcagagggatggcagcggcggtcggggtcgtcgtgtcgcgtcgtcgccttgggcagagagggcggcgtcgattggccgcggcagagcggagattggcttggtcggcatcgggcagaggtagggcagagggcggcggcattggattggccacggcggctgcggtgcaaggcgcctgggcgcggcaggggcggcgtcggctttgtgcagccttggcacagcgggaatcgcggacagagggtggcttggtcgtcttggaggcgctgacttcgggttggcactccaaatgttcgacgaaatgacctcaagggggagaggtgaagaggagagggaaaactgagagtctgggaattttttttttcaggattgttacagagctcaaaagcttgtgccaaaattactggaagttagtgtagtcatgaacttcatttggtgaatttctgggatttttctcatgtgtagtttatattgttttgaaaattcatacaagttcactgtttttatttcaatttgaatcaaattttggatgttttcgtctttttgattgagatgaaaaacttgtgagacttaaggaaggttatttcaagtgtgtaccacttatttcaattctttttatccctttttgatttaatacttcaacatttttttgtttatatctattgcttgcaaatacattataagatgcatgaaaaatccaagaacgccaaaaataagttcaaaagacaaagaaaaaaaatcaaaatcaaaatcaaaattttgctaagtttttctttattttcctttttttctgacttcaaagaattccgggtacgttacaaaaagttcatttttattaaatagggtgacgacatgtcaatactttttatcatatgattaggaattcataaaagtataagagataaaataagtaaacacatatctacactgttctgttttcaatacaacttatctgttgcacttcttatacgagctatttcaatcgtcaattaaaaaccttattagaaacatcaaaatgacatcctcatttgcttgtagtactagttctccaagtagcagtgcttctagtttttctctggctgtggccgctagcttgttcgttgtcacccttcctgctgacattcttctcgtctgtcctcccaccagctgctactttgtgctcggctagtctcactctcacatagtcacctcaaggcggcggcggcggcggcggcgatggcttcactcccggaggtggcgattgtggccctctgcgccgccgagggctgcgcgaggctgctgaagcctatcctcgacttcctggcgaacgggatgagccccagcagcgccgccgccgacgcggccatcgtcgccgccctcctcgccctcgtcttcgcctacctcgtctgcgtcttcctcgtctacctctccgtcactaccccatcggcggtcgcggctgccgtgaagctgtccattgtcaccgcattcacgctggtcttcgccaggccagccattgcctccgtcgtcgtcgtcgtcgccggcggtggcctctagtgacagtgagcgaggtaatatttgctgaggattttggttgagcctgaactaaatcccagctaaatccccaaatccaaacatacaagtggtggggaaaaatatttactactactacagatagttcagtacaataaagtgatagtatcagatacaacgaattggagtagcatgtaacgccatggatttacaattgaagcactctacaatctactccctccgtcccacagtataagggattttgagtttttttttttgcttgtaacgtttgaccattcgtcttattcaactttttttttgcaaatataaaaaacaaaaagttgtgcttaaagtacgatagataataaagtaagtcacaaataaaataaataataatttcaaatttttttttaaataagacaagtggtcaaacactacaaacaaaaactcaaaatcccttatattatggttcggagggagtagatttaaggggaccatgcgtgcagccatggacagtggctgctatagctatgctatcccctagtttcctaacgaggcattttcctgcttggccttgggggcgaaaagacaccaccctgatgagtatgattagtcaataatgtattggacaaaagttccatggatatgcaatgtgaaatttctcctttctgaaagttagttattgtcactccacatcgtgttgtacgttggattggatggtttcatttgcattcagttgaagcacgtactggcaattcgttctggagaataaattggatacccaagccatcttctttgggagaccgatgctcaaaggtctgagaaatgcactgttggaagatggaacggacagtggcgtgaatgtttagagatctttttttgaatggaaaatgtgttgggagtgctaaggacaaactaacatccattatttaatagagaagaaaatggttaaaaaaaacctacgctgcctgccagctgaataatggattgcaagtaccgttctcgtttagagattgtttcaaggagtaaaaaaatccgtaggaaaagcgagaagtaaatatgaatgtaataggcatggatattctccctcgcaggtactaccaccaaatgatgctcctccctagcagatactattaccaacaaaaggaagtacttacaaattctctctggaaaaaaatgcaagtgtgtagaagcaatacttttccctgccaatgtgggggagacaggtgttcagtgatgctctgaactgaagcagattggtctcggatggttgtaacttgtaaacgcgcacatggttgtgtatttgcgcgttgcgtggtcgtctacgacgcaacttgctaggaaagcgctcaccatttggtccggcagcccctgaccacgccgtaagctatcagcatattaagttcattggtagtattagcaagcagcttaagtttctacaggggattagctgtcaaaagtaagatttttggggagagacgcttcaaaaactttcaacagggagagttcaatctgggtgacaacccaagtcctctcaagtagaaatttaagtgggtaattcctctgtcagtataaaaattcgcttgctaattaatttctcacatgttaatataaaattaaaaataagaaaaactcaaagtgagataaacgggcagaataatcccgcttgactgttatgcttgcattcctactctcaagccatctaagcatccaatggtgcaccgtgcacctttcacttatctctaaattttttaattatgtgtttgatgatactctctctcttaaaagagtgttgataacttgatacgctcttttttttaaaatttacaaccccatgtctatctcgtattttcctcgattgaaaatgttaccatagtgtctccattctgagatgatttacgtgcgaggtcaacacggagctactagcaaaaaattcaaaggaccgtactctactctcttgctagtagtactccctcccttacaatttaatctattagtttattcctaaatggtctacgtatttatatttatttattaggtctattcattatttatgcattagagtaaatggacattgatgcatgcatccatacacaccagtatttatataacacatgcaatatctttatttgctattggctaagaaatatttgggatggtgtatgcattgagtttgttgctagagtaaatatagtatgagagagttattagtttttttcttgatgtacctacgaaatatgtatatcaatttggaatggagagagtatttgttaatgctgatgaagagaaataaatgatatttctaagggcctatctaggtcctgtttggttccatgggctaatgtttagccctcatcttttagcctcaaattagccctcaaggatccaaatatgtgggctaattttgagctaatgtgaattagcccccctcaaaatattagcccctccaaggggtgctaatggggctaattttgtgtagggacaaaaaaaaaagcagctctctctcttctctttctactctctctccactttttagccttgaattaggctatagatccaaacataccaccctaggctaatgtttagcctaccaatttagctaaatattagctcttaaaattaaccgtgggctaatcttccaaacagtgccatagtaaaacaaatacctttcccctgtaaataagccctccggatgactcgaggttctacctcattccagaaggagaagcaggagagaaatcgaaggcggccggagaggagggagcggaggagaggaggaggaggaagaggagaagaaggcggccggaggaggagcaggaggcgtccgcggaagaggaggagaagaaggcagccggaggaggaggaggcggcggcggcggcgtcggcggaggaggagtagaaggcggcggcatcgtcggaggagaagaagaagaaggcggcgtcggcggaggaggaggattagaagtcggcggcgtcgtcggcggaggagaagaagaaggcggcggtcggacgaggagtagaaggcgacgtcggcggaggaggaggtggagtagaaggcggcggcggcgttgtcggaggaggagaagaagaaggcggcgccggaagaggattagaaggctgcgtcggcggagtcggaggaggtggaggagaagtcggcggctacgtcgtcggcggaggagaagaagacggcggcggcggctggcggaggagggggacgaggaggaggattaaaaaaaaaaaaactttgcttactgtcgcggtagcattttctgcatcgctgcacgcaccttgtccaatttcttcccggtcttagctcgatctccagattgtgcccatacctaacacaaatggcgtcccacctcgacgcggccgcgcttcttcttctctgcctcgcggtcggctgcgccggcttcctgggaccgattatcgaggccctcgagaacggctccttcacgggcaaccgtgccgttgacgccgccgccggcgacctcctccgcctcgccctccccgccgcctatttcaccggcataatccttgtctaccgccgagtggctctctgagtcgccggtgatcgtgagctcggccttgcttctgcttgtgtctctcaattgtcatagcctcgttatttggggattctttgagatttctgttcaggtttgagaaggatttgggtcttaaatcttaatcccctgtggcactatccgaattcatacggggcaattcatcagagggaaaagccaagaaagaaattagagcacggctgaataaaagatttgacctttcaggatgtcctttcttggattcacaagagagtgctccatcacggcagatctcgaactttgtatatttcatcaagtcgtcagcatgatccaggaaagaatctgttgtacctatcactaccaagctggtccgtccatgacagtatgctgatatgctctgccagtgactaggaatcttgggcaaccagtatgctccggcgaggcataaggtggcacatggtgacatggaacattccggtccttgcattgaaatcaaccagcgacctccagtgtgcttgatgggcctgaaggagaagaagaatcatgcaccatagagttttctgtaaatttatcatgtacagcaatttacaatcagctgagtgattggttttcttttctcgcaaatttcagtcctgcaaggtatacatttgttttcaatcagttgtgccttttcaagtcgtgctacaaagcagttatgtgctcagttgcagaagatgagtgaattgataaagagatagaaaagaagataaaattaacactgtttttctcctctttcttccaagttaagtagtaaataatcttgacctttgcaagtacagaaggaaccttactgatgacttttcccacaagtgggaactgaacaaatgatatgttcgacaacaaaccatggacttttcaaaaccgcatccacatcagcttggacccattcttccggccctgtatgtatgtttcttgacaaatgacaagtttactgtatgtttcttggcattaacttagtatgaatagttctcaaaatgaaaaaaaaaaaacttggtatgaatcatgtaatattcccggtatgtatcctgtaagaatcttaactgctttaccctgtgatatttctggtaggtcttcctgaaagaattgtaaccatgcgccgatgcgcgctattccagtagtctggtgcccaatctccatgccagcatgatcacaaaactcctctctgcatgtcattcatttgcacttggacatctaatctctgactcaaagctctcttctgttgagccttgctccttccatgtcgtagttctgtccaacggctgccactgaaaacccggccacccattgatgaagatacacagctcccatcttgaacctgatttccttcttgtagtctagctagagcacatgtaactcaactggcttgcttgccaaagctaatagggctacattggaacgaatgaattttacaggaatctgttaaaattcccgcaaaaatcctataaaattcctccgttccaaagtaggcctaactttgatcttaaagggagcaaatgaaaagccgcggccatcgaaaacggcgaagcgcaggagctatcttctacagtgggcaagctatctcagcgaaggcacaagtttgcaaagcagtaagcaccagcatcaggccagcaacacatattaatcgatggagcagcatacatatgatcgcacgatttatatatgcgtgtgaacggaaagccagcgattccttttcggtaaggaaaaacatggcgcggcaatggcgacatctacgccgaaatcgttgaaagataagcactaaatacaagtttaaaaaggattataagcactaaatacaagtttcgtggaagttgcgttcgttgaaaattggacgccgactccactggcgaagtttcgcggaaagccctggtggtggaatttctgtggaggctggccggccggcgacggggacgaagttggtgacaagatttcagtttggagttcggacgaggagaacgaaccggacgtgaggggcgagaaactaggcacatcggatcggaggctcagaatggtcctttgcgattctataatttgactaaacttttttttttcggggaattataatttgactaaactattccttcgtttaccgggatcacgttctaaactgcacagttttttccaaatattttatatgtaaaagtttgttttaaaatttaaataagcttattttataaatttataataatcaatacttcacatgttgctcaaaattttaggcaagcagccttagtgaaagggtgtactagttgtgtttttccccttttttttttttggtaatgtatgcttagggcccctttgaatcgtaggaatgaaaaaacagaggaataggaaaaacacaggattctgacaggaatacaattgtaaaacagaggattgcaaaacacaggaaaaacacaggaatggctgtttgattggaccacaggaaaaacgcaggaatcagatgagagagatagactcagagaaaatgttccaagaggttagacctcttgctaactttcctccaaaacccattccataggaattttaaaggattggataggattcaatcctttgtctcaaaggctttcataggatttttttccataggattgaaatcctccaaaattcctacatttttcctacaaatcaaaggggcccttaatgtgtatgcaacaattgatcataagggtgggacctagtacaggtaacattagttaatgccaactctacaatggctatggttgtgaaatagaatttaggtagacctcacaaggtcccactaaatcttaaaaatattgcttctcatctgctcctagtgaactagtatgaacaatgaatcaataaaaaaagtatattttattctcttatgtgcaggcatcctattttaatgttttgtaaaagatatgagagtaaagttaatattcaattttgaatgggttatagttgagataatattttttattctattttaaacttcagagatctctcaaaaaattatttgagattgctttcaacattggttatgatttcattgcaattaccgtaggaacacatagattgtaaactaaaattactatgaaactgtgaaatctttaccactattttacatgttgtgaac

SEQ ID NO: 64578 - DNA, 1947 bp, Oryza sativa
cttaaacaatgtgccatactatgctgcaaatggggctaaggtgttacgcataagctatttctatgataccaaaggctagacatgctttgtacgacacgatatgatgctcggatcatctaccctttatccgttatttgactaaagactacagtgaatttaaggatggatgagggaacgcagtcaggtccctaaaaataatggcaccagcaattggtgcatagggcatctcaatattaaagttcactgatcatgtgtaatttcatagcaaaagagagaacttaattaagtttttttaaaaggcattagatatataaccatgtataataattgttctatcccgatttatgggaaaaaaagaaacagttatagcaaaagagagaacttaattaagtttttttaaaaggcattagatatataaccatgtataataattgttctatcccgatttatgggaaaaaaaaagaaagccaactgtttttctactcttacttcgaatttataggatttctaattttgttgaaataccaagagaagttctagatgtcttaggagggattagagtgtgtttaatggactttgagtagattttctcaaaattctagggagttggccgcgtactttgatgaccatccttttgaatgttattgcaaattattttaaaaattggacatgcaaattaaggataaattgaagatcggatgattaccctattaaataaactaggaaggaagcccgcgcagatgcgtgggcaatttattattattattttatgaaaaaaagtcatatatcaacataaaaaccatatattgtcttataaccttactgtaaaagaataaaatatttataccgtgaaatagaccatagattgtttcagttatatgtaaacttacctattatcatcctttgtaaacataatatgagtgatgatttttttattatattatacatctaacttccctatacatgttcatgggtaatatacaaaggaatactctatattgtcaaaaatatttgtactaattgttagcataatttatatgagaacaacataattaaaaaagataaaatatggttccatatgacattttggattgtacatatgtatgtaaggtttttcttgcgaatggcagtctctcatatctacatactttttcatgtttttttttacaattatttttctctcataggaggtaggatctgtgtatgtgcattcatagggtgggtgtgcacatgtttatatggccgtctatgattgacttttacattgttagttaaaaaaaatactttcaagaaaattggccagagggcatgaagcagcgctatggcagcgcggcttcttcgtcaacctcgcatagagtggtcactacatatatgcataatttgaggaaaaccttagggctacaaagaaaaaaacagaaaattaacagacggggtggaccatatatgcattcttcttttttgtttttgacatctcttgtgtatgcacgtgcatatagagggattagctggttcttaggagcgagggcttacctgaatcaatctaatttaatggttgaaaataatggattcaccggtttaagtgcaaatcgatggctatatgttttgttttcccctatattttttcttaaattttcttctatttattagagcatctcatggcatcttcaagtgtttgtaggagtataggacactattactcatactcacaatctacttgtagtcaactattgtttattgtgattttgtggcaatctctatttacctatgatttattgttaatggtttcccacttagtatcatcttttatctttgttgctttgatgacacacgtgtttactgcatgtaaactaattattaggtgcattgtgcagcccaagcagttgaaaacatatatttttaaatcatatatttttattgtatgttttttaccatatttgtggagtaata

SEQ ID NO: 64579 - DNA, 846 bp, Oryza sativa
accacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcccagagatggcacgttagtcctggtcagatatatgccaggcttcatcctaaaccattataggcaagatgttgtgtgaagaagggcgagcatgtagattgctaagctgacacgtggtggacaagaatgaccgacgtgactagtctgatactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacctagaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtca

SEQ ID NO: 64580 - DNA, 7272 bp, Oryza sativa
  unsure (1)..(7272): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccagcgcggacgccggagtcggcggccctcctgagccccatcttcttgacgatgaagctcgccccgatgaaggcgctcgacgacaccgcgaggaccagccccttggcgttgtcggtggacatccccgcgagccccgccgccgcagccgccgacgcgggcgccgccatcgctgccgcagccaccgccgcaacctacacttcgcccccgccactgcacggttactactccaacgccgccgccgccgacgaggaggtcatggaggtggaggaatcggaagcgggagggaaaggtagaagaagaagaagaagaaggtgagaagaagtgggaattttaaggggagggggtgtttttgcgacggggtcctcgaggattcgctttattaccaaatcctattcttttttgggttagacaagtagtatccgtttttagaacggtttacctaaatattaaaaaaaaacttgtctaactcttctagtttttgttggattaggcattgcattctcatctcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagcttcaagcttatcaaatttcatttattcacctatatgtctgcagcgcggtatataattctatctttaattattgtcataataaaatctgtctaattcttattccttgtttatttttcaaaaagaaaatatacatatcttatttaactcatataactgtttcctacacattattcgtcatctcaattaatcaatcacaacattctcttctttaattcatccgtctattttcgcatcttaacatatcatcaccatttctcattcaaaccttaatttatacttaaaactccttaaaaatactcatgtctcgaaaacggagtgaggctgtgtttgcaactcctttttcccaacccatctccctcgttttccgcgcgcacgttttttaaacagttaaacggtgtgttttttacaaaaagtttttatacgaaagttgcttaaaaaatcaaattaatctattttttaaaaaaaatagccaatacttaattaataacgcgctaatggaccgctccattttccgtgcggagagaataagttctcaaccaccccatgcgaacacagcctgagtacatgacatagaagcactattcgtatcatacacgctacatatgcatccggaattctaggaggaactgtggtaaacctaattattgggattggtcaccatctagtagtacttaatatgactagcacatgttcacttcaccggtgggactttactactacgtgaaattcctcctcctttcacgttaaataaaccctttacaattatcgccacgttctcctatcttatattagcaaaagttattatacattgcattagagagaaaaaaaagtaccacgaataacaaagtgagtttgttaagtttcttgtgatgcaatcagtctatccggattcaagttattgagttgatacggatgttcgcatttacagattattgtttttcagtggtaaacgacgtaaccatcgacaacgagacacccataatgacgtcattaatcttaaaatatgctgaccaatttttcgagcgcattcgtaaattttaggatataatatttcgttctttccaagattagagtgtgtgtgtgtgtgttttaacatatatgagtgagtgtgcgaacgtgagtgcgtgcgtatatgtacgtgttttttattaatactgtgaataagtagtataacgagtcctaatttcacaataccgagactcccaagggaccaaaacgcaaagagccccccgaaattccaggtgaatcgaaataaatgtgtttcggatggcagggcgtgtcagaacccacccaaccacgcggctgtcgcgtcgtccgatccgtctgtccatcaccgcatcggacggtggaggcttctcccaggagaggccggggtggcgttggtacgtggggacggttggtctggatttttcacattttggtccttttaaaaaacttatttcacaaatagacccctaaaaaaacttatcccagaaatggtcctttttggggc

SEQ ID NO: 64581 - DNA, 13511 bp, Oryza sativa
gccagcatggctggcgccgccgcctccatacctgtttccctgtatggagttgcaacggtgtcatttttattttattttttcggatgttttttcacactcaggatcacgatacaaccaaccacaaaaaaaaattaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaattttttttatttttatttcatttttttgatattttttcacacttaggagaacataggaaccaaccgtataaaaaataaactcaaacggacaaaatatgtgatatgtagaatttttcaaaactctaccgaaatggacaaaatatgtcatctattaaaataggcataactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttgaaaaattccatatgccacatatttcgtccgtttgagtttattttttacatggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtttatttgagttcaatttttctatggttggttcttgtgtgtccctaagcgtgaaaaaaatatcaaacaaataaaacaaaaattaaaaaattcggaggggggggggcgccagccactctggcgcactccccttagccacctcagcatcgccccgccacgtcggcagggggacggcgccaaagaggctggcgccgtcctgttgaacaacggcgccagccactctggcgccccaaaaaggaccatttttgggataagtttttctaggggtctacttgcgaaataagttttttaaaaggaccaaaatgtgaaaaatccaggacggttggttgggttgggacgggttcgggagcacgtggaatatgcccttgccctcctgtagttctgtactaccggatgaaacggagcaaggaatccgccacgctggcgcctcctctccattttcatggtggctctcactctccaagcgaaaatggatcggaattacgaacgctgatggcatgatcgtagctaggcccggtttattccctaagataaacttttcaccctgtcatgtcatattaaatgttcgaatacataagagtattgtaaaaaaactaattacacaaattacgtataaattatgagacggatattttaagcttaattgcgtcataatttgacaatgtggtgctacattaaacatttgctaatgatgaattaattaagcttaataaatccgtctcacattttacaggcgctctgtaatttgttttttattagactacgtttaatacttcaaatgtgtgtgtctgtatatccgatgtgatatgccaaaacttttcatctcgcaaactaaacaaggccctactaccttcatgtcaaaatataaaaacttattatcggattgaatattttgtagtataaaatatctagatagaaagtctatccaaatacgttgtattaagaaacgtctcattcggtactagattcttatatgttgagacagagggagtacgtaaaaaaaacagtagcgaaagagaaactcttactattcccactatcctagttcatacgtaaaaagacactttttagaaaacaaaggtattactagtattgaagaaataaaatgtctcaatttacaaccgaggatagttaagagagtagaaataaatttattttgtgataaattttaaattgtaggaaacttattttgcaggatggagggagtccttatcagatgcaaccaaaactaaaatttaaaatgaagttgatttgggggtccttttctttgtagtttattttttagcattggcttttaaactgatagtaacacaacttctaccgataatttacttcacttgctagtcgtaactcaaatgatcagaacatctgtctattttcttgtgtcttattggtgatgtagtttgtgtaagtaacaagttgtctctgtttcatgagaagccattattatcatgctgtgtaacttcagccccgttcttttctccaataaaaattgtataaatttggatattcatggcacgcttttcaaaattactaaacgctgccgtttcgtgcaaaatttttatatatggaagttgctctaaaatatcaaataaatatatttttcaagtttataataattaaaactcaattaaccatacgttaataccatctcattttgtataaaacatttcatctttattacgagtttcaaacaccatcttcatttcctaatggataatcatccatttataagtcatgggtttggtcttatacctacagaccttccatgattttgatattagaattatgtttgatgtacaattcacatactctctgttcaagaaaaaaaatccaacccttatatcctgaggtaattttagttgtgagaaaaaaaatactacataacccctcgttaatagaaaatgaatatgttggatgcgtaggtgagcggtacagaaggaataaaagttcttgatcaatgaatcaatagtaggtaaaaatgtagaagtttaaattttaattttaggattgagtctatctgagacacaaggagtactataacagctggtttaatttggtactacaataaagagagtccacgggattttagaggattgtttctattacaaatctgaacggcttgatggtttttactaagtccacattgtgcatttttcagatagtactccgctgacttaaaaaaaggacaaaatgcagtgcaagccagccaaacaccgaaacacgtatagtactgtagaagtatttatatttctgaccaaatacgtccatgtcgtgttctgaatttaggacgtgggagcctctatattgcctgtctgcctgacatagattttcagccaaagccaaaaataagaagattaaaaaaaaaaactctttgttcagttgtgccaacttacacacctagaaaacggagagaaattaattaattaattaatgctatgtcctactcctacagttgactgttgtcaatgtcactccgttgtcctgaaccaatttttttaagaacaatttgtcctcaactttggcccgtgagtgacacagaagcagagggacagttattatagttgcatttgctccaaagcaagtactacaccaagcaaagtcagagtgtttacagttcataatatctgtttttgtttcctcctcgtttaagccagggctgataaaccgtgaaataattataaaaacttctaaaacagtatgtgttattagtggtttaaaaatcaatttttaaaaacacaaggataaaaatactctaaagtcaacttgttttaaacttcattttcaaggtgacaaccaacagactaacaagctattaaggtaatattgttatcgttttgcatacaactaactataagtcataacgcttactaacgataaaaaaaaatgatgataaaacttttataatgtgttctgaacgacttaaaaattcaatgctaaaaaataaactaggataaaaaaaatcaaaatcaactatagaaatattttttaatattaaattctttgttgcagttgataagttaaatagcaaacggtacaattcacagctagaaatgcgaaagctgccgctactgttagctttggctacttgccagttgccactagaaagctgctcactcagcaagacagcaacagcttatcttgtctccttgctcatctcatccctcaccttccccttcaaatgctttgcattacatatttacatcaacattccatagtggcaaaattgcaaaaaaaaacaaacaaacaaacaagcaaaaaactctagagagtaggagtagaatctagaatctctctctcaagtactccctccgtactcgtaaagaagttgttttagacagtgacacggtctccaaaacacaactttgatttcttgtttctataaaatatatttattgaaaagtgatatatgtatacttttatgaaagtatttttcaagacaaatctattcatataacttttacatgttcaaacttaacaatttgatagttattcatgatttatattcctaaggtttgacttaaaccttatcctaaatgactttctttatgagtacggagggagtagttatttaattattcagataattcaggggatattttagacggtttcatatttcattttcttttagaaaaaaatggtttcatatttcggggctgattaagtagaaaaatcccgtagtataggaggtaaatagattatacatatttctttctaacgtgaagatgcatagatatactatttctttacttatttataagatacggtatagttggactcatgtaactaatcattactcaatcgttacaggatcaccataaagtataataaagtataagcatatactcttcgtctcaaattaaaaaaacccaacctagtattagatgtaatgttttctagttaacagtacgatgaatctggacatacttctgttcagattcaactagaaaacatctcatccaatactatgttaggttttttttttggacggagggagtgtggagtacctgattacttggttagtggtttacaataaggctggccgtatttagtttgttgggtgtaaaaattttgacgtatgcggacgtatatttgaagtattaaatgtagactaataacaaaacaaattataaattccgcctataaactgcgagataaatttattaagcctaattaatccgtcattagcaaatgtttattgtagcatcacattgtcaaatcatggcgtaattaggctcaaaagattcatctcgcaatttacatgcaaattgtgcaattggttttttcgtccacatttaatgctctatgcatgtttccaaatatttgatgtgacgtttttggctaaaattttttggaatctaagcacacctagtgtttagttcccttcaaatttccaaaaaatccatcacatcaaatgtttggacacatgcatggagcattaaatgtagacgaaaaaaaccaattacacagtttgtatgtaaattgcgagacgaatattttgagcctaattgcaccatgatttgacaatgtggtgctacagtaactatttgctaaggacggattaattatgcttaatagattcgtctagcagtttatatgcggaatctataatttattttgttattagtatacgtttaatactttaaatgtatgtctgtatacataaaatttttttttgacaaggaactaatcacggcctaagttgtaaacatgaggcccagcttggcatggtacaaacaattttagcttttggaactcacacgaagatgtgacaaaagttgttgggtacaggccaaggaatgcacggtgacatgtctttgatgtcagctttgtgtcttgggctgaaaacaccctacaaatgcaatgtacagcctgtactatattggagtactctgaaagtctccattcctactttgctctagtagcctaggatcatgtcataaaatttgaacttgaaagagtgaccttaaaatttgactctagcagctgcattttgtctctaatacgcaattaagtttgattgattttacaccagctggcaaattatacataggactttcatcttctcaatataaaccatccaaatctaatttgtcttgatgtccatccactatatatcattcaattgtctgcatcaggtatattcccattgtattagataacgtgtctttaagagacggctggattgaggtatgatctattcatttcaaatctcctgacaatatgcctagaaaataactataaactcaagtatgatccattcatttcaaattacatgccgttctagttttgtcctaagttaaatatttgtatctttcaccatattctagacacgtgatttaacatcgtgagatttatattttagatttaacataagaaatactttcataacatataattcacgtgttattaaactacacgattttttaaaaatgatagttaaaggtaaaaaatatttaacttgagataaaactgaaacaacagacaattttaatcagcgaaagtagctgaattggaagttctatggggagtaggagtaggctctaaagaaggcactcctgactgagtagtcacatttcaatcattagccttgctaaagttgctagctagggtacctggatatattaacaagggatttactaattaatcacctcacttagctaggtagcattcatagcaaaaccatcattatttttgccgccacccaatgatgaagggaggtcagggggaattgttgaccagcatgcatatatacccagctcgcctttggaggctgaacatgcaatgcggcgacatggggccgaaatgaggtatgatttatttttttagataatagaagctttattgatctcagtcatctgaagatactttcggcctctgcaccacgatagtgcacacagccaacaaactccaacatactcaaaacaagagagaaaaaaaaacagcatgcaagatcaatgccctataacccgaagactaggtcgccacccatatatcggggtaaaaaactccttgaccacttgctccaaatatagacaagccgaagtgacaaagtcctgcaaattgggtttctagagaataacccatgatcggagccaatgtgtaatcaagaaaatagcctgcaaaggagaagaaacagctttcctatcaaaaaccacatcattctcatcattccttgagagctaaattgcccagcaagttgttgccgcccctagtaagactagaggtctaaactctttggtatgtcataaaacccactgcccaaacatatgtgacacgttcctaggcgaacaaatgtttgaagcaatctggattagagaccaaaccgaccgtgctaggcgacattcaaaaaataagtgttttatcgtttcttctttgtggcaaaaacaacagatcttactctctttccatttccgcttagccaggttaacttttgttaacaccactcctcgacgtagataccacaaaaagatctttactttaagaggcatttttaacttccaaatagttttgttaatattgggagctcccgtatgagccaaagcaagataatgagatttaaccaagaatcttccagctggtgttagattccatttaaactcatcttgctcatgtgacaaaactatattagcgatgcgtgggaatagatgattccatgccactaatttagagccaataatatccctgcgccaagtgaaatttcatgaggtatgatttaataatggatggtcacctagctaattatgcaactttatatctatatctataccttattaaaaaataggtaaagcttctgaaatattttttgtccgtgtccgtctttttttccaactgtttttttccatcacgcttcggtttggtattcttcgatctcatctgatctattgcacgccgccgccggaccaaaacctagcattgtcgccacatcatctccccgtgtgttttatccccctattgaattttgtggatttgttccaattttgagaaaaacggaaagagaagatcgaatggataaaaagccctcaaccaattttgatagattaagaagaaattggctggatttgatggggatgaacggctccggcatatatgcaagagactatctaaaggtcggagatggcagtcggctgtgtgagttgggcctatggctccacttgtgggctggaccgaagagaggtaggtcatgcggagggaagtaacggaataggctggggctaggaaggaaagaatggactttcatcccaaaaccaagaagaatttttattagctttttcaattataatgtatagccatcctaatgttttaatttattgctcagtttctaatagctattgtatcactgacaaaacgtttttatccgttgcaacgcacgagcttttttagttagataacaaaagcccataggagttctgatcaaagttttaacaacggcttattctttctaggtaaaggacaaggccataaaggttgatctactccttgtatcctagattttaattgaagtgtgcaccatggacttgttttggataacagatagtactcgtatttcatttgtagggaacatgcatgcgcatcgatcttgcatgcaatttatgagtggaacactttttttttaacacagtacaggcgcacactcatccttctgaactcacacacacaaacactctacccctatgaacatctccgagagactagactggtatatattgagattgatgaagtgtttatgggtgtcttgctctcgacggacacgtcgcctccaagaaaaatgcttcgtagaggcatttttctaatgccatagaaaacaattttaaaatacatttacaacactatatcatttaaaaaatatgtaatgcgtgccttattgtgaattaatatctacaaacgaaaaatatccgtcttgtggcatttcaatagaggcgattttttcatgtctataagataaatccctctatgtctcgtggtattttaatagagacattttttatgtctataagagggtagatgcattttctaaagatattaaatttcaccataatcatatcaaaccaatgttgaaaaaagagcataaactatttattcttgctactgtcaatccttgaactcaagatcttttaggcaactcattattatcttcaatgcgttgaccaacttaacctcatgtcaatacttgtaaggttatggcgtgtgttacttatatttattctcttagtatacagtattattcttttttagaagtgtctctgcagagtttaaaatatctcaagaaaatgtctttacatatcaggcatattttaaagtggtgaaagaatacctctacaagagaaaatttaacaaaatatactaaaaatatctctagaataaaagttttttaaggcaattcttgaaagtgcctctgaaaattgtctttacactgtaaaactcctaattttatagacaatttgtaaaatgcctctgtgtgaggttttttgttgtagtgcaaaataattagtcataaatatgaatacgcatgtcaagttagcacttaaatctggttgggtaggttccaccataaggaattgttaacaccaaaaattggtatggtcttttagtggattcagttatcgaaaaaagccaattggtagaacaaagtttatcaagatcaagctgaattcaaagctgaattcaaagaggaatcgtgaagaccatagcaatacagtttcgtatttccttaattaatatatctcttagataggtaggattagttatgctccttttcttgttaggaaatattatttcatgttcgatatagacttgtacctcctcgagggtataaatatgtacacctggagttttttaatatcatccacagatcaatacaattatatttcggaaccggcaacctttcgacgggttcttgtttttgggcggggctgcatcgattaagttcatcttcggtgagaaaccaagttcagggccttgctctcaagttgggcttcatcgtttcaatctccagtgaggaaagtaagttccgtcaacttcgcttgtatcaatttggctagaactttctcggttatgtccaatattctattcaagttgatgcaagcattgcctatcagatatatcgactctatctttaactgcatcgttgtttagagttgtattggattaattaggacttcctcggttaggtccgatattctgactatcttggtatttctctaatcacattgttgttttagattgtttcaatatatccatcacaattgtgtagatctatcagctaaataggtttttcttattatcttcaatcttatattatctcggttaggtccgatctattagattgctgctaataagtttgattctactaagtcaataggctattatacaacgttttatcggagttctagtcgatgagttaccattgctagctatgggctttagctataagatatatcggttagttagccgatgtatatatacacactatatcagtatcggccaattggtttattggttcaatcctttctattatccttgttagttgcaagatcaaactaaatgacacacctgaacctcatcaaaatttaggacttgcaccagagctaaggaaatctcttgaccttcgtgtgtggcaccagattttgcatcaacaggaacctagctaactaattgagttacgctcactgtgcaaatggaacacgttattaacattagtagttattgacttactgcaacatctatttacattttgagccattgcatgattatattatatatataataactcttatacaacaagtatcaaatatattaaccatcattgcaatgtcgtttttataccaatattttccatgggacgtacgtgcaattaatcgacgaaagaggcaggcttctactcaccaccaaatatttgtcacatatcaaatcaagaaacaacgaaaaagagagcagttttatgcacagttcatgaatttggatcacaaagtagttattgcaactttcttcattccattgagaactataggtatatatatgcataagagtagtatttttgccattgggatgtatgattaaaacttggtatccacgcaagaatttaattgtaccaaaccgcttctggttatcaaacatggcaatacataaatattttttcattgtagtataatcatgtaagatcttgttctgaagatttaattacaacgaacacaatggtgtaatcggattatagatcggataaataatttgagagaaaacttattaagaagggggaaatgcatgcatatgtaatagaaaaaagacttagcatgtgtactggcttctggcgttgcgtgataaggcaatttcgagaggcctctctgattattttttgcgaatttgtaagctatcgtgaagaaaggaagattatacagattcttactaatttatcatagatgaaaaatctctatgtttgatgtggtattttaagtagttttcttgtttctaatcaaactgggactctaactcgtagtcatccgtcctataacctctgtaataattggttgtatcttcttttaagtaaagaccggaatgaattccattattaaaaaaaaaacttggatatgtatagatattttgttttatgccatcgtttgtgctacagtagcatagtatgctactgttatatcctccaccatggtatagaacacatgcaaactataaaacataaagaaaatgttacatctttttttgtctcttgcgagcttgattctatcaaatgtggttaataccacaacttatacatgacatctgattgcatgttttataccccaaaactgaatgacttggtgaatttggaccacagcttgtgacaacagctaagggggtgtttgggaattagagactaaatttagtccttgtcacaaaacataagtcccaaacataagttctatgtttttatgagagggactaaatttagttcctagttctcaaacacccccttagctgttgtcacatgtcctcaccaaatgcctgccacaccatcaaacaaccaattaacttcataactattatgtgtgcctgtaattaatgttgttctcacaggaaagctcaattccatgcagacaattgtactacacagagtccaagtcttcaagatttttagtgagtcatctactggaccagcaatgccgtggcttctgagcctttcatgccatagacttggtcacttggacaaggcccctcaatcctcatgcaatggtccattattcttctgaatttatcctggacaataatatgctcagatccctggaacttggataaatccaagtatatttcttaaaaaaactacatttttcttctcaaataccctgattttctttccaaggcctaaaatctttaggcatattgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatcaatgtatgaagaagctccaaagagctggagagccagagagctcttactctagaaaccctcttctcccttttttcctctcgtgggatctattctccaaaacctcctctcctcccgtcccctatcctaagtgggcaaggtcctccttttatctctccaggggataccacatgcaccacttctacctatctctcttttgtgtggggacttatcctctctttactcaaacttggcttgccttctctagaaagctaaaaacactgcttgtttttgagtgtggccacgcgtcctcactcgtctgacctcggggatcaccttgtcatctcttcataaatgggcggagacttgcaatggctgctgtccgaatgaccttctgatgggatggcccatacctacctctactccgccggaagcaggtgcaacgtgggaacacggttgtctgccgacgacatgaccagtgtcagatcggtcacaaatcggtcattcttgtccaccacgcgtcagtctagcaatctgcatgttcgcccttcttcatacaatatcttgcttgtaatggttaggatgaagcctggcatatatctgtccgggaccaacgtgccatctccaggagctaacacgccggctccggctagggacgagtgcttggaggctctcatcctgacgggatggggcgaggcgtgcgtcagaccgcctgtcgccacctaacccacgatctgaccggcctgtgactggtcacagaccggatagacgagcgcgctgcactgcgttatatgcggtgtgacgcgctcgtccaaaccgcaataaatgcggttaggtgagccccgttgtgctcacctaacccatacacgcggcgcaaaacccacaaggggtcggggcgcctcacccctcgggggcgaaacgggagcggtccgacccctcggggagacaaagaggggggcggccacatcaccctcgggcccgacccccccgagggggtcaggccacgtgggtgattgctcctgcccaagcctctagtcatgatactcccggtcccatgtcaccgacacatatggacaaaaaatacgggaaggcgtgtcaa

SEQ ID NO: 64582 - DNA, 12031 bp, Oryza sativa
tccgactctatcagatgactacaacgttgatgtacgcgccgtcagcagcgtgcagtacgaatcctcacgccgtctcgcaatgtgttgctacgttgttttggtcgtacgccggttggatggatgggtcgtacgtatagcatgattcttttaatatataacactattaacttttagacatgataagatgagtaatcaaatatatgctcatatttaaaagtcaaatagccttgtatatttttttaaaaaagaggaaacatgcttttgttcaaattaattgtactagaaaacatcacatcttatgctaggttgattttttatgagacggagagagtaatactgtttatcctatacaagttgctgacaacgatacaaagacaaaggtagtgataaataccaaactagcgatatggggtccttatgcttgcaattgctgctagcatcgcagcgaaggatccaaatcactgaccaattcaaacagtacgttcttactgtagcaacagggtgttgatgctggcatgttgctgtgagacaaagctgtactttgctcattctactgtaccagttcaatctaagccgttgatcatctcatgtcctggacggtagagaatgttcccccaatgcaccatttactgttggcctactccctccgtcccataatataagggattttaagtttttacttgcactgtttgatcattcatcttattcaaaaaaattttagaattattatttattttctttgtgacttactttattatctaaaatactttaagcacaacttttcgttttttatatttgcacaatttttttttgaataagacgagtggtcaaatattgtaagccaaaactcaaaatcccttatattatgggacggagggagtatatatgttgtcatggaatggggatcacattcatggatttgtttgatttgtatcaatcatgcatgagatgacttgtcacggtcgtacgtgcaaatgtgtaatggagaatcatattagatcacctttagtacacacacaggaatttaagtgccatgtacttagaatccctatggtttttaaaagggcaagaaagtttcgtaattgtttctctgatggcactagtcatatgtccatacgttgcaacaggattttcagaacgtgatttaatttgatatgagaaacatggttcaattttttccaccctatttttttttcggttggtttcagtttgtcttttcactggtttttttttaatatgtaggataggaggagggaaggggagaaggacaactgcttttacctagtagagaaaggattgaagcacttacactacaaagagataacatgtggtaaaacttcaaaaatttaattcccttgcaagttcctattctctatttttgaggagtcctaaacattgtaatccattgtatggaccaactattactaaagaaagacaattggacttacttttttctatgagaagtcatgtatttcgaggaaaaaacaagccattctgacatttttgagttggcaagagaaaagttatatcctcaatgattgggtctctacttctataaataaacaagtagtagtagtagtaacttcttttgagtcaaaccatcaaaaggttccagctcccactgaattgccaaatctttttcttataaaaatgccccaaaaacatgagtgttccacctgttaagcttttttacttgctaatgtcggatcgatttatttacagaaaagatttttttatgtatattttggaaacgtgacacgaataatccgtttagaacaaggccttgccactttgtgcaactgtacaatcagccatcatgtccttccaaaatttttatcggtgttgcatcctacatatatagattctgctcgatttcattcgtgctagtttcagttagcaccatgataactagatgatgcctcatacgcgttgctgcgtgacttggttaacatcaatttgttagataggaggtacaatctcaagaagaaacagaagaaacaaatagctttcttggaaaaattctttttagcatctctatccaaaatttgtagataatttaggtagcacatgtcaactaaaggggcgtttagccataaagctcttttatacggattgacgggctggatacatgtaaatgtatgtggagatgggccaatgtgttcatgtgggctacatttggcactgaggaggcaaagagacttactcggtgactaatgggttgggcttatatgctggattccatctaacgtctgagaagcgatctaacgcattcatccaacggttcacaatttgatgatgacatggacagtggcgtagctaggaatttttcgttggatagtcctatttcccatgacgggggataaaaaaaatttaggtgtgaccaagtacccagtagatagaaaaagaatgatgaaaaacaagttatactacaatatttacaaaatttgtccatagtcgtgccaacttatactacaattttaatatcaccatactatctaatatgcatttacaaaatttgttaaagaccgcctaattcaaataaaccatcaaaacataaacaccatgacagaaaaaaaagacagctagctctaatctaatcgtataaacaaactcaaaacttgacaaaaatgcaataacaaatatataacactctagagttgtcaggctaactaacaagtttaagaagcatgatatatcagtaagtatagttcgttttgcaaatgatccatgaattgtaaagactgaataagagcaaatcaatttaagagtataaatctcaaaggtaaatacgaaatgctttagcaaactttgtggccaaagaaatttattttgatagtggggattaaggtctctaggctagaatctagggtagtcctgtgcccatatagaccaccagctagctacgcccctgaacgtggaagcacgaggtttgagcttttggccttaacttcatagtaaagaaagaagagattacatactctagatatcccacatgcctatgtttgaattgttggaatctactaaaaggcatacctagtaactaaaataaatatttcccccatcccaaaatataaaacttttagccatcaggatttgtcccaaaatatactccctccgtcccaaaatataagcatttttggatctgaacacggtctccaagatgctattttgatcaacaatatctacaaaagtaaaatgtcttgaataaaaaagttgcatattatgatagttcgtttaatgataaatatagtaacatcaaatttacatgattaatctttttaaatttttcactattaatagtcaaaatttaaaaagtttgacttggcactattttaaaaatacttatattttgggatggcgggagtaacaacttttccgccaacattcccttcccaaccaatcacaaccctcaaccattcactttttccacctacctccactactcatccaaatacaaccctacaccatttacttctacctactttcttaataaccgtgtttaattctaaaacttcttatattttgggataaaggttgtacttgttaaacactctctagcttactactactatcaactactgctgctgctggagtactactacacccatgctcaatgtgtagcaactcaatgtgtctagaatcttatcacatcaagctaactacacccatgagaaacaatgcagaggcagccaagacaatctgtagcattctcttcctttttgtgaaaaccagtgctgaacatctcattcagtcatctttactctttaccagaaagtagcagtactacatgcacaacagcatgcacagagtaaggcagattccatctttccaagcaacatcaaacatctttggcagaaagccatcagaaaaaaagcaatccctgaatcatctgttgggctctgcataactgcattgctgctgttgctgttgctgtcacacacatcctccctccaaaaaccattcaattgctcatgctgctgctcctgcacatgcctgtctatggattccagcttcccttttgcttttcaatcacactaacaatgcaacagcaatcctttcttttttgttactacaaaatttttgattggttggtccaactccagtgcaacaccttgcagcttatgttgctgttaggcaggtcagatgcgtgaacattcttcctagggtggtgtatcactgtatcctacagcctttgtccctttttaacactggttgtatatagtaattagttgcctgtcatttgggataaacagtgcacactattaagtaatcagcacatcatcactgcataattattgccatctgatctgaagcttcaggggaaccatatccctgaatttcccaacagctgcagatttcaagtaggtactctagattaggatgctacatcctactacaccctagctacacaacctttgtccctcaactttggctctatggccctgtttagtacacactaaacttcccccaaacttccaactttccatcacatcagatcatatccaaaactttcctactcacataaactcctaactttttttttccaaactaccaactttccccaaacttctccccaattccaagaactaaacatagcctataatagagaggcagtggatcaagcctactccctccgtccctaaaaaaaggttaacatagtacaagatgtaacatttccgagtactatggatctggacagaggatggagtgagtaccattttgcataaacagtgaaaactaatcatcatattatcactgcatcattattgccatcttgtctgaaactctgaatcttcggggtggcaaccatatctgaatcctcccaacagctgcacatttcaagcaggtagatgaggatgcttcaccctccatgagtgaccacttgtcatacaaacacaaattgtagctatcaccattcatctcatatatatatatatataggaggaaagtagaccgagtaatggtagtagcagtagatacatcaagaacacatagacacatacacatcaaaaaaaagatttgcaacctcgttgcaaaccatggaggagttcaccttcttcccagcagcgacgtcgcctcgccgcgatcatcggctcggcctcgtcggctcgcctccaccgctgctgttcgccgccgtcatcgaggtcgacgacggagatgatggagaggaggaggagaagatggacttgctgtgggaggacttcaacgaggagctggctcgcgcgccgccggtgtgccctctgagcccgctcaacatcaagggcggagggctgacggcgacgacggcgatggccaaggacgacggcggcggcggcgagaagcaggcgaggcgcatgtactccggcagcgtggtgcggcggcgccggagatggagcctgctgctgatgctcaggctgctcaagaacctcttcttggccaagaacacgaggaacaacccaagaactgcacccatctgaagcttttccgaaacgatcagtcgatcagattttttctggaggtttcagaaatcaagaaatccgagagctgatgatgatcttgatcacgatgatgatgatgaggatgagttatatacacgagtgtaaaatagtaatgtgcatatatttgatatctattagtactacatgtttgatgtttctgtcacaggacagagtaacccaaggaggtaaatttcctctcttttgctgaagtgtgtgttcttcttattatctatatatatatatagtttcctatataattatctgtttctgttcttcactctgattcttcttatgttatatcagttatcacaatgtatattggcatctcaatcatcaaaaattttatttctgaatcaagttcaacaagccctggctatttctcagtatagtactgattgagatcaatcattggttccatctgaattttgcttcatcatataaagatatctgaattttgtttgtaaaattttactgtacacctgttcctacagctgcatttggtttgttgtcaccaaccttgtagatgcagatgccttgccatcaaaacctaccgaaatgagggagctattaaatgtcaaggagcaggccaagttttctggtgaattcaccagaaatctctatgtgaggcagtgccagatgattccaagtcttcagcttcataaatgttgcaactaaacatcacagccaaaacagaccaggatcagggtacaatcatttgtgctgcatcttcaggaattctaacattagtaatctcaatgccctatctgatcccacagtttgcatttataatctttctcttctagtaataagatcataattttaaaaatgtccagacataaatacttctgtaatctgtactgtactgtactgtacttctgtaatctgtactgcatttcagttgatcagtgactgaaaaattttcaaactctcacctaacacatcatatagatatctactatttgatttagcagttgtgcttactttgttataatgaccagtactacaagtaagtcaatcatcgtagtcatagtacatatcaaacctagaaaggtcatctgaataggacttcctgattgggatttctccattgttcactggagtagaaaggaagaagaaggcctcaggctgggcgaggcgccgacacgtgtcgtctcgtggcaatctgcggtatctcagatctgtatataggcctgtaacaaattgaagcaacagtgaggtcaggtgagctaggcaaaggaagagctgtgagatggattcagctacctctaccggttggtctcaaacagcaggaattggttgtgtactctttcttgtacactgtcagaaaatcttggcaacaatctgcacttgcctgtcgggcatattcatgcaagaaggggaaacaaattattctcacatcataagctaatcatgctataacatgactagcagcagagatctagaacaaatgaacaattgctgtagcatgaaactgaacctgaaactgaatcaggattgttctactagcataaacaaatctgaaaccgaatcataattgctgcaagcataaagtttcagggtttagagaacaggatcacataagcaccagttcagtaacagtttcccagaaagaggcaacaatcagaaactcttttttctaagctataagatcagaacatttcttagctaacgactaattttcatcaaagcttcagttgcacactagagccacatgtgtgtgcaaccaccatcccaagtaaaagctgatcagatatggtgaagcatatcacaccatctggttttcagatctcaggccagtatactttgatgataatctgaatgaaatcaactacctatgacatatatcatgaaacataacagtaaaaatattatacagccacaaaaaaaaatgcaagttacattttagcattacaatggctgcacgtccgcaacaatagtacactccttaaccaatacaaccaggtctaaactagtcattcaacaacccaaccggaacaatagttcacttatgaactaggcacttattttgtttttttttatagaaaccaacatataaatagttttttaactgccaactacagcctcagatcaatggaattgaagcctccaacatgccgacatagcaatgttacttcgggtcagaacggagtttgtgcggagtaatttctgggacaactctgtagatgtgcacttttatgttatccttctggacaagctcgaagacacacacatcaaacttctccagattgttgccaacagcaaatttgccccagccaccactgaaagaaccaacagaacgatcactgtagtagacatagttaacttcccaagccttcccttgtggatcccagagtgtgatccttttgttggtatggggaagacactcacggacaaattcacatgggatattctgcaatataagaaaatgagttttggtttagatataagaaaacaagtagggaggttgagtaaacatatacagatagtgagcctttttgtaaaaaaaatgtattgccccgagggtaaggcataattggggaaatcggaagtttatctaagaaagatagttgaaaaatactaaacttggctcatttatgatggtattaaccgaatgcttgaaaattactactacagactgttgcttatttatagatcgctctctgctgtatgcagaaactttgtaataaggctatgtcaagatgggatgttcaaattagaacatccaaaactctcaaactatagcagcagcgccattgtgcaaattataatcatgcatgaaagaatcctctcatgcacatattttttttaagataaaatgtctcatgcacatagaaaaagggaaagtgctggatgaggattaacacacggaagtaacattaccatgaaaaatccaacatagacatatgactccatcattatttgcacggcaaaaggattcttagatttaaactctcttgccctttgaagagcatggtccttctctgcttcagttaccggacgcctctgtgatattactgttagttgtctttgaccctttgaaacacctgaaaagtgcaacacagtcaaattgtctacagaagtaatttattagcactacatttaggggacaataacttacatctaccacgccgagacacctcaccagacagaaagcgcatcaggaatggtggatttggtgacttgctagaagaattatcttcatctgagctgcatgatgaacctataatgtgcaaaagtaatttttttgggaaatcatatgaatccttaggattctgaacaagtatgatggaaataaataaataagcaacctctaaccaagagattagaaatatgtctttttgcaattactttgcatggtttggcaccgcgtagcttatggctatgcatggaacaaatcaggaatacaactaaacaagttctataaacgaaatggatgtggcaagtcatttgtgccgttatgcagacctccctggtcccccaacagttcaaaataattgactattaatagtcatcatctaagctgactatgccaaatatgtgtataacactttcagaaatatagaaatgttttacctctggtactgttatggcttgtcgatgttaccttggacttgccagcagaagctcctgcacgttttctcctagaactttcgcaaacattagcctcagatgacttcttaaatacaaccaccctatcttccataaggtaatctacatctctagttctctttcctgtgattccattattttccttcagggcgggagccattttctctgttgtgatagctgcggtgaccatgcccccttcatcactttctgttttaatgatcacatttttggaagggtgagcagagaaagttgatatcttgtcaatgcctgaaggttcaaagactgtcactgagaattgtgaccgtttatcataagtgaatactaaaaattgaccacactgaattgagttatctctgacaaattctttccatccatgcacaaagaagaatccctcagagtctgaagtcagctctgcactccatttatttccacttcgatcaaccagagaaaccatcccagtaggttgattctgaaggcattggttgaatgatgatgggattttctgcattgtaccaaagtataaaatatgttaatttatttttctacactacttgttaacattgtgaactactcatacgatgcaatgtcagttcaaaaacaaatatatcagacaaatacaatatgccacgtcatgtaatttttctataaggcatcaaattgtaaagaccagcaaagcagtcctgacatcatagcctcaaaaatgcaaaattacagaacatacgtgatgtatgactggaaaaactaaatgcttagaccaactaagatcaaaccttatcctgattaattgaattccttcttttcccacaccaaaaaataaaaatgaaaagtaagactcaaaccctctgaaagataatccaacccattagcagaggcccatgttgtgtaagtttttagccgctgagttgaaaaatgaaaggacatcataggcaattttattgtaacacagtgctttctactattctttggccacataaatgtgaaaatgaactaagcaagtttggcagctagccagctactttgggaaaaccacgaaaatagtaaatgtagtcgtcatgaacttctaacaataactgattgtgtgaccaatacacctgagtgttagacaaacctggatttggtagtgggagtgattactctatgtttttctaaagaacgctatgagaacacataccaccaccaaacaaggttaatcaagatgttgtttgctgactatgaaaaaccaactgtgcagtgcaaatgaagagctacatatcaaaatcaatactttaatacgctcgtgtgaacaatgaaagtgtataaggttactaacgaatcaaagcaagctagtcacactagggaatatacataaccaccacaaaaactcggacatttatttgaaagtgtttatagttaccctgcaatcatacagccacctttcgactaaaacacatacttccaaataattaatctagcgaacacaatccacatccgtgggattcgcaaaaaggggggacaagcatatagctaccctgcaaccaaacaaccgccttggggaaaacacatactcctaaatcattaatctagcgaacacaatccatatccgtgggattcacacaaaggggggggggggggaagtatttagctacccacagccaccttggggataaaacacattcctaaataattaatctacacggacacaatccacatctgtgcgattcaaaaaaggggaaaaaagtgcagatatctaccttgcaacctaacaaccaccttggagtaaaacacatactcctaaatcattagtctagcgaacacaatccgcatccgtgggatttacaaaaagggaaaaaatacatatagctacggctacccacaaccaccttggggctaaaacacacactcctaaatcattaatctagcgaacgcaatccacatatgtgggattcacaaaaaggaggaaaaacatatagctacccacggccaccttggggatagaacacattcctaaataattaatctacacagacacaatccacatatgtgggattcaaaaaaaaaagggaaacaggtgcatatagctaccctaaaatcaaataaccagatttgggctaaaacacattctcctaaatcattaatctagcgaacacaatccgcatccgtgggattcacaaaaaaggaaaaaaaatgtatatagctacccacaaccaccttggggctaaaacacatactcctaaatcattaatctagcgaacacaatctgcatccgtgggattcacaaaaagggaaaaagtgcatccggtctacgggtatcacctgaggacgcgagaccttggggttaaaacacatactacttaattattaatctacgaaaacacaatccacatctatcggagttgcaaaaaaggaaaaaaaatgcatgtagctaccctgcaatcaaaagtcaccatggggctaaaacacatactactaaatcattaatcttcacgaacacaatccacatacagctacctacagccaccttgaggctgaaacacacactgcaggttatgtttggttcatggccatttctagccttgccaattttgggcaatggcaatgccatttttttttggcaaaaattggctagtgtttgtttggtttgctaccaaagttgcatcttgacatattcaactcagccaaataatttggcaaggcaaatttttggccataaaccaaacaaataataaaaattttgtcagtcccaattttttttttcggtttggctgagattggctacaaaccaaacatgcatatcccaatcaactagcacaatcagcatctaatgaacagattaaaagtagcacaagtgaacacaacattattactaccctctaatcaatcaaccattcataacaaactgaacaacaacaacaacaacaacaacacaaacggagaaagagagacaaaaaagggattaaagagacatc

SEQ ID NO: 64583 - DNA, 13499 bp, Oryza sativa
atccttttccttccccttccccttccccttccccatccggccaccttgcttttccctaaccaccatgacctcctactccgattcttgggccccccccccccccccgaccgaacaaccaaagccgaaatagaatccaagaaaaaggaaggaagaaaagagagcgcaagctcgccccgcccggccgggtgaacaaaaagaaaaaaaaaatcaaaccggcgaggaggcgggtggcgggtcgggagagggaagacgagcagcagcggcggcggcggcggaggaggaggagaagcaatggaagcgaaatgcctaccgctgtgctgcgatgcgaggggaagaggaaaataggaaacaagcgagcaaggagagagagagagagggttttggaagagagaggggggaggggagtgtcagcactggaaaagtggaaatttccagaagggcctgagatatcacctgcgcggcggggtggggcccacctgcagtcacacacacttccatctcttttttttccctcatttttttactttctattgctcgcgtccaatcaataactctctctccttcagtccaattctcgcactctgcttctctgttggccctgttcgtttccttctaaactgacaggataaacttttggattaaaatggcatgttttttaaactactaaacggtatattttgtgcggaaactttctatataaaaattgttctaaaatatcagattaaaccattttttaagtttgtaataattaaaactcaattaatcacacgttattgccacctcattttacgtgaaaaacttaatttttatcttcaggagattcaaacacaacttaatttttatctttaggagattcaaacactaccttgatagtacccacagccactttggagataaaaacacatactcctcattcgttgatctacacgaacacaatccacatctatgggattagaaaaaaaaggaaaaaattgcatatagcttccctgcaatcaaacaatcaccttggcgccaaaacacaatctcctaaatcattaatctaacaaacacaatccgcatccgtgggatacacaaaatgggaaaaagtgtagatagatacccataggcaccttagggctaaaacacatactcctaaatcattaatctttgcgaacacaatccgcatatgtgagttttacaaaaagggaaaaaaatatatagctacccaccgccaccttagggctaaaacacatactcctaaatcattaatcttcgcgaacacaatccgcatatgtgagtttcacaaaaaggggaaaaaaaacatatagctacccaccgccaccttagggctaaaacacatagggtatgtttggttcgtggccatttctagccttgccaattttgggcaatggcagtgctttttttttagcaaaaattgtctagtctttgtttggtttgctaccaaagttgcatcttgacatattgaactgagccaaataatttggcaaggcaacttttttttgccacaaaccaaacaaataacaaatattttggcagtcccaattttgtttgcttggctgagagtgggtacaaaccaaacacatcaataataatatattgaaccacaacgacacaaacagataaagagagacagaaagggattcaagagaaatcaccatccgctccatagattgcagcgtgagaagcacacggaagaagctcctcccaaagtagctcatgtcgccctccttctccttccccttctccatccagccaccttgctcttccccaaccaccatgaccaccctctcctcctccctcctgctccgcccaacctccctgttcttgcgccgatccataccttcctctcctccttccactcgctacaaccaatctactaccacaactagatcaaagattgcaagattgcaaggaaaccaagaacaagaacggcaagaaccttctccagcaatagaggaagggtttattaatagcccctggctgcggtagggaccagacacattgcaggcagaggcagcctccaggggatgcgagtgtgtgcgggttggctgccgctcgccgctgaaatgcgcgcacacacacaacacactagcacagcaaaaaaaagctatcgtttttgtcttaaagctgacacttttgtcctctccctcatcactccacctgagagtgaggggcaaacaaattggtcagtcttgtcaggagcagtagtaggatacggaggggatagaaaggccctgacatgatggtcctctttctgtgcattgtgcatgtgtgcgctgcaggggaaattgggcagattttgtagtggtttctcacttgaattgtatcccttttctcagagcagaagaagaacatgatggcattggatgacattgttgttcttctgcttgaacacctgcagatgactaggagtaagagtacatgtcgcaatcttgggagatttaggggtggtattggcactggtgttggtgttgggttcattttcttttattataaacaacacattcatatatattgtttttagttgtaacatatgctacattcgcgttattactatacacatatgcaacttatatttagtcgcaacatgtgctacactaacggtatcgcacatacacaacctagatatatttgtatactctacatatatttgtatttggttgtgataatcgtcagagttgggaaagagaatccgggaataatgtcattttcgatgtttagaggtggtatgtgtattggtgttggccgtattttcttttccactcatgctgcatatggacatatgtacgcgtctataaatattttcctttaagagggcacatttacgggcgcatgcaacacaagtagcaccaccacactcattccacatccgcgcacacacatagatcctttcacacacaagcgaggaggcattgcattttagggtgcacgcgacacatgcaacactaaccagacacattccaaatgcacgcacacacattgacatccttcacactcagaacgaggagagattgcttttcagggtgtatatgacacacgcaacaccaccagactcatcccacatgtgtgcgcacacatggacatccttttacacacgagcgaggagagattgcattgcagggtgcatgcgacacacacaacaccattaaactcattccacatgtataaacactactccctctgtcccaaaatataacaacttttagccctcaagatttgtcccaaaatataacaacttctccaccaacattctcttcccaaccaatcacagctctccaccgttcactttttccacctaactccactactcaaccaatcacaaccctccaccattcacttctacctactttcttaataatcgtgtctaactctaaaaatgcttataatctgggacggagggagtacatcttttttacacatgagcgaggagatattgaagggctaatgcccttagtgcactgaaatgcatagtaaattgaaacacaagtgtgtataattgtgcctaattggtggtaaccttaccaggaaataggaaaagactagtggtaaacataatgttgggaattgaacttgtgccaaccagctctcaccaccgagatccaaccactaagctatggcttagtcctcacatctacaaacattttattgtgatgattgcgaacatttgagttgaatgagagaaaatatggggcttgggggtgtttaaaattttgcatgatatggtgtggtgctattatgatgtttattgatactagcacaaaatgtttatgttttagttaaaaagatggcaaaatttgctacgagaccctcaaaatttgtgttatttgctgatagacagcataaaaacacgtcgcggctaaaagacactttaaaaaactagtaatttgccggaggacactttcggtggttcaattgaatagagagattctttaaaaagacaagaatgcccctagggtcaaaaagcttttgagctgagactagaacgaagatggaatataatgtatgctagtgatgtacttggggatgatggcaaatttatattgcataatttctaaatttttactctaacatcatgtttgaagcatgtggtcttaggggcattctcgtctttattaagaatttatcaatttaattgaggccaaagtgtcctatagcaaaatatcagtttttaaggatgtcttttagtcgtgatacatttttttgatgtctatcagcaaattacacaaaatttgggtgtcttgtagcaaaatttgccaaattttttttgtctcattttaagttttatatccaaataatcagattatatatattgctctaacataaaaaaatattgtcaatactccgatcacagtatccatacctgtatggttcgtttggaggatataaggatcaattgatatgaggatgcaagaatctgtaaggagagtaagggacacatagatttttgtataggtccggaccctctaattatgggtaataaccctatccctgttggccaagatcgctgttaccgctatatataaatgtctcgtgagtacaaaggggaggaaaactcacacatttatttgaaatgcatatctcatttttgcgtagctaactaacccattggaagatagcatctttattcctacacataaacagaaccagtttagaatccttctacaatccatacaagattctcctggatgcaataaatagccaccttgggggtaaaacacattcctaaatcatgaatcttcacgaacacaatccacatatgctggattcaaaaaaaggggaaaaagtgcatatagctacccagcaatcaaacaaccgccttgggactaaaacacatactccgaaatcattaatttagcgagcacaatccacatatgtgggattcacaaaaaagggggggaacacatagctacccatagccaccttggggataaaaacattcataaataattaatctacacggacacaatcacatgtgtgggattcacaaaaagggaaaaaagtgcatatagctaccctacaaccaaacaaccaccttggggctaaaacacatactcctaaatctagcgaacacaatccgcatccgtgtgattcacaaaataggaaaaatgcatatagctacccatagccacctcctaaatcattaatctagcgaacacaatccgcatccgtgggattcacgaaaaagggaaaagtgcagatagctacccatagccactttggggctaaaacacatactcctaaatcgttaatctacacgaacacaatccacatcaaaaagggaaaaagttgcatatcgctaccctgcaatcaaacagtcaccttggggctaaaacacattctcctaaatcattaatctagcgaacacaatccgcatccgtgggattcacaaaatgggaaaaagtgcatatactcctaaaacattaatcttcgcgaacacaatctgcatatgtaagtttcacaaaaggggaaaaaaaagcttatagcttatagattggtctcatttaaatttttatatccaaataatcagattgtatatattgttctaacatcaaaaaaatattgtcaatgagttatactccgatcatagtatccattcctatatggtttgtttggaggatatagggattggttgatatgaggatgcatgaatctgtaaagaaagtaagggagacgacatagatttttgtacaggtccggaccctctaattatgggtaataactctattcctgttgggcaagatcggtggtataattatatatcaatctctcatgagtacaaaggggaggaaaacttaatctagtatgctagtgtatcagtgtaaagcttgggcatggtggtcgacaactagctgttgttggcttcctcgtgtagtgactcgacaaaattgagggtagcttgtattgtgttggtttctatgtcttgtccttatcctctcttagaggtgttatattcatacctttaggtgcccattgtcaaagtagtagtagcgatgcaaatatggatacgatctgagtagttctggttaggcctaagtaggatttttgccatatacatcaggcttgtttccgtacaggactaggtatatggtggtcccactgagctaggtacacatgtatatggtatttgaaagtggatcaaggccccaaatgattttggtgattaataacaatacgattatagatgactaacaaataatttgagtatgtgtgaaggaatgttagttcttggtaaagagtatttcaatgcaaaacccgatgatagtgacaaaacgatgtgatgtggcatatgagcaaatggtataatataaattttaatttgtttgcatcattaggaaagccgtactataaaggggatgatgcattgaaattgaggaatgatttgggtgctcaaaaatcaactttccaaagtatttctcctcgaattttcagttcttgagttcttcggacttgtccgaaatgtgttttcggaattcccgaaagttgcctgagctgagaaaacggtactggtcattttcagacttgtacaaaaatcactttcagaatttccaaaaatggctgtgaagtcaaactcggttctggaaagttttgtacttcccgaaaatcatttttggaattatcaaaaatggctaagcaaccaaaatggttctaaatgtttttggacttgtccgaaaactattttcggaatttctgaaaatggccgtgcagccaaacatggttctggatgttttcagatttgtccgaaaatcattttcagaatttccgaaaatgtctatgcaagcaattttggttcttactagtacaaaaatgatttttttggacaaacaccctaataggttacagatggcccataagtgtctgcatctgtaaaaatcgaccccaattttcacatatggctccttaatagacccgcacgcaaaaatgaatttttctaaacggacaacttaaaacgtctgcactcaaaaataagggtattttcgcatgtggggatcttcactcacccgcatgcaaaaaaaaacccctcttcccattctcttttttctcccctcccctctctctcttgtggcctcacccactcctctcctctctcccactccacacccactcttccactcccggctcctcttctcccctctcctccctctcgacgacgagcactggccgcggtggtggcgacggcggcggtggcgggcgagggtgccgaggggtgtgggcgctggcgtgcggcagcctcatccattctccgcacccctcgtgcgtggggcaccctccggcggtggggggcgtgggatctggcggtccccgcacgaatctgccggcggcaccctcagaagcgactgccgcgacggagggtggcaactgcggcaacatcgagggctggcggcggatctggtgactgcgtcgacgacgggcgtgggcaacggcgaaggcggcaaccccctcggccatcaccacatgaaatggaatagattccactagtgaaaggaggagtgctttatgcgacctctcgaggaaagggttagtgaagatccagctctttgtgagctcctcaatggagactagaaactccccaaggattccaacttcaggaacacttcatcttgcaagaacctcagtgaaatccctctctccctcctctagctttagttgtttgtgccgctacaagtctagttgttgtttgtgctagttcttcattcttatgggtagctagatctagcatttctttactcatgtgcatactttatgattttcggattttctgaaaagtcttgcttccgcatttacttaagtttttaaattagcctatttacccccctccctctctaagcgtaagtgaccctttcagtatcccatatccaggacactgacaattatattgatggccgatttgtattttaaattattttgtataaggttggcttagatctatcaatgatatatactatgtagaatcaattctaaaagttagttggatgtcttctcgaaatccatacaatccacacccaatggtccccatagtcgcaccaaaacctactgcgtgagagcagatctagttcaggcacagtgcatgtggcctcgtgatgattttcaacagttgtatggatctgttatttaagacgggcgactattgcggtcttcaaagccactgtgcaattagttgtttttctataggacaagtcacaactagagtgaccgaaggagagcttttgctgatttattttatggttaattggatctgtgtcattgtaaatttgacatattagaaaaatatcattactatctgtgatatcagctgggtgtcattgaaattttgtgaaattctaaccatgccattgccgtccagttttctgtcgtggccatcaatttctatcagtcctcccctttctcactcttctctccctgctaccaatctgccgccggtgtgggcaacatcctttcctcattgacccccgcaggtgcggcctcatcatgctacggaggaggcttctcttgccacccctcgctgttgtcctcactcatagcgttggcggtggcctgcactgtcttggagaggaactgacaaggagagtgtgtgaggccatgaaggaggctgcagtgaggtcggccatgcgggtgtggaggagcagcgatgggaggagtaggaggatggggaggatgccgacggtggggaagatagggaggatacggaggtaggggaaggggagggtgagaagagtgggaaggaggcggaggaagtggcgaaatctaccattggagacacgagcccgactgatgttgtgccccgttgaccttgaactcatcatctttgcctctaaggtccacgtcgtgaccgctgtgcattcattgttccatgccacacagcttcaatcgaatctgggttgagttggtttggagctgaaggggagcaagcgctaggatgggaggtgggtgttggccacaatgaggagctcgtcggcgctaggaggggctccatgtccaccgcgcactcggacagctgcttccagccgacgcgagctagtctgtcgctcctgcatatcctcattggcaaggattggagggagggcgtggggtttgggaggacgatggaggcgatgaacctgcccccatcgttgtcgccgccatcgccaatggcttcgtcgtcggtggcctagaggcgcgacttcctcgctagacgccgcatctgaaacgaggtggagagatatggtaagaaagaagaggggaggatggagaaagaagatggaattgacatgtgagtcccacgtctaggggttttttttgtctatatgatgacggaaaacatgatggtgatgacatggtcttaattttgtgtaaattcgaatgacatgaatacgaatagacgaattataagtagtatttatctgatcagcatatttgtactggaatgttccaattaatcctttattttatgggacaattgatcgtatctttttttaaactaaaccggcaggaatttcctgccgattatattttcaataagcagcagtcgatcatatctaaagaggcagcagtcgatcatatctgttgaattggaactatccagatttaagctaatgcagggaaggtctcctctgcagtacaagagcctgaggcccctgagcctcccccatttatcgagtcgtgtaagagcaagtttaacagtatagccactgttagctctaaatcatatatagccaaagtaatagctaatttatataatagttgctcactatactattaatatctggtcccatctgtcatacacatattacgtcttagagtccatactgcagctggctacagatctgtagcccgctgctcttttctctcttcctttatctttttaaaatatgtttatagttagcttatagtctgctattattttatctctttaaaatatatttatagctggcttatattgtaactgctctaagacgaacgaacagagggtaaggatataaagtcccagacatgatggtcctatttgggcagtgcgcagcagagcttatccatatccatgtgctgctgcggcgaatcagtagatttctctcttttcttttctttctccttggattttgcctcttctttccgggagcagagcatggacatcatcattctcattggacacatgagattgtcacaatctgcaaggttcatctgcctagatttgccaaacctttttgtccaagctcaccaaagattttgccatcaaaatcaaagctacaatttagccacaaagtaaaaccatgccatactttttaagaccagttagagcatctccaacggtctccttatccctctctttaagttaaattttggaaattttggctcaatttcaccctccaacagactggctattgggctggccaaagtcctccttccactagccaaatttggccagccaaaatagcctagccaatcgtgggccccacgccaacaacatccctctcctctttctctctccgccaaccgtcgtcgtcgagatgccatcgctggtgctgtcgaggtcgtcgttgccggacgccgccgtcgccagccgtcgtcggcgctgtcgccgtcgccagccgtcgtcgcgtcgtcgccagatccgctgttgccgaacaccgccgtcatcgtgccgttgccagatccgcgaggtcgtcgttgagcctcgctagccgtcgtcggcgccatcgtcaaccgtcatctccgaggtcgtcattgccggacgccgcaccatcaccagccgtcgtcgatgccgtcgccagccgttgtcggcgccgtcgccagatccgtcgccagccgaggtcatcgtcgcctgccgtcgtcatcgccatgccccggcggattcagccggtgcggcatgtagtagaggacgccgccatctcactcctgtcatcgtgttcgccgcccgagccgattggccaccccgcatccacgcgagctcgccccgagcggtggcggcggcggcggcagcacctgctgcgagctgagcagagtgggtttggggaaagggggagagatgaggaagaagaaagggttgtaaagactgacacgtgggtcccactatcataggctcataatagagaggatgaatagagaggctgttggagtaaataagagtttgactggctaaattagatagagagttggccaaattgatatttggagagttagatttgaagagactgtaggagatgctcttaggcatggatcctcagtttgcagtgaagtaatcttacccacacttatagttgtcaaccaaacacacgtttaatatgatcaaactcgtctaaccacaagggtggctatcaacaaacagcctcacgtactactagcaactgtgcaaaaatctgacagtgttcaaaaagttaaatgagatgcaccggtgctataaaaagtgaatgaatggaataatggcttaaaatcccttccatgacaattctcctaaaaagacaaagagctacaataattatgaagactatttcttttaaaaaaaataatacaactcttttagcaaaactgcagcggcactacaattttaactttgcgggtctaaggtgcaacccggacctaccagataaacaaattttcagtttttttataacaaaacgttcaactattattgtaataatcttttggactgcctattaatattaggtcctctttgtttagacttataagccaacttataagtcgaaaagtctaaacctaaacaaacaagcagcttttccgtttggcttgtttgaagccacaagccactttaacactattaagccaaaagctaggttggagaagcttttttggcttatgtgaggtatttttggcttatgtgaggtagatgtatgactcaaccactaaacttaggacattaaatccattgtcttataaatcatataagccaataagctgacttaaaagtctaggccaataagcctaagcctaaacaaaagagggtcttagattcggagctttaaatcttatggaattttcaaccaacagatacattccgttttaaataaaataaaaaaagagacctaataaaaattcctcaatctaagaaaaaaatctatactcctttaaaaaaaatagcagtggtggtagttagcggtgaatgtgccaccacccatgccaccaactctctaccttttagaatgaagaaatgacacgtggggttccaccaacaactccctacttcttttgagtgaagaaaggatatgtgtggccgaatgacccacatatccaccaccccacccaccaccatctctatttttttatgaagaaaaagtgatattgtgaggccatatgcacatatgttatttacaaatatgtagaatttaatagtacggaaaataatgataataataggttaacgattattttcatcaattagatcctgtttcaatgcatggacaatatgctatgctagtagttataaaatctaattttggtgtattgtaattaagtagtgctatgtaactaagtgtaattgcaagttggatttataggagcacgaatcttgatacaagatcctacggacgaaaaatcaaaagataagagttcaaaaatctatcgcaagtgaaatagtaaaaccttaatttcttttgtggaattgtagcaaatcgataattttggtgacatggttgtcggttcatccgttcccaggcttaattccatggaataagttcactttaggtccctcaatttgtcctcaagtctgattttcatcctcagtccagaaaaccggaatgcatcccccaacttacaaaaccatacagacgaggtctctcagtagtattgtgcccggtttttagatggcgtggcgcctacatggctcctttgactaggtcgtcgtcccatgcgacattgacgtgatgtttacgtggcaattcgatctcggaaaataataaaaatagtgggacccacatgtcagttacacacaaaataataaaaaaaagatgggggtccatatggtcccatacgtcatcctcactccttcctcttcactttatcccccctcactcccatgcactgcaaggagaagggcgagcggcagcggccggatcagaggggtggcgagtggagcagatgggtggtgggcgaagcaggggcggcagctggaacagaggggcagtgggcggaccaacagcgggcggggggcgagcacctataagttgttcgtcgcttgggccatcgggcgggagagcttgggacaacggtgctctgttagcctctgtggccctcctcgctccccaaccccatcggtgacgccgagttggccgaccaccgcagcgccgccctcataacagtcatggtttcctcacctcgccaaggtcactgcccgccatcggttcgttatgcctgatgcttaactagctcgcctgctacgttgtctccttgccacccacttgcccatccgccacacacccttctcgttctacaaaccaggccgatgcctctccactgccgtccccggcaaggagctctgttgtacgtctctctcggcatcgatgccgccatctccc

SEQ ID NO: 64584 - DNA, 11414 bp, Oryza sativa
tcgctgttgacccccattaggagcgagggggagggagatagagagaggggggtgaggtggaggtagtgggacccattgacatgtgggtcccactatgtttatcttcttgtttgactgacatatggccccacatattttgttgtaatttttaatttttcaattttattttttccatatcagattgctacgtcaatgctacgtaggacgaagacatagttaaaaggtccacgtaagcaccacgttagccagaatcggggtcaatactgctgagggatctcgtttgcactggttttataagttgggcgatacattatatccggttttttcgaccgaggacgaaaatcagaccggcaacaaattaagagacctaaagtgaacttattccattccaggccatcccacgtgttttgatgggcctcaattttcatccatccacgaataattggcgttgtatttgctaatggccctaggcctgtgtggatcgtccattttgctttcactctaggcccattacgtcgaaactaactcactgcccggacgaccgggtttttccaggctctgggtagccgtacgtgtcaaacaggcagcaacctggtgaaagtcctaaaatttaaacgattttattcgtgtataactacatgagtaaaatcccatatattttaaaatagagacagtagctttaatgccatcacccatcataatcacgtttggcaatataggcaggggtgaaccataagccatgcaccatggtctttcgtcctgcgaatcagccatgattcggggtttagattcattcgttcctgaatgtagattaataaaatgtactaccttcgttttctcaaaacatgaactaaatctttactattataaaaaatgaagatgtttttgccggttatttggtacgttattcgtgtatgagtcggtttttaaattcgttcgcttttagaaatacagatccgtatttgagttgagttttaactttattcgtttttgaaaatacagaaaggctcatataagaaatctctttaaaaaaactcgcatgctaacttgtcataattttctagaaaatatatatccaagcgaattctcacaataaattttacattgaacaataataagattaaaatagccttcactcgttgcaacgcacagacattttttctagtctttgaaatatgtttgattattcattttctaaaaatatttatataaatagacaaatatattaagtatgtttaaagtagctttggttatagctcaagttgcactcttttcactagctaagtaattgtgttgatcaaagtttgataaaataaaattcaaacacaccctatattaaaaaagcagaggtattgtattgccaatatacattaatctatattgccgatggtcttatttttagtacaaatattcaccatacaacaccgccacaatctatattgacttctgttgcgaaatgacggcggtgttgctcccatgttttcccagcctcactttgatttttcccatagtccacacaactcatcaccgtctttcactggtaacaccaaaggcaacaaacaaaaaccacaatttacatgggtataaggtcattatttagcatttgttggctagcttgttgctacactcatgcccttatataggtgtgtttggcaacattttggataattttttgttggtttgtttgttcataataaaggttatggtaaataaaaataaggttgcatatctagcccctagatttcaattaccagaaaagttgcttcgttataggggtgaaagtgaatcggataatatctaatccactccactccaaatccgtccgaagtgaggatatagtaagggtttatagatattcggcggatacgaatttggctatggatacggagctagacgtggtgttggcgatatcctgcagatctggtggagggtttggtagataacccgactttctcatctcatggaaccactctatttgacccatttcacataagacagaccatctattagttgacctaataacctatctctctcacacacaggacgaaccaatgcaagctgctaggcaggtttgccgtcacactcccatgcgcacacaagcggcgaagcaggaatgcgggtacgacgcgtcattgcctgtggctctcaacgttgacgcctcctctggtcgtccccatcttctactccccgcagcaccgcctgctttgagtttgctttaaattttggtgatatggtataaccgctattccgatctgttttcacccctaattcattatcaaagtttacaagtgcacacattattcctacagcggaatgctacgtgaggtcaccttgggtatggaagtgtgtgaggtggtgtgacgagtttaatgtgtaataggcactaataaaatttgatgactatagacacgaaacatctttactactttaaaaggacataatgatgatggtgaactccactttatacattgttgaaattacccacatttctcatcctagcctatatatcaacaaaattgctcacctttgtcatctcactcctgacttctatcatagccacaaaccccaaatctccccctttcctcatcattttctctcctaccaacctccatgtcacttgctttctcgctgcttgctcccatcatgatctctgctcctcctactcaacatgttggcacttgatgctcaatgtcccttgcccctcccgtcatgacattcacgtactttcctcctgctcatatcctactcagcacatgagtaagggggttcacacctatctctttgctggcaaagaagaccgctattgagtggagtactagttagctacaacattgccacatctcttcctccatatatgctacatggtccatccttacgtgactatgattctacttagatttattttttaaaaaacatattgtgtatatatatccttttgtcctcacttaggtaccatctagtgccaagccttgggtccttatagatatcatgatattatttcacccagccacatcggagccatattatttgcttgccgcacaacatgttaaattcactcgtgcgcatatgcatctacctgaaagggtcaattcggcctagaggctaatttaaaactttatgcggaagctaaaactgatataaggtcggaaagtctgatccacagtcagactatccgaaaatatcagatagtctgatgttggatcagactgtctgatccaccaatgaagcacaacaagtagatctatcacacaaacaagagtaaagcacaaatagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaaccactccttccactaaggggtatctctttcctttgcggaggcgagatccggccttcacaaacttctcccggccaaccacacgtagatcggtgccttgggagtgacacctagccgtctaggagttctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggaggaagagctcaaagatccaaagcaccttagcactaagctcaacccaaagtgaatgagaatgaaatgagttgggtcaccctagaaaagggttaggtggggggtatttatagatgccccaaaatgtggccgttggaggggaatctttcagcccacgtcggatagtccgatacaagatcggatagtctgatattttaaacctccaaggcaacgagaaacagagaatgaagttccatgaaattttggactttccgagacattggactatctaatgttaaattggagtatctaatattttagaagtaaaaacttcgtcctcaaacagagacttaagttctatgaaatttcggagtctttgtatcatcggactatctgatccgacatcggatactccgatacttagaaaaactcattcgataggattttttcaaatcaagacagttctgtgaaaaattggatagtccgatacatcggatagtctgatttcaaatcggatagtctgatgttgctcaagtaaaaatgcaataactttttactccgaactccgatttcgaagatcttggactctatggaaagctagtttcgtgggctatcaaacccaacataaaacatggtccaaaaccttcaagagattttgaaaaacttgcaaaaaaacccggtgtaagtgttgtgacgagtgaaacaactcgggattgaaattttggcttaggtttttcaactcacacaaagatgaagcattttgagcactagtgttctaccaattatatgcatgtggtatccctcttaatagtacggcattcctacgacacaatgcaaggtaaaagatacaatataacatttgatcattgccgcattgcatcttgatgtcgcattcatggggtatgcatctcattacaacatgtcgaggacataacaaccttcacatttgcttgaataaaagtgttagtcctctctaatcgcattgtaatcaatcatcaaaattattaggggtctagatgcactttcactaccaaactagatttgttgctaaattgaattgttatgtcattatatatgtagattttatcttcatagggcctataaaacacccttatacaagatttttttctagttattcaaaataacatgtttcgcttgaatagggtattgtcggcgtagagttagaaactagggatggatgatgcacttatataaaaaagtgggttgagattcctttcagcgaatggggtactggcataataccttatcgtgtttttaatttcattaaactaaaaaaataggcttaacttttactcctacataagaaaaaatgtatatgtaagcaatgacatatatataagaaccaatttactatgcttgaaattacaatggtgttgtttcacttttcctggctgcagcagcagtgactgtcggctgtaaccattgaaaatggctgctaacggcaacaactctaagctactaaaacaaccatcactattgatcactaccaatatccatacctctcgccataacataatccgacttcattaaatttttcttatttcacctatataagataaacacaaatatatatatattcctacaccccatgtctaaagtctgatcttagatcattgcatcaatcttgatctcaccaacctccatgagagagaagagatcaaagccctcaatagtctttggtatcctaaccccattcatcatcacgtgcaattaaccaacccatccgcgccaaattacagaaaagcccctccatttctcaccttctcgcccaccctcccgtccatgtccatggtggtcgagcaccaccggcgcggccaccgcgagctcctcctccccctctaatggcgcagtacaggcagtcgggcggcttcttcgactaccgcggcggccaccaccacgcgctcccggagtaccaccggcccctcccgcacgcctccaagccgtcccggatccgccgccccgggaagcccgcgcgccgccgctcgccggccgcggccgccgccgtcgcgtccgcgctcctcctcgccggcgtgttcctcctctcgcgccgcctctcccgccaacccgcaggttcgagatggctttgacgccgcagcttccccccaccgtggtggtgtgatccttttctttctttctctttttcttttttttttccttttcaagaagaagagagaaaaaaagtttgatgtgttcgggggctcggtgcgcatagagagttctcgatccgatttcgtgtctcaacgtgatctcgtgtgcatttttcgcagagatcagccaagatttgggcggcggcggggaggggttaccggagtggaaccggagcaaggagctcaagttcggccatggcggtggaggccggagcgcgcaggattcgaggtactgggaccgggacgatcggaggcgggacgaggactactcggaggacgagaaggagaagatctcgggtgcaagtggaaataatgccggtgtcagtgataaggttgtgacctctgatcctgctgttgaggagaaagggttgaccatggataccggcggtgccgccgataaggaggctgctgaggtagctgaaggtgggaaaggagggaccttgtacaatgaagggggcaggaaagagctcgagcagtatgaggcggctgcgatgggagctgcgggtactgggatcagggaggttgatccggatgatgagtatgacgatggcattgatgcacaggacgatcttgatgatgctcagtcgcattcatctgatggcgggaggaagcttggcgacagtagtcatgagagcaccgagagtaaggaaaatatagctcatgatagcaccggcaataaggaaagcatcgccttagagagacgcacggaaacaggtgcgggtattagtgatggtgtcgatgttattgatgctgctaatgtgaaccaaaagaaggtttcggcgactggtgataagaaacacgcgtcaaaaaagaaatcaaagcgcaagaagactggtgagtttgttcttccccaaatttaagtgctagagtcaggcgatttgaattcagaaacctgatttcttgtttagcttagtggacatattgatcctgctactgagaataactaagctttctgcattttatttctgtttcaatagccttctgtagtgtttagaggtaattctagcttgcttctatgatatcagaaacaccaattatggaatctggttgtaagaaggtactaactatgtgctattcatgttcgatagacataaatcagttagtcttggacattttagagtgccaactaatctgttagttccacaacattagtatcctttaaaatgaagattgagatgttagtagcacagcagcatcatgttgtatttatgtagtgcttgatttacaatgtttatcaatatgatctattgatttctacgtttgataatttggtatcacataaaatactcttggtatctagcctttgttattatggatggttttctaatctgttggataaacataaatcaggttcaacttgtgaaatgaggtttctgaactccactgctcaactcgtagagcctgctaaaaatgagaaatttgctagttttaatttggaatatgtggaagttgaagacaaacctcttggatcagagtattgggagccaagatttgctggccaccagagtttacaagaaagagaggaatcatacttagctcatgaccaacaattaaattgtgcttttgttaagggtcccaatggtacaagcactggttttgatatctcagaggaaaacagaaagtacatgagcaaatgccacattgcagtatcttcctgcatctttggaaattctgatcgtctgaagactccttttgggaaaacagtatgttctttttctgtaccaacaaactcctgaaaaaattatgatacccctaatcctgcatgagttacaaccaatgtaactcttgtcaatgtatttattttggttctcttgtatattttggcaatcgcaaaattagcgttctttgcatgatttgtcttagaaccttataatctcagtagcttcatttttaccataggtacttattggctctgttagtaggcaatgaaacataaaccttatataataggcctgtgaaatgcaactgaaccttctgcaatgttagtttggatatacatgaatatataacctcaatctccatacttaggttaaacaattgctgacctttccattctgttgttccaatgctccctgaatctttttaaatgcttcagaagttgatggaaatctggtaatatttaagaaataacttcatatgatatctgtctacgcagattacaagtctatcaaagaagacagtatgctttgctatgtttttggatgaaatcacattacgaactttggaatctgaaggccaaaaaatggatagttcaggtttcatcggtatatggaagatcatattgattaagaatatgccttataatgacatgcggagagtcggcaaaataccgaaatttctggcacatcgtcttttcccatcatcaaggtaaaaatgaatgttcttatatatggtggttgtacttttttttttccacattgaatccacactgtcatgtttatgggccaatatcattcttaatcctcagctgaactgagctagtaactcccctcccccaagataaatcaccttgggaaatccaagcagtttaccagctggttactattttttttatcaaaaatattggccaacactaactgccagaaaataccagtagtttccagtcataaaccggtgccaccaggtggaaatctgttttcacattctgccctgtccctatcagtatgcacattcctgactgcctcgctactagtagcaatcaatcctgattccttcaattcagctgtatctgtgttgatgctttgctggtctcagataggttgagctcacgtggaggcatatgattcagtagtactgtttatgtttttttctgattcgttctttccaactgcattagaatcactagcacaaatgaccttaattcccacatgtatttattgcccttttcaagttaagaaaaacaaattgagaagtcctccttatttcaatatttagggtgttttcatataatcatttgctgtgccacattatatgtagagaaacacacagcaactcccaatatattatgctgtctgtcctaaaagtgtgcatgaatgtgaaaacatgacatcttgatgttaggtgaatgtgctcatttgaacaagtattgcttatacttgctccttcaatttattgtgcttgttttaccaacctgtttttgcatgcctaaagacattactacttgtgtcaggttctcaatctggttagacagcaaattgcgattacaaaatgatcctatccttatcctagagtattttctttggcggcatggctatgaatatgctatttccaatcattatgatcgacactgtgtttgggaggaagtggcacagaacaaaaggctgaacaagttcaaccatacaataattgatcagcagtttgagttttaccaagcagatggactgacaaagttcaacccatcggatcccaacaagctgctaccaagctgtatgcattcttgcctgctagtttattgctagtgtatgagctattttgatctaagtttttcttcttctttttttttttggttaactttgtacagatgtccctgaaggttctttcatcgtgagggaacacacaccaatgtccaacttattttcatgcctatggttcaatgaggttgatcgattcacacctcgtgaccagctcagctttgcatatacatatttgaagcttagaagaatgaacccggagaagccatttcgccttaatatgtttaaggtgggtacagttgaccatctagctagctagtttgaccgcaaccatactaaatctaatttacatgctattctcgttcaggattgtgagaggcggtcaatagcaaagttattccatcatcgatcagaagagagacgcagcagtccacaactaacaagatgacagagattctttcggaatgggtggtgcaaggatattttaggattttacctttgatatagcacaggatggcacaggactattcagtgtcaagatttatgcccctgctgaggaatttaagcctaaaggtcgcaagcgattctactcctttactctatgatcctgcagaccagttcctgccgcctttctattttgcacttgacaaaggcggattagggaactatggccgtttgattttcgtaaattcttctgctctcggtaaagttttgttcattcttttggggtgatctgggacaagtggggcatgaactcccagaactagtttagcactgtgtattatcatatggttgttaaaagaactaccaagtgaagacatgattccgatgtaatcctcaatggtcttgttgaaatgtaatactacaacaggaaacaaaaccttctgtaatttctctgtgatagcaaactagcaatttttttttgtctgaatttgtggaatctccaggcttcccttgtgcttttgctagatcagaactgagaatgaataagtgatcatctgtttgttttttgttccatgtactacagcttgctgcaattgagcattccttcaacaatgaagaagtgaccatctgattgtgttttgtgctctgaacttcaattcacctcttaactgaacatagtttactcctgcatcaactgcaatgtagatgtgaaattgcatctggtgtttcatctcttttagcagatataaaacaaatctaaacttcagatgctttattgatcagtatgtcacactgaaacaagttacaaaccaaaggagaaattaaagtataaaaggaaaccaaatataattaaacaccttcataaacacatactcacacattgcaagaagctctaaaccctcaacaaaacaactcaaattgatcagtcaaattagcatccaccccaggttacatacataccctgctggtttccagattgctcaaggtcaattaacttttcagagattagctaacatctaaaaattcagcccagtgtgagggccttatctctgaagatgccaagcatctcattcctgcccttgatcacctcatcaaacacttcatccaaaacacaatcaaacatctccacaccttccctgagctcacctgatcttgttcttagaagctcaacatggtcatcttcttgttcttgtttgccatttttggtctcttcttctccttccatcttggtgttgatcatcatggacttcaccaccatggccaccctctcgtgctcggcgacgcccggccgcctcgggaaccggtcggtgatcacggagagggattctcgccatggctggagctcggggaccgggacggcggcggcgcggccaagggtgcagtggccgtcgtcgacgtcggcggcgagggggacgatgggtgaggtgagggcctggagcacgaacatcgacacgacggccatggtgatcttggcgacgagcatgacgaccaccatgccgccggcgtcgtcgtccccggcgccgccgccgccgctggagctagacatgatcttcctccctagccgctccgcctcgctcaccgccgccctcacgtcggacagcctgtggcggatggcgcccgcgtcgtcgccgcccggctcctccttcagccaccaaccgccggcgccgccgccgttcttcgcggcggcgc

SEQ ID NO: 64585 - DNA, 12904 bp, Oryza sativa
cgccggcgccggcgcagccgacctgcgcggcgaagtcgacgaccatgcagtagcggtgcagccgcgacacggcggacttgaacgcgttgcagaagtcgagcagcgccgccgtctcctgcatgtagtgctcgaaccagcacccgccgccgtcgccgcctccgccgccgccgccgtaggagacggcgctgcccaccggcacgtcggccttcttgaacatgaccagaagctcccgctgcatccgcttcaccagcctcatggcgtcggcgcaccacctcatcgacaccgccccaccgccgccgccgccgccatcgccgtcgtcctcctcacgaagcagcgtgctctccagctgcgcgaggccgtccaccagcgaggcgcaaaaggcggcggtgtcgccgtcgagcagctggcatcgccggcgagcaccaccaggccttaggcatctcatcgtcgtcacgcatgcaacacaagaattaaatcaaatctcaagaaccaaggatcaaacaagaaatggtgaattgggcatcacttttatgttgtgcaaatacaacaatataataatgatctagtgcaatttgttcatttgcatggaagcaaagttgggtttcttggaggagtaggcaagattaattttttcaaaggaaagaaggggaggagtgaagcaagaggataactaggtatgcatactattccatgcatacacctagctttaccttaccttgcttaattagcacttgtgctcttttgatttggcattcttgttcttggagtttggagattggagacaactcaccaaccaaccaaccaaccaaccatcctttggggcttttagctatgccaggtctttgatttggatgtagtggcaaactggcaactactaataacttatagattgacttgtaaggatggatggatgcatggggccggccctttggtgccttgcagggaagaaatggtataatttttactctcttaggggaagtgttttaagctcttgagggcatgtgtccttgttttcttacgtggttcaagtaattaacaaaaacttaaaataagatttagacaacgtactttctccgtttcatattataaaactttctaggattgtacatatgtctagattcattaacatatatatgaatgtgggcaatactagaaagtcttataacctgaaacagaggtagtacattattatgatacgaatattagggaatgatctaatatcaaataattacaaggggtgagacttcgaacccaaatcgtctagcccaacacgtcttgtggagctagccggaagacccctgagcgtttctcaacatactttattatgccatgtgtactttcacttgcaaaattaaatttgatctatatgtgtatgtgaacgaaatttgatctatagatcagagggaagaaagaaagtgcagcagttgcattcacaattggatctgtttcatgcactcctatacgacatatgcattggcattgcatgtactttatactttaatttgttgcaacgcattttaggtttcggtactggacaaaactgaggtgggatgtcatgtgtgatgatttatattttgattgtacaatggagtacactaaaagtactccaattaatccagctgacatgattatttgaggacagttagttcatcattctttccaaaagcacattcaccataatcacatctctaaaggcatccctatttttttttcagattattcgtcggattattaaaaacagattatttgctctctaaaagcattcttctgcagtattaactgcttagataacttatttttaactatttattaagtttgtttctcataatgtttaatttatccctatgatcaaatacacaatttgtggtaataatctgctctataatcaaatgactaatacatttggaaatctgaattttatcacaatagagttggtcaattttatcacaatagagttggtcagtcatgtcagttttgttaataatttaagatgtataggacacatcatcgtatatacctcggctgaaaatgtggtagctaggtagaagtattcagggtttaaaaagcaagtcacagttagttaataataaaagtctaaaaaaatatgatagttcagatcggcatgacttaatatgctctggggtgagacaaaaataaaagtctcctctttggactgcttctataattctcattaattactaacagtaaaaactttctttcacgccacaaccattaaataagctccgtaagataagaaaagaaaaacaaagtgaaaggaaaagaaatggaaacggtcagagcacgcttaccggtaatcacaagtcactggcgtcctaagcttaatttgctcagctctgacctttcttatgcagccgtgcatccaaaccgtgcggcaagaaaacaaactatgcggccatgtagcgatgttgaccttgccacgggattcacgggatgtggttgttatagtgaatacacacttggttctactccctccgtcccataataagcacagttgtaagttttaattccaactttgaccattcatcttatttgaaatatttttataattagtatttttattgttattagatgataaaatataaataggactttatgcatgacttaacttttaaatttttttcataaaattatcaaataagacggatagtcaaatgttgggcacgaaaacttatggctgcacttataatggaacggagggagtagtaaagtataaaaattctaattctatttatgtcctaagttgttgtctcaagtttggtcagacaactaagcaactagccaagtttcttatagcggaaccagttcgtccgaatttaagttctagagttaacacggatgctcatatttacgactaattatttttttagtggtaggcgacgtactcatcaccaacgaggtgcccatggtgattttgtcaacctcaaaatatatgtcagtccagttttttggaggtgcttatagaagtaggatgcgcgtgtgcgtgttcatagatacgagcgtacgtgtattgttagcatctacttttataccgtgtttctaataaaaggaaaataataataataatatttacagtatcaaatgagcatcattacatccatttgaaatatatattttcatgatttacttccttgattatgttagatgttcatactcttctcaacaaaattaaagaattggatccttagtttaacttagaaaaaaatatagaatcccttaaattttaggaaaaaggaagtatctaccaatagctaatcaaaatatggaaggagctcgaagcagcttctaggcacgcctccgcaccctcgccttatggccggagatgctacgaattcagacctgaacgcgggtgttcatgcccttgccgtcgccatgagcccataacagtaggaagatgggagatttgataaagagacacgagagaagtcgttgctatgggattcgtgaggacaagtgtctcatgcaggaagcgaggtccttcgatgagtaattctttctgtacaaccctttaattttaactagaaaaagtgtccgtacgttgtaacgggaagaaaaaaaggaaaatctcgctggcagattcggtcgtctggagcagagaaacgtgagccgtcttccatttcgaaggtagagtaagcagagcgcaactgattggtgacactgaagatgatatatgttttttcatgatttcacatgtgttatgtcttggatgcaactcatattccgcttattgttgtgctctttttcaaggatttgtgttttgtcacatcctgatttgagtttaagggattttgtaaattatttaataaattatttcaaaatttatattaagtttcattaatttacaagtgaagtttaatatgagaaatataatttcctaattaaaacatggttgtgtttaatcattaataaattctccatgattaattatactctttgaaatttttcaattattaattttaacaatacaaagaacattttcaataattatttaagcaattattaatcattaaatgatctagataaatatttttttaaatacgttgagtatccaactattttcatgatttttcttgaaattattagaacattgaaagtgtttttgaaaattcaaagttcatttcagtgattaatttaaatgaaaaagtagttaaaatcgtctcgtcttggaccaattcgagtaaagtctgctttccgtctctctctctctctagcaggctttacctcctctccggtgaagtctaatctgtctcctccttttatcggcctgtttgctttcttcctttccccttcggcccagcagcagcagagcaagtctagatagcgtttggtgaaaaaaaaagtctagatagcgttcctcggtctctcctctctctgtcgcccagggcccatgtgccacagtcttcttcctacacctccagaccgaacccccgtgcccatgcgaagcccgcgctgcctctccttccaatcccacctaccgagggatgaaactgttcggatagattccgtccgtctggaccattttttggattcgaataatttcggtcggaactatccagaaattttcggattcggaaacgaatttggattattttctcggaaacgaaaacgaatacagtaagggtactatccgtcggaatcggaaaacggtcagaaactatccggaatttttttcggatatcctcagacattgataaaattttagaaaaaacacgtatatatacataactttttcatacggaatcagatgaagacaaactttatatcaacattgtagatctcgatgagatctacaactttcttattgactattttattatttgagatcatttaagggtctaaatattcattataatatatcatattaatttttacaaaatctcagatctacaattcaaacaacatctgatggagatgtgttctatatcaaagttgtagagctcaacgggatctaccactttgtagtttataacatttgtatttgaaagcatttaaagcataaaacaaatattgcaagtttcgaagatgtaaagtaaaataaataacatctccaatttatacaatggcaagtaagttatacatcaagtaaaagttcttgagaattgaaaatgataatcatatttgcatatggatctcttagaggaacaaccatgaaaatcgattttcgcatacggttgtgagaccgtctacaaaattgatgatataaatgttggagatgttgaatgatatctcttccttgatcaagaaactcaatttgaggggctttttatataccagtaaatattcgccaccgtattcgttctgtctcgtattcgctccgtatctgtattcgataatattcgatttcatttccgtattcgagttttcgattccgattccgattctgaaaaaaaatatgaaaacaaatatgataaaactagtttccgtccgtttccgatccgttttcatccctacacctaccctttgctctctttttccaaattggatggaaaaatgggttcccctcaatctcctctaccctttcctcgaaatagacgaaaattatgtaagactaatgaaaagttatcaattttttttaagtagtaagatttgaatttccaaacgtttggcttatggatcttcgtgccattaaagatatcaacctactgtcccatccgttcaaaacctcagctgaaaaatcagagtcatcaagatttaaatcaatacccctcgaatttgcaattctgaaattcctgataaatggtggaaggttactgctcacttccttttcgctgccctttggcccaactgattataaagtcttgaggaacattcccttgttatttacatatcatctaaatagttgtgattttttttaaaagaagtcaacaaaatagatcaattcaggcattcagctagtgacaaactacaaaacggacaggaatagcgtctgcaagggttcataacaattcaaatcttctagtactacacattactgctcgttgacatgtgggcctgaggatatgtgagggccacatgtcagtaagcaatactgcaaaggaccctctcacttggttcataaagggtattaaagtggggtctaaattgtaggcatgtcctaaattggaattttcttttattttttgtacttgtgttttttttatctttttaaaaaaatcccaaccaaaacttattttcagaatatgaaccttttgcataccaacccgtctgacgtgacaaaacaatattgacacaccacacattgcaaatgtgacatctttatcctgctacgccagctagaccggcgtgaccaaataacgctgccacgctagccagagtggcgtgtcagtgttgttttgccatgtcagtccggctggcgtgataaaaagtttagattctaaaaataagtttgggaagggtttattttaaaataaaaaattcaaaaagtttttttttaaaaaaatctctaaacggagtagtttaaacactccatgcatggatacctctgaacattttactcggaaaaaaattcctaacattgagtgcgtcgtagacgggggcggagaggctcggctaattaatgcgtagtgtctcggtttgacattccccataagaaaatatatctgacaatatacatatgtaactcaagataattgcatgtaccaacgggtttagacagtaccggctgaatgcaatgtcctgtagtcctcttcttcatcttacccattatgaagttgcccgccaccatcgtcatcttcttacccataaaaataaatacacttataaagaaacacaagtaatatagtagtgaaatcatgggtgcataatttcaaatcttaatatccataatattacacactatgggtgggtttttaatggcaatttagtgtgatcgatacatgatatacagctggtttcggtctcttaaagtatgtgctaggacacgtattcgtggggtctaagtgtgtggtacgtgccatagaatagaaaaaagaagtaaactgaggtgaaaacctataattaattacggttaaacacagttttttcgtatctgggtaagatggatgctctcgaccattgggattgacctgcaaatcttttctcatcgacgatctgatccagagtatagtcagctactcctaagtaaacctgtcttcaatttccggagtggtacatacttcagcgcgtgacgtcgatcgatggatcccaggctgctcagagccgcacgccgcggcgacttcgcggggctcgaggctctacttctgggcgccgccgccgccgccgcgccaaaccaagtcgccatcgacgtcgtcgtcgtgcatcatcatggcgccgccgcggcccccgggcaacaagcgcctgaggcggcgccggtgccccacctcctggacgcggcggcgacgacgccgcagggggactccgcgctgcacgtggtggcggcctccggcgacggcgaagggttcctgcgctgcgcgcgcgcgatctaccgtcacgccgcgcgcctcctggaccgccccagcgcgagcggcggcggcggcgacacgccgctgcaccgcgccgccagggcgggcaacgcggcgatggtagggtgcctcctcgacatggccaggcaggaggaggaggagctcgccggcggcacgggcggctcaagggtagccgaggtgctggagaagaggaacgctcgtcaggagacagcactccacgacgccgtcaggctgggcgacgagcagctcgtccgccacctgatgtcggtgcacccgcggctcgcccgtgttccggcgccgggcggcgggatgtcgccgttgtaccttgcggtgtccttgcggcatgaccgcatcgcggaggccctgcaccagcaaggcggcgacgaggtctcgtattctggaccggccggccaaactgccctacacgctgctgtcctacgcagcgcaggtaattaagttcaataaatcaaagatataaccgatcaatcaaagatactcctccgtcacaattctactgctcttgaagaggtagcattaggtaaaaaaaatttagtctaaaatctgtacctcatagtaccttataatagctaagtaccaaaaaataccaaatttataatagaaaaaatggtatctcttggtaccttctcaaaaaccgtaaaattgcttcttaaaataaacgtagttatgagttttcgtatccaactttaatcgtctgtcttatttaaatttttttaaaagaactaaaaaaataagtcacgcataaattactatttatgttttatgatctaataataacaaaaatactaatcataaataaattttaaataagatgaacgatcaaagttggacatgagaacttatggttgtacttattttggacggaggaagtatatatgaatataatgttttctcatcatataattattagttcagtgaaatttactcataatataaattcaagaaatgacagaaaagatactggaatggaacaaggggctcgccggcgaagccgacgcgtccagcagcacagcgctccacttcgcagcagcctcaccggagaacaacccagagaccgacagtagttcactcctccgccgctgtctccgctcgccgtcgagccacggccgccggacacccacccagcttctcctcgaggccgacccctccttacccttccgcccggacggcgacggcgagtaccccatccacgtcgccgccgccgccggcaacctgaggctcgtggccctcctcctcgatgagcactgctgcccggagtgcgccggcctccgcgacgcccgcgggaggactttcctccacgtcgccgccgaccggggcaggcaggaggtcgtgggattcgccgccgacgacaagcgggcggtggcggcgtcgatcctcaacgcgcaggacgacgacggcaacaccgccctgcacctggcggtcgtggccggggacctgggatcgttctggtgcttgctgcggaatcgcgaggttcgcctggatcttgcaaacaacgacggcctcactccggttgacctctccaggagtaccgttcctgcggggctttactacaaaacggtaaatctagactagttttttgaacattttcacttcaccgtttctaacgtgttaaagagtaaaccaaaataattttatacacttttaattgagaaaattgattatgattctaggagtgttggggtggggtgggtggtggtatattagccccgtttggtaggcattttgtcgaacatatatttttttttgaacgactagcacaaaccggtgcgaaattctattgatagagcaggaaaaaaaaagtacaagattataaccctggagagtcgtaaccaggaaaagaaaaaaaatagcaccacccacacgacgacatcgccaacacacacgccgcctttgccagatgacacagcagccaccacagctgccaccgccgtcgccaactgccgtcggccaattgccgccgccgccgtcgccacaccgtcgccgccgtcgccgactgctcccatcctccagatccagccgagaggcgtggatctgggggcatcgctgccgtcgccgccaggcatcgagccgccggccacagtagctgcgcctccgagcctaccgcggccgcccgcgcctgctccgccgtcacgcctgacgccgccgcccggccgcccgtgcctgcgccaccgtcgcgtttgccaccgcctgtcgcggccgccagcgcccacgcctcgccgacgccgtgcccgcgcctccgcgaccggatccagctgcgagcgcgccagatccggtggtggtgacgccggatccgccgccatgcgcctcgacgccggcgccgctccggtcggccaccgcctttgcgtccacccgcgccaggagctcgggagatggccaccgcgagccccgccgccgccgtcctcgcgagccgccggctttgccggccgctcgctcaggcgacggcaaggcagaggaaggggcggggaagggcggcggcggcggctagggttccgccgcccgagtcgcccgacgcgggggccaggagagagttgctggggattgatgtcgaacacatagttggagtcgccctgccgctgccgctgccgccgccgctgccgctcaacccgcgcgccacgcccgcccctcccgtgcgcagtgggccgccgccgcggccactgtcgcacgcccggccactgccgctgctgcccgcgcgcctcccgtgcgccgcgggccgccgtcgcatgaaagtaacgtaactaaagacatgaatgacgattcagatttaactcaagaaagatccagctgctaatgttttctaggtgatgtggttcaattaattcatgttgagattattttttctccaacatatatacaatatctgtactgattgtagtaattttgttcatgcagagcgcacgaacttggatcctctggtctctggtagaaagcaacgcactcggcagcaacttccggcgcaacgatcacttcgaggaggagtacgtccccaagaaagacgagagcgccgagtcaaagaagatgacggagtcgacgcagatgctgggcgtcggcgccgtcctcgtcgccgccgtcacgttcgcggtggccttctcccctccgggcggctacggcggcgacggcggcggcgcgccggcgctggcggggcagtaccccttcgacgcgttcatgtacgcggtggcgatagccttcgcctactccatgctcgccacgtttagcctgatgtactccagcacggcggcggtggactggaagctccgccgcgcgtacttcgagcggtcgctggcgtggatgcggcagtcgacgaggagcttgctggtggccttcgcgctcggggtgtacctggtgctggccccggtgtcccgcaccacggcgatcggcatcatggtgagcgcctccggcacgctgttcctcaggaacagggaggtgctgcggatgctgatgtgcgcgtacgtgctgcacaagaggatggggatcatggtgctggcgaggattggtgtcccaatggccgtcgtcctactgcagtccagccttatcttcgtggttatctttggtgcacccttgtgtcctccgttatgccttctggttttcgttgggaagctagtgcatgaggatgtctcgttcctaagatatgtaaatggaaaggttggttcattaccttttcaataaaacttcagagtaatagtttaacctgttagagtttgtgtcaaatatgtattcatagtcagttacagtttagaatttgaaattgtaataggtataagttagagttagagttagaattggactctatcctaggctctatctaaatagagtggcacacctattataaccgcatgacaaattagcatagcgagaaggaacggttgccgacgacgtccggtcgttgtaatatgttggatgggggaggagtgactgtaattagtgtcccagagatatatgctttggttgaactccgttatcaaatatcatgcatcggtgtcgtcatcgtatttagatgtcctatagtatttcttgcgcatttgattcttgatgatgttttcgggccggttttataacactatgaaatgaatatgcgaatgtctgattccggattcagaacattattctttcattgtagaacctttatccgcataaacattcaacgtttagaaactttctacatagaaattttcaatgtaggaactttctacactgatgtcgaaagttactagtaacatgttttgcttacaaacttactactccctccatcccaaaagataattacagattattcaggtataaagtttctgtgcagaaaatattaatataaactaacctctcaattcaaccaatttattttccaaactcgagtagctatgtacatacttctaacttctaaggatgagagaaacctcaaacatattgtatgtttattacgattcatagcactgaaatatatcatattttgtattatgtttgtttattttgggacttaaagagtagaggggtatgtgggagaaatgggacccagagtacccaccaccatctactcgcggggcacttctctgtttgggcatggcccttagtaggctgctcataggcagttcattccccgggcgtggccccacgtgggttgagcccggggcacttttttccccactggctgtacttggtacacttctctgctcgggaattcaccctgtgagttgtttcagctgactaagggacttaccatttttcagttgattggttattacacctctaattccaaatataagttagtctagagactaaagatgtctataacaattaaaaaaagataaactatttgttacaaatacgttttagattttgaatagattaatgcatgaatacatgtgtttcatatatgtattcaaattcatatgagtaaattttacaaaactacatacattttagccaaattatcacaaaactacatatttaacatgatgaattacaaaactacctatttaggagtagcacttaatttatcccggaattataaatttaggtaaaatatcacaaaactataagttttatatcaacttttaatcacaaaacttatatatataaatcaaacatagcattagtgctaaggatttggaccaaaaattttgtagtttgtgattattttattattaaatatgtagttttgcgatacttagcctaaagcctatagttttatgataagtttattgctaaattctgcagttttctaatatactagatgcacttttaaaccccaccttgcccactccacaaggagtctaaatacactttcgatggcccggggagggctatcgtggtgttcctactagcctaaacatgaagacgtgtttcatggggtcccacatctccgccagatgcggtgccaggtggccgagcatgtccatcgcatttattatggattt

SEQ ID NO: 64586 - DNA, 10685 bp, Oryza sativa
ttcctgcagcccagttgcatgcgtgtattatggaggtaggtgaaattgaatgattgagagttgtggttggttgtgaaagtaggtagagaaattaaatgagagggttatgattggtagagaagttagttatattttgggataaatttgaaatgctaaagttgctatattttgggattcattatattttaggataaatttgaaagaaaaaagtccgaattacgtctaaagttttgcgacagtccaaattacctacctacactaaaaaccggatgttggagcacaaaaaaaaaataaaagaaattgtagggcttacatgtcatatctcttttttgggtgatcaaactccccctttgcagagggccctataggcagtgaccaagtgaccaacgttggagctcgagcttgctcaggaagcgcgaggggggggggggggggggtggacactggaagcaaagactagtggcgaagctcaagctcgcttatatatgttacatggtctagaccatggctccctacgacctatacaagaaaatggtctagggcacagtttaggccctaaatgagatgaaaatctgcagtcttgcgtctagacgtgatctagactgtctaaaccatggtctaggcgaacactaaatatataggacgctgacggtagaactcgagctcttctcgtcccttttctctatctaggtccctcatctcagcgactgatagcggtggtggacaccattgcttgtccagccattgtctcctcaagcttggttaggtgattgacattggccgaagcaaagcttgaggcagtggcggaccaacgtagagctcgaggagatggtggacccacatagagctcgaggctctcccgttccccaagcactgctaccccatcttaataggggaagagatggaggtagccgcgagcagatctcatgttgttgtgcctccacattagagcaaggataacttgcaggctataagccggctaaatgcttaggtggaagagagaagagaggagagagaggagaagcgggctataaacttacagccgacttggacacaataacaaaaaactctgtaagagagacaagtagaccatgtattaattgtaaagagctaactattatatgggtaggctaagagaaaactaaaaaaaccttatagccatcaggtcggttatattattagccttcctcttagtgccaagtcggtgctcagctccatggtctccaccgtcgcacctccacatctcatgttgtcgttgttttcttctgctgaggtcgagcctaggaaagaagggaagagaggaaaagtactgacaggtatatccaatcgattttaaaaatattttttggtgggaaaaaaaagcttcggattgagtaacggtataattcgtgttttgaagagttttggtgtgaaatatttggtgtgttaattcagcgaataattttaattttcacaaaaaaatgtggtggtaatttggaccatttctaatttaaatcactagcgctaagcggctattttaggatggagggagtaaaacttacccttttcattttggaaaaagtacgaattacccgcctgaacatcgcgacagtatgaattactctatttaactcgaaaaccagacatccttcaccccccaactatgcaaacctgacaaataaccctagctcaatccgcggtggttttagtcctacgtggcatatgtgtgatagtccaatcagaatttctttaaaaaaattggagggccccacctatcagtttctcattcgtctctatctctctactctatccctttccccggtcccctctctctcttctccctcccctcacctccatcagagaatgacggtgagcgaatgcagttgggtctaggcaacgaagggggagccgaggatggcggcaggcaagggcggagccaactgggggtgccgaagccagggatggcgacgcgcccctatctccgtcgtcaatgcccaagcaacctccgcctccccccatcggcacccgcgcgacctccgcttccaccgctggccgcccgagcgacctcttctgccgccagctgcccaagcaatgtgccacgcacctccgcctccgtcgctggccgcccgagcgaccttcgcctccctcgttggcaccgcggagactacgactctcctcatgtatgcgctggcgccggaggctgaggaggagctcagctcggcatggaaggtcgtctcgtgaagagatgtaggggcggccctcgtcatccgcggtgtcggcttctccagtggggtaatctccggtggtgggtgaggatgaggaggaggggatggtgggagacggggcggcatcatcgacagccgcggcgtgtggtggtggtggttgcgctggtggtgcagagaggtgggaggggagagatctaacagtggaccccaacgattgttttaatagtatttagaaccaaaatcatcgcggattaaccgtcgggaggagggggtgaggggttatttgtccgatttatatagttaggggcgaatgatgtctggttttcgggtttggggttaatccggttgactgcgatagtctaatgggtaattcgtgtttttccttttatttatttttttatgcaactttgactcctagacgtacattttattatttatcatattaaaagatcatgaaagtaccatttatgttgatgttgacgtgacatattttaattgtaaaagatatttgaagtttgttttacatttttgtacttatatttatataatcttttttgaataatgaatagtaaaccatactaggtacgttaaaacggtagcaacattgtacatttaaaattagaggtagtgccgcataaagagtttccggtcgcactcggcacacgggatgcaatgcaagacaggtggtgatcgcgcgcgggttcgtacgtccatggttttttgcacacgcatgagtgcatagtgctgtgcataaccatgtttaattagtcaactagtgctaaccgcttcagcacgtcgatggcaagcatctgactaagcatctgaaatgttaattgtaagtagttgcaagataccaaacgggtctaaatcccaagtttgattcatcaggcgcggtagtgatgatatgatggatcccaagctgctcagagccgcaggccgcggcgactgcgcggtgcttgaggctctacttctgggcgccgccgccgccgccgccgcgacgccaaaccagcaagttgccatcgacgtcggctccgggcaacaatcgccgctcctcctggacgcggcgacgacaccacagggagactccgcgctacacgtggtggcggcctccggcgacggcgaagggtccctgcgctgcgcgcgcaccatctacagccacgccgcgcgcctcctggaccgccccaacgcgaggggcgacacgacgctgcactgcgccgccagggcgggcaacgcggcgatggtcaggtgcctcctcgacatggccagggaggaggagctcgccggcagcgcgggcagggtggccgaagtgatggagaggcagaacggccggcgggagacggccctgcacgacgcggtcaggctcggcgacaagcagctcgtcgaccatctgatttcggtgcatccccggcttgcccgtcttcccggcggcgacgggatgtcgccgttgtacctggcggtctcactgggccacgaccacatcgcagaggctctgcatcagcaaggggacgagctctcgtatgcaggaccggccggccaaactgccctgcacgctgctgtcctacgcggtgcaggtacgtactcctacacttttttttttagaaaattcctcatatgccacctaaagttcacaggttttcttatatgccatcgtaaattagcagttcatgtatatgccatcaaacagaattttcgttcatctatgccatccacgtcactcaagagtagtgttagctttttttttgaaaaatgacaaaattactctggattccctttctttctatgtaaagcacaaatcagggtgagttgtagttgaaactatgactataactttaataatcattactgattcaacaaacaaccaataattggatgcaaagtttgtttctctcctatttttatagttaatttatagattatagaaagaaatagttcataatcttttaaaatgtcactaagaacaataatttaattagttataatctaattaatgtatctaactggatgtaagcattcaatttagaaaaaaaaaaacaaagcaatctctcagctagcaaactgattatatgcttaatttaatcacaaaaataggtatgcttaacttaacaagctgcgtgcttatttaatatcgccatggaagtactccccctgtcccataatattgtaacataataccggacgagacacttcatagtataacgaatccagacatgtttactgtactttaaattcgttatattatgaagtgtcacatccagtactagattgctatattataattataagacggagggagtaagtaactttaggataccgacattagtgattaacaccaaaaagatgcatcagctttgtttactcgtagtaagaatactaatacaaaattgaggagtttctaaactattgaccagcttttccctgagccatgtctagagagtggtacaccaacactaggaagataaaatggggaggctgtgcataagaaagaagggaaaatatagtttatttatttttaacctcttttttccaataaagaatatacatgtgaataattaaggaagtgaattgcgaaaaaactatagcaagttgctactccctctatcaaattgatctacatatttcataggtataccaagaccaaaaaaagctaatatctctctcatactatatttactctagcaacaaactcgatgcatgcaccattctcgctattttctagccaatagcaaatcaagatattgcatgtggattataaatacttgcgtgcatagatgcatacatcaatgtctatttattccaatgcacaaataacaaatagacttaatgaataaacacaaatatatagatcatttaggaataacaaaaaaaaaactatatgtagattagggatggcaatggggcggggtgggactgggttggacaggaacggtcctgcccctaacccccgactttatcccccgtccctggccccggtaccatcttcgtgtgaaaagcttccccgccaccgaccccgaccggggccccgcaagctgtagagaaagaggacaaaccagaactgtagcagccaagatgcggtggcttatcgaggaggccagtgtcgcggagatttggcggaggtgcagaagccggctacgcgcgacgaagacaaaggcgaagcagccgacgacatgcgacgaaggcacaacagccggcgacacgcggcggagttgcagcagccggagatgcagcgaaagtgcagcggccggtgacccgcggccgagacgaaggtgcagcagccggcctgggctgacgaggcgcagccttgcagggagctgacgaggcgcagcagccgtgcggagtcactatcgcttgcaacgactgcggtagcgccgatgcagtcgctactaattgactctatctttctttttattttcttttgaaaggtcattgactcgatctggatgggtggctccgtgactatgtatggctggggtagataagacgagataaggaaaaggagaaaattgcatatgtaccatggtataaaactggtttcgcaaaaatatcatcattcaaatgggtttcgctagaatactattctcaattgagtacacttcaccactttgccattttcattatttctttcattttaaattcattttatcatctttgcatctctttttgactgaaatacacctagtcagcaacgttgaagcacttcactcccaacttgaaatggatctgatctgcaacgtaccgaccaagtttataatttagcatataaattatcctccaacatttagcatttaattcgagaaataaattaaattaaattaatcaattacatctacaactcagattcaaatatttgaataaatcaattgcgattggacagagttgattaatttattttattttatttctcaaattatatgctaaatgttggaggagaattataggctaaattataaacttggtccgttgcagatcagatcattgcacgtaagtgcttcagcgttgatgacttaggggtatttcagtcaaaaagagatgcaaagatgataaaataaacttaaaatggaagaaatgatgaaaatggtaaagtggtgaagtgtactcagttgatgatggtattttagcgaagcccatttaagtgatggtatttttgcgaagccagttttatgcgatggtacgtatgcaattttctctaggaaaagttatttcacaacatgggcttgtttgggccacatttttaatgggccatctgcgtatgtacaatatttccgggtccccatgggtcacccgcgggtaggaatctagacccgcccccgtccccgcatatttccgggcccccgccccgatgcacctgtggggccaaatatagccccgaccccgtccttgtaggggcgggtccccgtcggggaaattgccatctctaatgtaaatcaatttggaatggagatagtactattgggattgcctatccatttgtcgggtgatttctaaaaaaatcatccagatttttctacccttagatttacatccaacggactacaaagaaaaataaaaaaaaaatacatactccctccatcccataatataagggattttgagtttttgatggcaacgtttgaccacccgtcttattcaaaaaattttgaatttattaattattttatttgtgacttactttattatctataatactttaagcacagcttttcgttttttatatttgcaaaagaaatttgaataagacgagtggtcaaacgtttcaagcaaaaactgaaaattccttatattttgggacggagggagtatttacttacacaacaattttatcaaaattacaatgcactaacatgtcatattaactgaatttacaaatgtaattgtagttatatagtattgtaattttatattttaaagaaaataacaaatagatatttacttacacaacattgttatcaaaattacaatgcacttacatattatatcaactgaatttacaaatgtaattttaattatatagaactgtaatcttatattttaaagaaaataacaaatagatattcacttacacaacattgttatcaaaattgtagtgcacttacatgtcatatcaactgaatttacaaatgtaattttagttatatagtactgtaattttgtattttatttttattttaatttcaaatgagagaggagagagagcatcatgcatgtcgatttttcagagcaaaaaataaaaataaaatagtgactctaaccatccgacgctgttacacgcgacccaactgaaccctatgcgggttcccagcccaacatatacgcacggatcttggcacatatggaacggcctaaaaacgacaaatctgagagaaaaaaaatcacatgacaaatctatagcaaaatcgagtactttttaaaaaaattgatccattctttgatatgcaagaagtaatatttctccgttgatttcggaggcccatcatatgaagcttttatggtgatccgataaatattggtgaccatatgcattccgattggtttcgttttcatatctggattttagagtattcgtttcggtttttaaataaaaagatgaaagcaaatatagtagaggtagctttcacagtatccgagccgtacgttttcattcctaatggcagtttatgaaaattcaatcaactgatgaataaacactcctttacgattgctaagatcacacttaaaaattattcttaaaacatcacagtttaaaattatgcctttttttaaaaaaaaaacagtgctgagcaatagtttgatagctaccgtgttgtatattggtttatcttaagctttgctttgtaaattataaagaaatgacagaaaagatgctgcaatggaacgatggtctctccggcgaagccgacgcatccggcagcacagcgctccatttcgcagcctcagcggagggaccagagatcgagctcgagaagagctcactcctccggcggctcgccttgcgatggccgtgctcgcgcaatggccgccgccgccgccggacatcgactcaagttctcctgaaagccgacccgtccttagcctgccggccggacagcaacggcgagtaccccatacacgtcgccgcgtccatgggaaacctcaagctcgtggccctcctcctccacaggtgcccggagtgcgccggcctccgcgacgcccgcgggaggaccttcctccacgtcgccgtcgaccgggggagggaggagatcgtgggattcgccaccgacgacaggcggaggcgggacggctctcagctggcgacgcccatcctcaacgcgcaggacgacgacggcaacaccgcgctgcacctggcggtcgcgagcggtgtcctcaacgtgttctgctacctgctgcggaatcgcagggtttgcttggatcttgccaacaacgacggcctcactccggctgacctctcaaggtgtaccattcccgctgggcttaactacaaaacggtaaatcactttcgcttgactggtaatttctaaattctaatgttacttgcctctccatttaatagagctgtctacatacgtatgtaccattgtacctacatacatacacatacacacacatgtgtgtccaatatgtatgccatgtgatcaaactcatccaatttatataaaaattagataaaaataactatacaaaaccaccttagggagtaatatgaatggttttgcaaagatctgattttaaagtttagggtgtagaagtatttctatctaaagtttagaggagtatttggatatttttttttcttttttaattgttatatagggggaattttacagttgagatatcaaaattttagtaccttacttaatacctagaagtattaaatttaccatagaaatatggtacctcttagtaccttctcagagatattaaaattacccttgttatagacatctctagtctctaaaccaactcatatataaccaatcaactgaaacatagtaagtccctttaattagagatgattttgcatctaatttagtaatttgttgatgcagaacgcacgaacgtggatactttggtccctggtggtagcgaaagccctcagcggcaacatccggcgcgatcacttccagcagcagtacgtacccaagctagacgagatcgccgagtccaagaaaatgacggagtcgacgcagatcctgggcgtcggctccgtcctcgtcgccactgtcgcgttcgcggcggctttctcgccgcccggtggctacgcggctggcgatggtaataataacaatggccgtggcaacgtcgtcgtcgtcgcgggctctccggcgctgtcggggaggtacgccttcgacgcgttcatgtacgccgtgacggtggccttcacctgctccatgctcgccacgttcagcctgatctacgccgggacggcggcggtggactggaagatccggcacaggtacttcaagcactccctgtcgtggatgcgcaagtcgacgaggagcttgctggtggccttcgcgctcggggtgtacctggtgctggccccggtgtcccgcgccacggcggtgggcgtctgcgtcttcaccaccggcacgctgctgttcaggaacagggaggtggtgcggatgctgatctgcgcgtacgtgctgcagaggaggatggggatcacggtgctcgcgaagattggggtccccatcaccgtcgacctggtgaagtccaatcttgtctacttggtcatcttcggtgggcccctttgcactccgctgtgcgttctgttctttgtttggaggctagcaccagtgattatgagatacgtccacagaaagttaatatgatgcggtgaacatctctgatgtgatatcatattagatggtgcatgacttcaagcgttagggttcaaatctgaacttcttccgtagtcaacatatatgccaatgttttcctaaaaaaacacatatgccagtgcacttttattaagaattttaataattgttacagtgcatgcatgtgtgtgtttttaaggaaaattggaaaaaaaaagtgtcgattgtcaatacaactccggctgggatatatgatatgatttggggttgggggaggaggaggagaaaggggtgaaacggggggcttcccccagacgctctgtaggcggcgaggcgctggtattgataaccggaacggtacacacggaaaatagagcaatcctttagtacattattaattaattattagctccctctatttcataatgtaaatcattctagtattggctacattcatatgaaacacacgttatgaatgacttaacatattaatatgcatccacattcatattaacttctatatgcatgttgtcggtgacatgggatcaggagtatcatgactagaggtttgaggcagacacaatcgcatacgtggcctggtacccccgagggacgtcgggcccgagggtgatgcattcgccctcctcttagtccccccgagggggtc

SEQ ID NO: 64587 - DNA, 11706 bp, Oryza sativa
tcacctaaccacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcctagagatggcacgttagtcctggtcagatatatgccaggcttcatcctaaaccattataggcaagatgttgtgtgaagaagggcgagcatgtagattgctaagctgacacgtggtggacaagaatgaccgacgtgactggtctgataccggtcatgtcgtcagtagacagccacgattccacgtcgcacctgctcccggcgaaagtggaggtagttgtgggccgtctcatcagaaggtgactcggacggcaactatacaaatctccgtccatttatggaaaggggggggggggtaagtccccacaaaaaaagagagaaatggtgcatgtggtatccccttaagatataaaaggaggaccttgcccactgagaggggggattggacttttccagattagaaacctagaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgtgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccagttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgcccggggtgacgacagggtcatggcgaatttctttcccatggccctgaaaggacaagcgcggggttggctaatgaacttgccacccgcgtttgtccactcttgggaggatttgtgccaacagttcaccatgaacttccaaggcacatatccgcgcccaggtgaggaagcggacttgcacgcagtacagcgaagggatgatgagtcacttcgcttgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgaccttgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgacgaggacatcgatgacggcgatgatgacctaggtttccaagagcctggggccaccattgccaccgtcgatgggggagcgtgtgctcacgtttctcgccggagcttcaaggccatgaagcgagagcttctggccacggcccctactcatgaggcgacgtgtcgggcgcggtggtcggaggttgccctcaccttcgaccagaccgaccacccaccgtgcgttgcccggggagggcagatcacgatggtggtttctcccaccgtttgcaacgtgaagttggggcgtgtcctcattgatgggggagcggccctcaacatcctttcccctgcggcctttgacgccatcaaagccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcaccgtgcggccgggcgcaaggccggtccggcagaaagtgcggcggcaggccctggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggattcttaccccctgcctcacatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggatggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccctgacgaccggagttggccctctgcccgcttgtcagacagtgctaggagcccccgacccccaggaaggccctgaggccactgtgggaaggccgcacctatcgcccttcgaccccgaggctaaccctgtgctgacccgacccgggaaagagcaggaagaagaggcccccgagcctaacggaggcctaaggcccctgacgaccggagttggccctttgcccgcttttccgacgacgccaggagcccccgacccccaggacggccccgaagccactgtgggaaggccacccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcgcggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccagtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccctgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcgacgcgcggctaatggaatcctcttgaagtgcattcctcgggaacaaggcgttgtgcttcttgccgatatccatgaaggcgaatgcggagcccactccgcctcgcgcaccttggttggtaaagcttttcgccagggtttctattagccgacagctcttaatgatgcggtcaacctggtccggcgatgtagagcgtgtcaattccacgccaagcaaatccattagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctccccgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggagtcaggtttcgggctcgggccaaccccgcaccccccttcgggcgtgcagggttggccgggggctacaacatatgcatattcttatttctctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctagcctggtaactcgccaggacgagctccaccgctccttgggcgaggtccctcgaggatgacttaattgtcttctcgagctcctcggggagccgttggagagccccagccatcttcgagaggcgctgggcgaggcctccctggttggcggcgtactttacggtccgccctctccagaggcccacttgccgaccggcgcaatctaggcgggagacggcgtcccaaagcatgccgggccctatctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcaagctcagcggcccgttggttcaatacggccctctcggcggggcaccttccagattgcggtgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcgccctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggaccaagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccattgaaccaatatcttgaagtcctcaggagcccagtcccatctcactccctggtgggtcctcgtgaagtcttcggacccggtgtactcccaggcgccccgagcgcgtcgctggagcggtgcaatccgacgacggaggtagtcgccgtacaccatggcccctgtgagcccctgggatcgcaggcccgccaggcggtcgaggacggcgtcatagccatcccccagatctaccggcacccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacagtgaagaaccaccggaacagccgaagagatgggcgcaccccaatgaacatctcgcacagatgcgcgaagatggccaaggtcatcaccgcgttgggggtgaggtgcgccatctggagatcgtagaactccagaacatccatgaagaaagaagaaaatggtggaaccagccctgccattgcaaaggggagaaagaagacggaccgccccgggtagtgtggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttgtactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggt

SEQ ID NO: 64588 - DNA, 1877 bp, Oryza sativa
actttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtcacatgtggacaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttaggatgacggtgaatccgaaagcgggcagccgcagagataggaaaatcagcggggcaagggcaccataccgccgcctgcttaaggaggagatgcgggaaagggtggaggtcggctaggagtagagatggcaatagagacccataacccgagacccgacaggtttttactctattagaagctaattgttctaactcttatacacatgggtctactaacgggcgaaaactcttatctattgggtacatggctatgggtccgttctttacccacccgtacccaccaacctgtgggtgaaaaaaaaccgttgattgagtcaaactatgagcaatataagtatcgatgactactaaatcatagcataaaactcatttcacatcttaagtattgttctagtctagttatatgaaattgttatttgatttcttgattatgtaatgtggttgtataattttttttcctcacctttgaacgctaatgttaattaatagtattgttgctaaagaaaatattgatggtttacaactctaatatggctaattatagtacaaaattataaatgctgcaagtcaattatatgggtatgggtatctatacccgttacccacacgggtgtgggtatagggacgattttgtatccacgatggatatggatatttaagtgagaatatttaaacatcacgggtgtgagtatggggcaagctaagagaacccgatggtatgcacccattgccatctctagttaggaggcctcgttgacatcattcgcgccttccggctagctggcggggccagattgacggtattggtggggcagattatggctagacgaggggagttagggtgtgtttagttgggaaaagaaaatttttgggtgtcacatcgaacgtttgaccggatgtcgaaaggggttttcggacacgaatgaaaaaactaatttcagaacttgcctggaaaccgcgagacgaatcttttaagactaattaaaccgtcattagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgaggagccgcaccgagacggggaagctggcctgaggaggagggcgggggttggggggggagggggggcgggagga

SEQ ID NO: 64589 - DNA, 24725 bp, Oryza sativa
ctaattaggcttagaagattcgtctcgtgatttccttcataactgtgtaattagtacctctctttatatagacttaaagcttcagcgacgcgtcgaaagcggccgctctggtgcttagtagatcccccttacaaggtgtcaagagcccgttattacatgcaccaaatgccttttaagtccaggggctggtgtggcatcagagcccaatcgtttgtcgtgggcaggaggccacgacctgactagttccatgtcactcgcatcgtggagctgacgatccgccccaccgccgcggacgatccagcctcaacagttcgccggtatgcacgcgaagggcggcgggaggaggccggctaggcctccttagcgcgccatccgcgtgcattccggctaactgttgaggctagattgacagcggcggtggggcagattgacagccaaacgatgagagtgacatggaacaaaaaaattcgtggcaaaatccaaaagatttctgaatggaatgcaatttatattaaaaaacctatgaattagatggcaaatagtgaaatttctcacctgatcatgacaccctgtttagaaatatgactatgtttagatgggactaaaacttttaagtccctatcatatcggatgtttggacactaattataaatattaaacgtagattattaataaaacatattcataatcttggactaatttgcgagacgaatctattgagcctaattaatccatgattagcctatgtgatgtacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaaggcgtaccgccccgccagcgccggcgcgccggctgcgacgtagcctcccgggggggagaaggccacggcgaaagccacggtggcgacgagcacggagccgacgcccaggacctgggccgactccgtcattttcttggactcggcgctctcgtcgagcttgggtacgtgccgctgcaggaagtgatcgcgcctgatgtttccgccgctgagggcgttggctattgttagacaccaaagtatccacgttcgcgcgttctgcagcaacacgagcaaagttttacccaattttgattagcttaacgatgtagttctctccttccggtgctaaataatatttgacgctcttttaagattcgattaaactacttttaaaactttggacatcagtttcatacaccaacaaatttataaaatctagagtataattcataaaatccctgtatatttggtctaaattgtacgaaaccgtatgagttttatactgtgttgcgcataacagcatgtattatggtgctatagtttcatacacttttttctaatctactatgcatatgaattttatgggttcgtttatccatcaaagttaattatattttattgtgctataatattaatagttaagttagttgacggtgtggttttctaagaactagtttaaattctagatttgataaaggggctcgtatttaccgctatttatttttttagtggtaggtggcgtttccatcaatagagaggacttcatcaatctcaagatataccgactcagtcctgaagatgctcacaaaaatagtgtgtgcgcgtgctatgggtgcctatgttcgttccatgtttctaacaaaaatacaatactacaagtatattcgtactatttttttttcaaaatgcagatttacatgatttgatataaaatagtttaattgttgtgaatttatttttaaaagaaaaacattattaaaaagggcctgatctaagggcacgtacaaacgtgtataatagcggtctctctttattgccatgtaagtaaatttgataacgtggaagagagagaggagagaaaaaaaaagcatggttgctatacatgacaacaggtaagagtcaactcttaacttttattaaagaaaattttgttgtatgagggtggagaaaagaaaagaagggtagtaaaaaaatattttggtacgttaatgattaagagttcttgttgtctcaactattgtaacagtatattctttaaataatatgtcttacttaaaagaccatatcggacactatttttgtacatgccctagtgaggtaaaagtgatgtaccgttctgttggagtaaagacccgctggaatggtactcctggccaggtcagccggtgtgaggccgtcgttgttggcaagatccaagcaaaccctgcgattccgaaacaagcaccagaacactctcagcaccccggccacgaccgccaggtgcagcgcggtgttgccgtcgtcgtcccgcgcgttgaggatcgccgccgccggaaaccccgtccatcgacgtcggaggcgaatcccacgacctcctgcctcctccggtcgacggcgacgtggaggaaggtcctcccgcgggcgtcgcggaggccggcgcactcggggcacttgtcgagcaagagggcgacgagcctcaggttgccggcggacgcggcgacgtggatggggtagtcgccgtcgccgtccggctggcaggccaaggacgggtcggtctccaggagaagttcggttggtgtccggcggcattggaacgggcacggcaagaggagccaccggaggagtgagctgttctcgatgtcgatctttggtccgtccgccgaggcggcgaagtggagcgctgtgctgccggacgcgtcggcttcgccggagagcccggcgttccattgcattatcttttctgtcatttcttcaatttatggagaaaagcgtgagaaaaactattactccctccgtcccaaaataagtgcagttttatactattcacattcaatgtttgatcgttcgtcttatttcaaaattttttatgattagtatttttattgctattagatgataaaatatgaatagtactttatatgtgactaaatatttttaatttttcataaattttttaaataagacgaacggtcaaacgttagacacgaatatccatggctgcacttattttgggacggatgtagtattaaggtactactgctaccgtgctctctatgagatgatatgatgttaaaattaattacaggagcagttaatttactactagtctctaacccgtacattgcacaagttacgtttggatatttctttaagtgggaaatctaaatggagagcattcttgattttgtcttatggcacgacgctccgccagccatccatccgcgtcttcatgttgtcggagagataggcttgcttccattgcaatggcatcaaagcgaggaaccttcgtggcgtcaggtatcgctatacaccaccaaccatcgaaactaaatattggttacacgagtctattctttttctaatgatgacttatatattttaaatcatatattattttcatttttgtttgtaccatcgtgctctactcaaaatatacgataaaacaaatttaatatttaatatattcaaacatttaaagtaatttacttaatttcaaaagtaatttagtaaaatcgtagaagtaacttagctctgcaatagaggtaactatctaagcattgaaagttgttatattgatcaatcaattgatgttgactgagacacggacacgtaaatattatattgacgaagagtcaaagaaatgagaccacttgacaggaaaagaggacaacatactatctgctagttatcatgtcgattcacgtgcatgctactgaggctaacatgtcattacactagtataatgtttttttatagaatctttgatgacctatatatttttagaccttatattacttttaagatccattttgctcaaaatatgtgataaaatgagtctaatattgagtatatttaaattatttatttattttcttaactcctttagaagtgtgttacttccaataatgtgcactatgtagtcgtgtccttttcaaatgtattgctagattttaagctcttgaaaatacaaatttccagtcacctaaaattcaagccctctacaaatcgagcgtctgatttcctaaaaaaaaaaaatcagacggtctaacgtttcaattgaccgatgactgaaatgttgagtagtacatggtgaaacatttaagaatttgtgaagcatagtaagaacacatgttgaaataggtcgctattacgtatgaaacaatgtgttttattggtttgaaacatattttttattaaaatataatcatgcgatatcttgttataaagatttaattataatgaatattatattatgtttggattatatattggataagtaatttagttgaaaaatatttcaaagattgctacaagcctatatgcatgaatggaatgaagagagagcaagtatatggtagaagagagagtaggggtagttatgtccgatactttaccagccacatctgaaacgtcatgctatacaaggtgaaaaaaaagacattgaaatatttatttttcatgtgtaatacattaaaaatatatgttgaaacatgtcgcattacgtatgaaacatttagtattaacggttataaacatatgattatattttagcaaaataatcatgtgatctcttattataaaaaaaattaattgtaacaaatataatagtacgatcggatcgaaaatccgataagtaatttaggaggaaaaaaattttgaagatagccacatgtatacatatatggataaagtggtgaaaaagcaaagtagtatactaatatggcagccatatagtagcttagttgcgcccgattttctttcctccaatcgggttaccgataggaatcattctcatctaaaattgcatatactcttaagcctaaaattatggtggcacgtgcggaacattatttctttttaactatagttttattgttatattttttttcctattttcttgtctaagtttgaatgttttttttaaaaaattgtatttttttgaaattgtaagttcatgtaatgcaattttgtaatttttggagtatgccttgtttaagtaagtaatagtggagtgatgagaagaattacatcgaaaactcactttgattattcgaaagagtgtaggtcaattttttatgctacaaggcaagaccacctatctaaatataaggctaaagccaaattatttttcgtcatttattgatctcttcgacggaagagggtgtcctaaggcgcactaacgtgtgctttgccctgtcataccagaacttctgaatcacttaccaagacttctggtattcctgtagtggcacgtcattaggtatcgttgagggttgcaaacgtagtgctagatgtgttttgggatggacacatttttatgtcaacaatagggaaacacatggagtcatggttgtataatttgacttatcatggagccgaccacctatattagaacgcctatagaaatacaatatttatagaaactgttgtcttaacttggctgcacgtaaaacaggggcctgcatatgagccccccccccccccccccaaccaaaagtatagaagcagattttataatgcactatatcaagtaaaatgagagagtgtcttctaaaatcgttttatatagtgtaaatcatgttaatcacacttcacacgtgcacatacgtttttaatatgactttagtgaagccaagaggcacgccaaagtcaacctcttggcttgagcttatgccaagaggtgcatttgtcgatgtgcttctgtttctttgatcgtgcctcatcagagtgtatttgtcgatgtatacgtgtgggtctttcatatgatctaaattgatcgtgcggagaaaatgttttcatccctaaatagttataaaaaacaataagatagccaagtatgaaatatattactttacaaatatgtaaataaaaaaatcaacttttgaaaattataaagaaacaaatataaccaggaatgtgtgttaactatttaagttgaatttgtttcttttggtattagttgtaagagtccaatttgatattacgagtgacatagttcatatcaatctatgttaatatatgctgttaatttttttaagaaaaataataactatttagatgatatataagaaatatatcccatcgagaaatgaaaaaaaaatcaatcttcacttgtaggcacgtacctgcgccgcgtaggacagcagcgtgcagggcagtttggccggccggtccagaatacgagagctcgtcgcccccttgctgatgcaggagctccgcgatgcggtcgtgccccagtgagatcgcctggtacaacggcgacatcccgtcgccgccggggagacgggcgagccgcggatgcacggccatcaggtggccgacgaggcgctcgtcgccgagcctgacggcgtcgtgcagggccgtctcacgccggccgttctgcttctccagcacgtcggccaccctgaacctcgcgccgccgcgctcctcgtcctcctccatcgccatgtcgaggaggcacctgaccatcgccgcgttccccgccctggcggcgcagtgcagcggcgtgtcgcccctcgcgttggcgcgatccaggagggccatggcgctgcggtagatggtgcgcgcgcagctcaggaacgcttcgctgtcgccggaggccgccacgacgtgcagcgcggagtctccctgcggcgtcgtcgccacgtccaggagcagcgccgccgcggtgggtggctgtggctccccggccgcggcgacgtggacggtgacgtggtttggcgccggagcggcccccagaagtacagcctccagccactcgcggtggccgccgcgtgcggctctgagcagcctgcgatccatcgatacggggtctgaatcaaatgatgattaggatagaacattatattgcagagtggctgtgatctagacccgtttggtatgttgcgattacttataattaacatgtcagagatacttagtcagatgctttaaacaacatacgagacttgctggaagcggctagcactagcacacggtcatgcgtgcaaaaaccatggacgtacgaaccagcggatcagatcaccttgtcttgcattgcatcccgtgtgccgggtgtgaccggccggtggcagagccagcatcgccatcaagtctgtgtgactgtgtgtgtacgactataaccttcttctcttttagatatattaacatgttatttatagtaataagtttgaatttataatgataattacaatgtaaataagtgtgtgtacgacatcattaatttcacaagaagtgtagctataaagtgctatatatctaagccgtaatatatggtaatgatattatacttcaaatttatttatttatgtttttttgtaaaatcataggaccctaaaccctgcacatacatttaaattaggggaacgaaagatctaaatgaggattatgctgaaagagacttggaaatgggcatgagcctaaattaaccaaacaactcgtatgaggagcaaataaaaaattaaggcgtgactcaaggagagatggtacactgaaaagaaattttttgatgcaaacaaaaggtaaattagaaagcttaaggtattgcgttcttcattgatggaaatattacagatttcatggatgccaaactcaataagttttgtattttgatcgtgatgcgaagccaggaaagaactcaagaacgttcagctgataatgcaaagttcttctgttgaacactgccactactacagatttgattttttcgtacgatcaaaatagattttctcatacggagatcccacccgtttatattcagatgtttgcgaaaatcaacatttgcccctcggaggggtgagggggaaccgcaacgcggcaaagccacggtctccacaacgcggccacggcgttctcccgcatgccgcacgccctcaagttgtcagagagctattaggccatttacaatgcaaagacgtggagttcagcctccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaaatagaggttttgtgagcattgtgcaggtaaacaaatatcctaaaattacataaatagtaacaaataatcacaattatattttacaagtataaaagactacttacaaagtattccttcaaccaagaaacaatttggtcaggctcaacgtgtgccttcaaaaatttcttggactcaccatcctggatgatgatgagtggtacctgatcctccctcagcccaaagtactgtacagtgacagatttaaagttagcatcaagtacattaataattgtttgaaaaaaattataagaaagtgaggtaacaaacctggaaggcaccttgactggcctcaatgtcaccaatgaggaacttaatttccttgtccttgaactcctcagcagcaccataataaactgacttgaaagactcaaacggtccagtggagaagttcaaaaatagcatagcctgcataaaatttggtacagtttagtgtcagtcatcaacaactgcaaattactggcctaatgatatacggagtattaaagaacaatatttgaatccctgcgtttaatagtgagacctgccaaatatataaatggagaagggtatcagatattacagtctaagcaaagtctatttgaaacacgagaaataaacatttaaattgactattaatatacagtatcaatcaactactgccagctgttattaaaagaatggagcttttcagagagcaaggaatgccaagcgcttaccttggcagctgagctttggaaaaatttcagaaggtaaggatggttgtcagggttcttgtcaaaagtaacaactttaggggtgctgctagcatcaatgaacttctccaaagcagtaacatcaaaatcctgaagagatatgcaaacaacacattattgacaattaaccaaaataatgccagccaataaaggctgtgacaagttgtaggaaacatagtggccaaatgaatagttaaaacaatgaagtttgatatttgaggagttatataccttgctgtcaacaacaagctcatcaaagggcttgaatagcctaaccaatggtctctcaactgcagcatcaccgcgtggaaggtggttggcatgcaaggtgtggccaaagtcataatcagatctcagcttctcagcaacctctatgaagtttgtatactcagtgccacttaattctgagaagattccaacctatttcaattgctcattcaagtcagcagtcaattttaaagcatgaacagtcggaacagaaaatataagttggagaatgtgtcatattgaatcgaggtcttacaatgtagattttcttgtcatcaataaggttggttgcgtcttctggtgacttgatctccttggaagcaggaccaacctgcttcttcaagtattcaacaatgccctcagcctccctcgggcccttgtattcctgaatgttcttgccctggttcctgaatatcttgagtgtcgggaaaccctggatctcatacttggtagcaagaggcttgttcttctcgtcgttggcatcaaccttggcaagaacaatcggtggatcgtgcttgcttagctcttgtgcagctttctcatactgaaacagatcaagcaaagaaaattaatacatgggatcaaaccatttaatccaaaatgtgaaaatgtgctgttaaggaagtgatccaactgtacagaagcatacctctggagcgagcttcttgcagtgtccacacctgcgaatagggtttatccaattagacacatttagaacaagcattggttaaattttgattcagataacacaatagcacgatgcacaagcataatttcataaagaatcaacattgaagtacaaaaacaaaataatagtgaataattgaaccaagactacaaagctatctggatttaaaacctgtgtaagtgaaagaacacccgaaattctcagttgcaaccctgatacagacaccttataactcgaaaaaccaagtaaccaactcactcaatctaaaccactgaaatctgactaggagaccaggcatacacatcacaaacaaggtaaatctactacaatttacagaatcggctcatccgcagtcacaggtccacgcacaatcgaatcggcgaatcctatccgaatctaagactggatcaccaagatcgagaccaacaaacgcatcaattcggcaaacaccgagcctcacacgcatcgccagcttccccaattcccgcatctgaactgaagtcctaaaccctccccaaacctcgcgatctaaatcccccccccccccaaaaacccacctcgcgagatctaacccaacacgcacagctcatcaacaggggggccgtagcagagcagagcagagcacactcaccacggggcgtagaactcgacgaccatgaacgggtgcttggcgacggcctcatcgaagccgtccgcgtcaagcgtcagcacggcctccgccgccgcatcgcccccctcctccgcagccgccgcctcctccgccctcgccgccggcgccgacagcaccacggcgagcgcgagcagcagcgagatccaagccttcgagatcgccatgaggaggagacggagagtgtgggtggctttcggaatttttccctgagacgacacgcttctcacacgggttttaatagggcggagtacgcgaggggggggtttaccggatcacgtggaccaagtccacatcgaccctgaaactgcccaccgggccccaccccgcggactccctcgtggacgcggcgcaccggagtcacgagatatttacaggtaacatttgcgatgaaccccctgtacttatcatcgtcaaatcatccctccacgaggctgagatgtgctaaaactagaggtaataaattactaatatgcccctgatgaggagtgatgtgtaattaagtggaattaggggggcgaaagtggggtggtcccgagggataaatccaatcctgtgacttcaaaaaaggcaggggaattaacgacggccaacgccacgtcaccgcgcgccccgactacgtacacgtacctgtacagccctcggccaatgggagggcgccacgtcagctctatgacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctacaggaggatggcgcccctcccggtcgtgggaccatggagagagaagaaggaggtactgaaccccagcttgtcctaggtcgcatggttgcgatcgaggactacattctctgcggttttctccctccgccttctgaatttcttctcttggttttgaacttctacggtctttctttgctccatttgaaccccaattctattgccttccttagtatttttttgcatctttgtgaggcctacattggggtagagccttttcttgatctctttcgcttctactacgagttgcgttggatgtagtccaacagggtatctggatgcgtcggattccgactccgggatggcctgaagtcgcgttatatccccttccagtgcccttcctctcatagcaaatggcggacgaggtggttctatcttcagatagaaaattcggatcctgtctttgttgttcctgaggaacaaccagacaagatttcgtcttggaccgcaaagcccaccttgaccccttcccttcagtccttcatcgatgttatcgacgatctccgagtacgaggtttgtcggggtatgaagtcgctgctgacttcgttggtagacggatccagtcgctccaggctcgagcccatctagcctttgactattctggaccggaggacacgacccaggtttctcctcggggtatctttcttgcatttaccctgacttgcttgtgtgcgcgttcctcctgacttatcgaactttggttctcgattcacaggtctgagcagcgaagccgtgggacgtcgtgtcggccaggtgatgatcagtggcccaacgatggcgagcaatgtccccgttctcctttgcgagaagggggcggccgaacgcgacgctgccatcaatgtaagtgtactcagtaggccttctgtgtttttcttccgggatcgccttatgacttcataaagcgtaggctctccctctgactgatatcatcgggccgctcatggaccatcaggtggcggtgtcactaaaagagaaggtcgccaaggaggcgtccgatgctgctgctgtcgctgccacaacaagtggtggcgacgttccaaaaaaggggaggaaattctcctctgtaatcggacatcgtcgaaaggcacctaccccctcggtaagttctcctgtcatttgatcacgtagtcagaatacttccaccccacatcatatcgattgtactccaagccttggacgcgtctcccctgcctccacgacggcagcggcttgtgacactcggcgagaagtgagtgaatgaatttgaggtttcgtgatttcgtcgaactttgtctgaaccacagccttcttgtagggcggcgcgggcgaaggcggcgcaggacgggtctggagggacttccagcgcgtctcctgctgtagcctcgacggatgtcgtggtcgtgcccgggagccacgaggcgacaccaagcggcccagccagcgatctcgtggctggtcatggttcgccggctgccgtcctcacctgggaggagctccaggttgagatgtggcgcctcctcgaggctggtgctcgcggcattggccgcgagatcatggaggtgagagcggcggcggcgtcgtcgtcggcgaacgagcgcgccgaccggctggcacacgacttggcggaggctcgtgaggacctcaagaagatgaggaaactggtggccgggaatgagcgacaacggcaggggctcgagcaccgtatgtcggagctcgagaacaacttatcggaaatccgtggctcgttgcgggtcacctatactggtctgcaccagctcgccggggaatgcggtatcaagtctaccatccccgcgaatcccaatgagttctcgctgacgtcttctcttgcggagctggcggcggcgatggaggagattccctccaagcatgcggccaggatcggagaggagacgtccaacgggaactacaccggggcatgccacgtccttgcgtgtgtgaggctggcgcaccctgaactcgatctgcgggagatcttggaatagggggcggctagcgacgcgcataaggatgtgatggaagaagtcggtgatctgggggagtctgttctccccctttttgaagagtaggattttgactctcttgtactccttagacatgctgtataaaactccaattggctccaaccgcctttgtgcgtgcagtcatcaccttagtttgctttagcattttgatcttgagtactttttttgtcccttgtagagatgttgatgtcgaggatgtccagcagcgtgggcagcctgagtcgccagcgatcattccggctcttgcgtttgagccacacgcgtcgccggacgatgtagatcagattttacccgcgagaatggggatggcgatgacttccttaggttagtggtctcttcatccctttttgctcctccgacttgatcaaccgtgttctcgaaagaggagtgcagcttgacttagtcgtttccatattgaacagatctcgagagtgcgcttgctggccaagatcgtcgtatccaatattggaagatgaaatttgaagtagcggagctcgagagaactatgctggaagtaaagaaagagcaagctgtggaaacgctctgaggttgtgaggtatggttcaacttgtacttgaagagttgctgcacgtccatggccaaggtttgtagagagctccgagtaccccgtggagatcctgaggagtcggcggccggatacatctcgtggctgaatggggcctgtactcagctcgaaggcgtcggcaaacgcattgacgaagccttgaagcaggaatgtcgtcgatcgagccgatatgccggagggcacgtgttggcttgcctacgagatcatcgtccgcgacaggacctcgagtttctccatgaaggttttgctcgttctcggagaactacggcggagatagaccacctggcaaagtcgatggcgccgttggcggagaaggtcttctagtctatggactggagttggccttcttggtagtctttgtaccctgtgatggatatcttagggaaaagtgtaatatagctttgaacttgtgtaaaattgtaaggggtattttgtgaaatagaaaagaaatctatcttaacaaatccttcttactctggatatcgtgtgtaagggtgtgttctcagttcacgactttagttagtcgtttgagtcgtacactctctctagcccccagccttgtcatcggaggatttttctcggaggataagcctcttggacctttgacctgccttggttgaataagcactgatcctagcccccagccgtgaagttggaaagtgaatttccgattacgcggcttggttaatacgcacggcgagaactcttacacgaccaggtcttacatggtctttcgtctctacaggatctgacaaggccttatcggctctgggcgtccccagtagaagatcccttaggttcatcggaggccttctcaagatgacgtaaagggacatggggataggtttcaacgctaggtgtcatcttgttaacaaccaaatttggtaacatcggcatcaggaaagaagattagatcgaagcaaagtcggaggcagagattgagttcggaaacaaagcaggaatcggctggagtccaaatcggatgcgattggcatcggctaggtctgagtcggactaggtaagccgatacagccgattccgacaatgcagcttgatgtatgatatcgggttggattgaggtgcttcaaggtgattgccgcacatggatagagtcctgagaagtcaattgtatctattaattagggtgttttatgtaatctccttagagatacgattgggcaaaagtctgccgcaaagacttgtggtatcctagagtttgataagatagtagtcgtgtctgttatggacatatcttgtgattctcgggtataaatagacccgagccctatgtaacttttaacacacacacacgttcaatacaatttcggcgcatcgccacccttttgctttagttttgtttcgatgagttcttgctttcaggttgagctgcatcggtttcgatcttcaacgagaggtaaaacttgttatgacggcttgtattctcgggattagtgcttccatctttatgacactctgatctcgtttatgtaattcatcgagttatcatatatcttacataatctccggcaataccgctatctaatctacaatcggctaacatctgtctgtagagggtagccgattaggttagatatcgatgttgacttagattatataaggtatccaccactctatgaaacttccagcgacttgattgtctagatattgttcttcttttcatacttaatgttgcatcagtcgagtttgatctattaagtcgtgcttagaatatcaatctctaacatgccttctggttgccaattagggtagcatcggagtttcagccgatcttatctgatctaactatatttgctctatatgcttcattgacatattaaatctgtcctttatgtcaagatattgctgtatctaagtatattagtcctttgtttaatatattatgtctgttttaatatcctgatatagagtagtattggagtattagccgatacatgctagatctatctgatcggctatgctataaacatatatagccctgttattaatatatatttcgatctaagtgatttatactgtctcggcatggcgaccgatctatcccaatcactcgatttaagtatatatcgatataagaactatatattggaaatatctacagccgatcgaatagatttagttctttattgtctatttacaactgccgatcgattcacatatgacatcggctcaaagataaatgttatgtcatcggcacctagccgatcggctatcatttatagatttaaccacggtttctttgcctttatttcttgttgattacgggatcaaatcaactggcacgctagtacacccgaaggcgagctttggacctacactggagttaagcagatctcccaggcctcgtgttttctgtcaacacatctgggtaagggatcatcgggtaggaacactttgattgtaatatgcgcctaaaaataggctccattgatactgtaaggtgtcttacaggtgtggatgacattgactcatacatagaatttacgtagttggtcaatattccaagagtttgccaactcgcgaccatcaccgtctgcaatttttaatgcgcctggccgcaaaacttgtgtgatcgtgtaaggtccttcccatttgggtgagagcttgtttcgccctacttggcattgaacccgtcggaggacatagtcgccgattgaaagtatgcgtgctcggatgcgctcctcgtggtagcggcggagagcctgttggtaactggctactcggacggcaactcgttcgcgatgttcctcgagtagattcacatcgacgtttcgctattcctcctgatcctcgtcggaatacttctgtactcgtgtactctgatgtcgtagctcgctggggagcatggcctcggagccgtacatgaggaagaagggtgtttccttgttagacgttgtcggtgtggtgcgtacggcccatagtactgatgggagttcttcgacccattttttgtcatgtgacatgaatctgtcgtagacgcgggtcttgatcccttgtagtactatgtcgtttgccctctcgacttgtccgttgctttgagggtgagagaccgaggcgaagcatatctagactcccagtccgatgcagtaatcatggaaatcggcgctgatgaactgggagccgttgtcagttatgatgcggtgcggtagtccgtatctgcaaaatatccccttgatgaatttgatggcgttgtcggccttgatttcccccgtgggtactgcttcgatccatttagtgaatttgtcgatcgccacgaataggaacctgtagccgccctgtcctcgtgggaatggcccgagtatatctagcccccagcacgagaacggccaagtaagagggatagtctagagcgcttgcgcgggtagctttgtgtgtttactgtggaattgacaggcttcacaccgctggaccatgtcgcatgcatctttgatggcggttggccagaaaaacccttgccgaaatgctttcccgaccaatgtccgaccagcggcgtgtgacccacagatgccttcatgtatatcaaggaggaggtgtctgccgtcgtcggacgagacgcatttgagaagtaccccgtttggcgctttcttgtatagatcgttgccaatcatgcagcagatttttgctttacgggttattttctcggcctctgcgtcgtcctcgggcaactcttcgctgttgatgaatttgatcagtggggtgcgccagtcgtctgtggtctcgatatcggcgacggcgtgttctgcctctgtggcctccgagctaatgttgggggcggctgggctgacttcgccgctaacctctttcactgatggctttgtcaggatgtccagaaaagtgccaggctcgagtggttctcgtctggacgcacatcatgctaggtcatctggctcgatgttgtccttgcagtatacgtgtcggacctcgatcccatcgaaccttttctccagcttcctgacttctgcgagatacttggataactcggggttagagcatttataatctttgtgcacctggttcgcgactagctcggagtcccctttcacgatcagtcgcttgaccccaagtgcggctgcagctcttatcccggcgagtagtccttcatattcggctgtgttattggtcgctctgaagttgaggtggattgcgtgcttgaattggtctccggaaggagatgtcaagatgaatcctgcccctgctccttggctgttgagtgcaccatcgaacgccattgtccacgtttcgttgtcgatttggttgtctgatttgttatcaggcatagtccaatcagctgcgaagtcggcgagtacctgggacttgatggctgttcgtggcacaaagtggacatcaaactggcttagctcgactacccatttcgcaatgcggccgacaacgtctttgtttctcacaacttcaccgagatggaaggaggagacaactgtgactctgtgggcttgaaagtagtggcgtagctttcttgatgtcatgattaccgcgtaaagcagcttttggatatgtggatatcttgtctttacgtcatggagagctttactaacgtagtagactggtcgttgtactttctctctctcgacaacaatgacggtgctaacggaatatggcgtggtggcaatatagaggaataattcttcattaggttggggagcaacaagtacagggggtttgataggtagcgcttgagtgcaacgaatgcctcttcggcttcttgtgtccatacaaatttgtcttgcttcttcagcagagcgaagaagggttgtcctcgttctcccatcctagcgacgaacctgcttagtgctaccatgcatccggttagcttttgtacttccttgagtcttgtgggcgacttcttgttctcgattgccttgatcttctcgggatttgcttctattcctctgccagagacgaggaaaccgagtagcttgcccgacggtactccgaacgtgcacttctctggattgagcatgaggcgatatcgtcggaggttgtcgaacgtttcccgcagatcgtcaatcaatgagtcgcttgtcttggtcttgacaacaatgtcgtcgacgtatgcctcgacattgttgccgagttggtcgctaagtgcgccctggaccgtgcgctagaaagtattccctgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtttcggcgtcttgtttgtcttgctcactttcttgggtggctcagttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgtcaccaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcga

SEQ ID NO: 64590 - DNA, 10328 bp, Oryza sativa
cccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggcatgaagcatgatgcgtgtgaaatggaagaaaaaggatttggtagcaattgctttcagaaagaattgttgcacagagttgatcttgcacatggtaagtcaatctttgcacggacgttgcttctatggaagaaccttgtgtgtacttcttacttggagaaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacacaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattgggagataaaacattgttgcatgattcacaggttctcaaaatgattaacggcatacaaacaacacgaagatctagagcttcaaatactacttcattgtagaatggaaaaaagaacagtactcgccctggacctgagttgaggatagaaattgttacaatcgaggatagaacagtactcgccctgcacctaaattgttacatgcttgtcggaggatgcctggtacatgcatctacgattttgacgagaagaaatgatatttagacatagtactatatcatcgtaattgatgtccttgttgcctgctccagttcttcaaactcagcgcctagcgcttcgcttcctgctcttctttcggctgcccttgtcatcagaatcactgtcagatgcagatgcagattcggagtcagattcagacgatgctgatgatgaggtttcccttctgtgcctcctcttctgctgcttccttttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaacaacatctacttatcaatttgtcatacgctcggtctgtgcctctgtggtcaatcattgctacgcccaaaaataaaaaaatggacaaacccttagagctaagagattctacagtaaaccgtggtaagaaagaaattgcgagctacaacccaaaagcaagcaaataaatccaacgaatacacctccccaggccgggcggatcttaacgtgggggcatggggattcactcgaacccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccctgacacaacctagcagaaaacacatacaaccatctcagttttgtcaagattttggaggtctattacctgcagcgagactgaattctacccgggaaactactttttttttattttatgaaacacgcgaaactactataaccataaaactgacagcttttcaaaggccatgttacagtttctccacactgaaaaaaacagtaaagttacaccaacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacagccaaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgttgttaccactaggaaggccgtgctgttgctcgaagtactgctgtctttggccataccttgctggaggtggcggtaaggaacctggagcttgcgcttcccatggagcttttggaagatcttcaccggagtctccatacttgttagcatttgaagacgaagaaaaaccagggatagctgttgggtttataaaatcatcatcaggtagactctcctgcctattgacagcaggacgatttgactcgctcataggacgagaaggcatagagaagctgggtgctgcagttgggtttatgaagtcatcagacacactttctgaccggctatcataacttggcggcggattcgtttctgtttttgaatgagacggcgcaggtatattggctggggcagttggattaataaagtcatctgatactttttctgtcttgtaggagtcgccactaagatagtcaacactgcttgcctccgtgaaaactggcctctttgatgatggtggcggaggaagaagtgggcttgggtaaggcctttcactttttggagcagaaggtagattgccctgtgctgctgtgccatcccttgcagacctacagaacatatatttgtacatcagatgacaaaactaaacagaccgtgaatcttggtatcataacatgatccgcatcaccaaaacattttcttaagagcagtcagctgatgttgccacaaccatccaaagcttagaatagcaatagcatgtatgagaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtagcggaggttccaactttagatcagagatggcgtacttcaagaaagcaattaatcactgaccacttttttcccccaaaatacttgacactccatagttgctaacaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgtctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgccgacagggagcttgaggagcttgcaagaggtagggcacgggagcgggcagagcggtgggcagcagcccacctccacggcggcggcggcggcccaagggaccgcgcgcccgccgacgggaacccagacgggcgcgggcgtgccggcggcagcccggagcccgcgcgcggccctcgcaggcagcgtggctctccctcccctgaccggcaccatggccaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcacgatcgcgcccacaagtcaacactgcaggcactccgcaaggagtgggagaacctggccttcaagcca

SEQ ID NO: 64591 - DNA, 10330 bp, Oryza sativa
agtctttgctggacctctccacgatgtcgatcgaggaggcgttaggtcgcctaaaggtcgtcgacggcgatgagccacagcctctctcggggcctatcaccattggcgggaagctccatctcactcgggagcagtgggaggccagccagagtaacgggaggaagggggagtcccctccctcgacaggcggccgcaagccgcgcaaggcgcgcggaggcgtccagctgcggtgggcgcgaagacgcgccgagggtggcgctcgcagaggtgcccagggcgacgccgctggcaaccacaagccggcacgagacgacgcctgccgcaactgtggcaagcttggccattgggccaaagactgtcgacagccacgacgcggccaggcccacgtcgcacaggtggaggaaaagccggctctgctcctagcacacgccagcatcgagctatcttcagcggcaccggccgcaacggctttcctccacctcgaggagccgaaggtacacgccttcctcggcaacagctccagcaacgacaaggctgatgggtggtacctcgacaccggcgccacccatcatatgactggccggcgggagttcttcaccgagcttgactccagcgtccgaggctccgtcaagtttggggatgcctccggcgtggagatcaagggcgtcggctccgtcaccttcaccaccaagtccggtgagcacaggctgctcaccggagtctactacatccccgcgttgagaaactctatcatcagcgtgggacagctggatgagaacggctcaagcgtgttggtcgagcacggagtcatgaggatttgggatcgccgccgtcgccttcttgccaaggtaaccagaggcactaatcgactctacatcctcagcgcgcaggtcgcacaaccagtttgcctcgccgctcgtcgagacggcgaggcgtggcagtggcacgagcgtttcgggcaccttcactttgaggccctgaagcggctcagcgccaaggagatggtgcgaggcctgccgtgccttgaccacgtggagcagctctgcgacgtctgcgtcctaacgaagcagaggcggctcccctttccccagcagacgagtttccgagccaaggagcggctcgagctcatgcacggggacttgtgtggcccagtgacaccggccacaccaggaggacgacgttacttcctgctgctcgtcgacgacctctcccgctacatgtgggtgatggtcctcggcagcaagggagaggctgcggacaccatccggcgcgcgcaggctgctgcagaggcggagtgcggccgcaagctacgcgtactgcgcaccgacaacggcggcgaattcacggcggctgaattcgcgtcgtactgcgctgatgagggcattcagcgccactacaccgcgccgtacagcccgcagcagaacggcgtcgtcgagcggcgcaaccagacggttgtggggatggctcgggctctcctcaagcagagggggatgccggccatcttctggggagaggcggtggtgacggccgtctacatcctcaaccgctcgcctaccaaggccctcgatggcaggacaccgtacgaggcttggcatgggcgcaagccaggggtctcccacctgcgggtcttcggctgcctcgcgttcgtcaaggagcttggccccatcagcaagctcgatgacaggagcaccccaggggtgttcatcggctacgcggagggctcgaaggcctatcgcatcctcgacccggagacacagcgtgtgcgcacagcgcacgacgtagtgttcgactaagggcgagggtgggtatgggacaagacggtggacgatggttcgactctgacgtacgacgacttcaccgtcgagtatgtccacttcgagagagctgggggagtaggcagctcttcttcaccaagcgtgtctaccccagtccccgagcctccatcgactccgacaccaacacaccctcgggccacggcttcgactgcgacgagctcttcgccgacaccaccacagccggcaaccccacgcgccccagcaccaacagccactcctccgagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggtgaccagcccgtgccaggaatggtgcctcgcgacctggaggcgcagttgcaccttgcgtgcgacgacggtgagcctcggtctttcgcagaggccgagaaacacgcggcatggcgtgccgcgatgcagtcggagatggacgcggttcaggagaaccgcacctgggagcttgttgatctccctcgtggtcaccgcgcgatcacccttaagtgggtgttcaagttgaagagggataaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctgaacggcgacttgaaggaggaggtctacgtgtaccagccgccgggattcgtgatccccggcaaggagggaaggtgctacgcctgcacaaggcactctatggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactttcccacaagacgacgcacaagacttagggggagaatgtaggaataagtcttggctggttggtcttggtcttgtggtgccttttcctgcttttcagctttctaggacagcatctctactttcagtttgaatgctctaggacagttaggacagcagtttgttgagatgctctaggacagtttgttgggatgctctgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtaaccattgaagttctaacaggaactaggaaagcaatagttggccactgaatgtgagtataatcctcacctttttctttactatcttaaccatttcacttaatatgtctcgctcaatgatttgctggtaaacaacatccccacagtttttgcttagagtctctagcacctgaaaaggaagacaaacaaacagaacaaatcagcacattaaacaagacatgactgtgcacatagaaactatgctctttgtttcctaaatctggaggaagcacaagaagtttccaaaatctggaagaagaacaagaaataacttctaaatttgtgtagctagtgaagacaggtgaattcttaaatttaggaatgaatcgacctaaaactcacattgttaaaacaaaaaaatcagaagataacacactgagtatcaatatacaaggactcttgaaatactcacataaagcgtcagaatttgcacttttgaattcttgtttcccaggcgtttctttaggagcttgagtgtatccttggcttgtctgtacttcagcaaacatttatgagcatgctataaaacatgacaaaccaaaagttgtatggggacattgaaaataaatcccagaaagtatttaagacgaaacaattatgtcaacaattcaatatacaaaactcattatgcaatgtgcatcactcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctcctcttgattacacaatggatattgccaagatggtcaacactgcgatgggccaatcggtcagcagtccaacaacgatttagcgaggctaaccacacaaaagaattgcaaagaggccaaagctcaagttttccaaacttccttccacggctcaaattacatgcccctgatgagtttttttttttgtgtgtgtgctctcattgctgatatcatcatggcaaaaagtgatgtcatacctaaactgcacctcaacaacaaatgacaccaactcatcaccaaaatcagtggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatatagcaatagacacagaacaaactagccaaaatcacagattcaatgccttatagaagcagcactaaaaccctgctaaatttaacgattttataaacaagcctaggttaaacgagatacaacaagcaagcaagatcacaacacataaaatgtcagagatgccacgataaccctactaaatcactcacgggttgaacaacatagagaactacctaggaattctccatcctaccatatgatagcaataacaattacaaacaaatcaaagaacctaaacaaaaagtctcgaacagaggcatcatcgagagagagaagccagacccgggatccatgttgatgatgtcgcagagctcgatgttcaccgcccaatccggcccgatcagcatgtcgctcgtcgccctctccgcgcacgccacggccgtcgccattttccccctctcaccaccaaaaaccctaaatcctgcaaacaacaacaaaaacaaaccacccaaatcagcccccaaattcccacctttccgcacctccccaacgcccccaacccgaatccgccccccaaaaacacatcttccaccccgcaagaacccgagcccctcaccgaatctgagcgacctcctccccaagattcggcgccaagaagcaccaaggcggcctcttttcaccgatccggaggtcctggccgcgcctgggacggggaggagagggagagatgcgagcgaactgtaggattggaggaatttcggtggctcggcttggaggaggagatgaggaggaaggagaaaggttggagaggagggtggtagactagactaggcaggcagcaggaaagaaggaaggaggaagagaagggaacgcggccgtagactttttctttgtttagttttcttggtgtgaaagtgagggcctgcaaaattatattttgtggtgctagtttggaattgtgagaaaagtgggatatcaaagtactccattcgtcctatattagattgtgagtttttacttgtaatgtttaactactcgtcttattcaaaaaaattttaaaattatttttattttatttgtgacttactttattatctacggtactttaagcataattttttgtcttttatatttgcaaaaaaaaattaaataagacaagtggtcaaacgttgcaagtaaaaactcaaaattccttatatagtgggacggagtaatactgtcatctagcagccccatcatttggaataagccaaacgacattttaacgaataaaacatgatttataaataaacttttatatatatgtgttcttaacaatttaaaagcaatggctgaaaaataaacttagatgaaaaaacctcaaaccaattataaattcaaggttgaaaatttgaattttagctactaagtattagtataagcgaaaaaatgagactatgatgactgatgaggataggatcgatttttctttatattagatcttgaattttttttacatgggtaaattatgtattttggaaaatatatagttatgttgtgaacttctttgatgtcatgaaaaatatctttttttagaaactctcaacggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaccgtgaccattcgtctttctcatttaaaaagtataactgaaaaagcagaggaacaataatcggcaggaatgcaagtacaaaaataaaagattatagaacacagtaaatacaaaaaatgatagtttgattagaccgcgagaaaaacacaacaatcggataagagacgtaagctcaaaggaaatttttcaacaagtttgagttcttactaattttttttcaaaatttctttaggattatctattttataggaatttcaaagaaaatgatgggcttcctaagaattattttccgatcctctataaagtgccctgtactaaattaagtgatcgaactccacaagaattattcaatgaaaaccaatcttcatcttcaattcagtagacgaccacccactataaaacgccatattcgttgggcaagaagtttgtccatttgacgatcaaccacacggacccacccttgatgcagaaacaagcaaagctttgctcatcttggccgttccaggccaaaattgctttctgtttgccacccaacttcctttgggttaagcaagactaggttggattagatatgacttttaaacataatcctcatatcagcacaaaggtaatgttggttcttggatctccttaattaatcacctgcaaagctagtttttttttctttttatagcaagaaagagaggcctaatcatggtagtgggtttcactatctgcatgtaggtgcaagcaacagtagagctggctagcatttttttccttgtttgttatgtctaatagtttaagccaaaatggttttggctattataaaccatcaaaaataataattataaacttcgctaggcgtccacatgtacaactagaattatttttgtattggtccatgtgtgtcaacgatttgtaagagaaaagatataatgacttttaattagttttgtttttgtcacaaagaacctctcgatccatcatgtattttgtcttgtctccttaatgtaagaagaaattcaacatgccacaagcctgaaatcaacgtagaattgctaatgcatatgccataggagtataggactaatagattaaaaaaatctactgatataaattgggcaacatttttttagataatataggtagcaattacaagtttcaaactgcagatccttaaccggttttcctactctggtcgcatggatgtagtgtactgctccctccgtcggattttgactttttgcttgcactgtttaaccactcgtcttattcaaaaaatttgtgcaaatataaaaaacgaaaagttgtgttcaaaatactctagataataaagtaagtcacaaataaaataaataacaatttcaatttttttgaataagatgaatggtcaaacagtgcaatcaaaaagtcaaaatcacttatattatgggacagagggagtactagatttgtactacttcagatttcctaggctgagtttagttccttccaaagttgaaagtttgggttgaaattggtacgatgtgactgaaaagttatgtgtgtatgacaggttgacgtgatagaaaaagttggaagtttgaatccaaagtttgactgtttggtagctagccagtcagccagacacggttttgttgagtcctcaatcttcatgcattccaccatgatttgatagccgaacgattaatggcgaaaactgataaaattcaaacggaatgtatcaaatatttggattttttaatacatgaaaatttatcaagtggttcttaaatatagattggctcgataagatcaaccatgacagtcaagcagtttttgttgtattatgaaatcctattcatctctcatgctttcaaatctatatgattatttccctagcaaaacaaatagatccgtcctaaaaaggaattattcccatttaatttgaaaatgattctgcatgagttctgtaaagaattttgtatcgaccaattcaataatttgaagaacagagtcacaaagaattttcctgtattctactctgggccttgcatgcatcacagtgttagaaatggctttaagcttttgcatcctgggcctccaaaattagttggtttaaaagcaaacccacgtacctaattaaaattgggccgcccttgttcacactgcacacttcatgctgccgactacaattagg

SEQ ID NO: 64592 - DNA, 5089 bp, Oryza sativa
  unsure (1)..(5089): unsure at all n locations
acaaacagtaggattttcaaaaaggttaacttctagaacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaacacaatctaacagaatcaagaagagcataattttttccccaaactacaactaaataagttccatcaacctaagttagcaaactctgttctccaacttttttaaaaacaaacagattttgaaataagacaccattcctaaaacccaaccaaactcccattcgagaataataaaaaagagatatgcaaaaaaaaaaagatccaatgaaactaaactttacatctagaaactgaaataatgcacaattagcaagtctaaaataatttacctgctcctgctcctggttgtttgagccttcgggttgccgccgccatggccatttccgatgctgctgctgctgctgcttccatggccgccgctgctagtgctgttggtgctgctcgtcctgctgctggtgccggcctcgctgaactcgccgcccttgctccaccactcctcctcctgcagctgcgcctcctgcttcttcttcttcttccccttcgtcttgttcttcttgccgccggcggcggcggcggcngncngnttgngcgacaccttcttcttcccgccgccngccgccgcggngagcgnggggcngagcttggtgcgcnggccggtgtcgaggctcacgctgcggtccatgctccggctcagcgtccgccctatcgtcctatgcttcctcgccgtcttggcggtggtgcatttcccctgcttcttgctggcttcctcgcccatggcgcccgccgcctccgcggtgatcgtggcttcgacggtgggaggtgctggggtggggggaggaggagggagaggatgcggcggcggaggaggaggggactcgacgatgtcgcggagggagagctcgtagcaggactcggggaggccgcggacgaggtcgagcatctcgctcggtacccggcgatcgcctgcgccctcgacggcgagctccccgccgacgccgggtatagccgctggagctgctgctgctgctgctgcccccagaactccggcgacggcgtgccggactccggcgagccgacccgcgacgcctgcagccaccgcgactcctcctccccttccctcgccgccatcgggttccccagcgggctccgcatcctaaccctctcgaactcccctcctcccccacccaccgccgacgccgacgacccctggaagctgaactccagccgccgctgccccgacggcggcatcggcatcatcccgacgccgagagagagagagagaggttggaagagagatggagagggagaggaaggtgtaataatggcgatgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctctagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatccccaagccgactcccggtccatcaccgcaaatactctcccgagacatcgagtcacctacacatgaaataaataaagaaaccatattccgagaccaagctatctccaacttgactcattagtagcaaacaacagtattacatacgtatagtatccatctagaagccataatcatgaaataatcacggatatccaaacaaacaacccgaaagcgaaactgacacagtgtcggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtattagactaattttcagtcgaatatttaatgagttaaatctttataaatctgtgacagagagagtagcactcgtacctatctcagattaagcaagacatcaacta

SEQ ID NO: 64593 - DNA, 2091 bp, Oryza sativa
  unsure (1)..(2091): unsure at all n locations
attttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacctgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctctagccaagctgcctcttatctcccagcgcttgacgaggttagagcttagtaatgtgccattattatgtggttttgttgattctttgagcttcccagcatggaggccctatggatgaagttctgctatatagacggtgagaagatatcgtctcagtcacttaaagagctgaccatgattgactgtatattttttcgccaatttcggatttctgctccaagtttggtgaggttggaaataactgattgtgtgggtaaagctcctgtgctggaaataatgccatctctagtaaaggcatttatcaggttccgagactctagagatatttgtggtaaagaagaatttgggggtagttgtactaatgctagctgtgataattgtggtgctaatggtgttgacagtggagattgtgtgcttctgaagggtatttcaatggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64594 - DNA, 1161 bp, Oryza sativa
acaactgaacaagctgctactgaaaattagttagacatttggataaaataaagagccacaccttttggagaacccgaactttaccgcatgcaagtgattgcagcgttcttcgcaattctttatcctcaataccagtcgattccttgatatcgaggaagcttagtttttgtgcatcattgaacaacatcaaaaccacactctgaaaaacagaataaatcagtgattttctaattattgatcagacagttacagctacaataaaccaccaaagaaattgggaaaaataaccctacctgaaatagtgacaccgcaagttcctttttaccttttgggaactctgcttttaatacacagtgacccaatgagttttgccacatcaaacgccttccactatacttgctcaaatagaattctttaaatatatcctatcagaaaaatagaaaactaaattaatttccaggcagttaatataaatatttactgccaacaaacatagttttgagaacatggcctgacctgatagacattaagttcatgggggagtttcacatccattggtggatatgttggccaatagctgcaatgcaacatatttaatcggaaatgcacatttatgatagaaaatatcaagttgcatgttaacatgctcagcaaacgcctattataaagttatataatccattgcccatattccagctacatgtcatggactaagaagcctatctatcagtattaggtttagacaagtgttgtgtaaacagaacatgctactcagtaaaccagcacacatgtaaaaatggcaaggcacatgttacctaccctgttgtaagcacgtgaacactcatttcaatgccagatggaagctttgtccttgcttgagatgattgcttgaaagactcatttatttctttggataattcaatgtcctgagaacagcaccaaagtcattttattttacaagagtattaaatccaaataaaagaaattgatgatatcgtgtacgccaccaatggatagaggcatagagcatatataagttagcaacatttgagctaaatatacatagggcaagagttcgcaaaaaggctagtatactagcaaaagtcatttcttctatagcaaattgctaccttgaacattccctccagcttgttggtaaat

SEQ ID NO: 64595 - DNA, 1102 bp, Oryza sativa
tccatcgtaccctttgtaacctgtgttttccatcatataatctcatatcaactggattagggctattacctatcaaggggcctgaaccagtataatcctcgttctctgtttgcttgatgtcgtattacatagatccttgtaccaacgtaccccaataccctctatatccggtctacgggtatcactcgtcgacagtggcgcgccaggtagggggacttggtgctcaaggttctactactatgtcatccagtttcgttgacaacggcgtcaacaccaacctccaccagggatttcctacttcaacaatgctggtgtggactcaagtcggcgaaatcgtcttcccggtttataccacgatgccgatctcagctggtccatcaatgaccggaaatgagaacgcagtggatacaacccaggacgactccctgtcgaaggatcctcccgccgaagcggagaacagaacattgacgacatccgagctcgagaaggattctaatgcggccaaaccttgtcgttcagacaagagccacgagccgacgagaataacttccgaagcgacaaggtcctggtgtcctatccacaaaaccaggaaacacactttgcacgcctgttgggtttttctcaacgtccgcgccgaaattcgcgcctgcaaagagcgtggaattcagcgtatttctccaacctgtgatgtctattgtcctattcacaagacaaagaatcacgacctctcaagctgcaaggtctttctcagcgccacgatgacgtcatcccctaaggtccagcagttaggcatatcccttagagatgaagacaaggaacaaggaacgacgctggtttcagatcgattcgttggcataatcgacatcagttcacccgaaccatcagtcctgcatctactcgaggactatggctcatcaaagcgagtacgccgcgcgaggtattagctatcgacgggaccagcacgtcagcacacgctaatgcggaagcacaaaatcaagtggctacaccggcctagcacatcaggaccatcaacgcaatactgagggagaccccttacgatcccgttctaaacgatgatctcgcacagtggacagaacagcta

SEQ ID NO: 64596 - DNA, 2425 bp, Oryza sativa
gcgtggtggtagcacacttcctcaatgaactaagggcgtaaggtaaaaccgtcgacagtaatatagcaaaattccgtttgtgaaatttagttttcccaatcccttctttctataaagtggccaaaagctcaaacctcgtgcttccacatcatcatcaaattgtgaatcgtttgatgaatacattagatcacttcttagacgttggatggaatgcagcatagagcccaacccattagtcaccgggtgagtctcttcgcctcatcagtgccaaatatagctcacatgaacacattggctcatttctatacacatctacatgtatccagcctgtcaatccgtataaaagagctttatggctgaacgccccttcagttgacatgtgctacttaaatatctacaaattttggatagggctgctaaaaagaatttctccaaaaaaaactatttgttttttcatgagatggtaactcctatctaataaattgatgttaactaagtccgcagcaatgcgcggagcatcctctagtatataagaatatactaagcgggccaggagtgtacaagaatactcctgggccaattcttgggccgacattctcaccaaagtggaccgtttggattatttggcccggccgctctccgacaattctttccccaattattccattctctctcctccatcttccggttgcctcgctatcctctccacctctcccaccaccacccaagcagccaaggcggaggaggggagccggccggcgacgcgcgcgccaccatcccagcgacgatgccgcagctgagcctgaccaccaacgtgcccgtcgacgccgtcgtcgccgccgacatcatcaaggactgctccaaggcgctcgccaggatcatcggcaagcccgaatccgtacgcgccccccacctgctcggcggaatgccgcggccgttctctgctctgctcctcctgccttccttctgctgatgccgcggcctccgtggctttttccttgtatggccccgcagtacgtcatggtgtcgatcagcgggtcggtgcccatgtcgttcgccgccagcgaggagccggcggcctacggcgagctcatgtccattggcggcatcggccccggcgtcaacggaaagctgagcgccgctctcgccgagatcctcgagaccaagctctccgtcagcaggtctaggttctacgtcaaatttgacgatgtcaaggttgcaatctttcttcagctcacttcttgtttccccatttttcctcttctaacttctccttccactcgagcttaagttctaatactgacacagtgatgactgatgacactgcttctagtcaatttttccttaatcccgttgcgactgcttgctgctgtggtctgaacaacattttgctccactgcattttaacttcatttttgttcttacagggattcaatttggggttcaatgggtcgacattctgaggccaagtccgtcaaaagttggattgctgcgtcgaatcaataaaattctaaggctaaatgttacatgtcatgtgtatcattccgttgcactttcgacatcatccatgaatgtgtttcgtttatgtgagagaccgaactttgcctgctttatttcaatcaaaaatagcatcgaagtctgtttgctgaaaactcagtccttaattgccgtactaaacaaaatgcagagttccaggtagttgagatagtctttaaaacaaacaaaggtagctgaggtgtcttagcagtttccagaatacatcagttgcaaactgcagggagctttataccagagtatcagtatagagtatactagacagtttggacaggaataccatgcaaactgcagatctactgctctttgaaaggaacacatgttaagctgcaaaccgccctaaaaccaagcatgtctcagcaagtcagcatagcaaatatatgtgtaaacgtggccacttgaaagttgacacttcatagtgtaatataagagcatctaacattacaagccttgataataccgaattctgcttcacgtactcatacaacacattagtccatatactacaagtagaggtccacaggaagaacaactccagaatgctgtcttattcgcacatatttacataagaggtcacctgggcgacatcgccatagcttaagcttgataggcgcgacaatcgcgaataagatttatacaaaaaaccaacatgtgaagatcttagtgtagcacgttgccttcacatgttcgttcttgcctgtcacatattcactcctgcaacaacctctgggtgatagtggagcatctcctgccacatcatctcccggatcatatccacgccaagattttcatcgatgtcgagatcgatgggcacttgagcaggagggtttgcgcttggatcatacagtggagacatgtaagggtgctccag

SEQ ID NO: 64597 - DNA, 2422 bp, Oryza sativa
gaataggcagaaaatgtaaaaattctcataatagcaaggtaaaagaatttaaaaggcagattgactaggaagattttggcctacaagaaagtctaacttcacttcacacgcaaaagcttgccttaaagagtgcacataagaagtttaaatgccaacctcatgcaaatctccttgcacacatatagtagagcattgaattgatttcagaatattatttcagtattcctaagcaaaagcaccatatagaagcagtaccagaagcttctatcaggcatattgaagctgactactattttgctcacacttcacaatcattatactacataatacatcttgtcaggtagtttctaatcaatatcaaacaatttagtgtcattatgacctctcataatttctgatttcaaagctatggtccaggttagcattggtttcctgaggatatctagtccctagttcccagattctgactagtggagttctatcctaaaaccgtaagtgcatcgcatcaattgctgttccttgtcttcctttttttctaatggcacagtagaacaatagcttcaaatgctgcattatccgattcaggcctaagttcaggggtgaattatttcagaaacaaatgtagataaatgctgactcgtcccaaatgctgtgaatttccccagatatgaaaactagtagctagttaatgaatccattggaaagcattagattatggccaaaacactataacaagcactaaatattatcatgaatattcgacctaaaagccagagtgtaccaacagctgtactaaaaaaaagggatatggctcacttgtatctttatctgataatagaagaaatgaaactaggcagcaacagcaacatgccagcagctgcaataggtaatgacaacctactggactaatagatggatttgaaccatcaaaacaggctcattttcacttctcaggagcaagaagtacatcacattcatcaatatcatacgtcatggtggaaccgctgcttataacatttcttttggaacaattaataaatgaaatattatgtgaacaggaagtaaacaagaataaaaatggaaacaatggtatgagccttacctgaaaaaggaaatattgacagtggtcattagaaagaggttgagatgatttaattatctggtgtagatctgtgtccatgagttcataaaccaagtatacatctttgaaactccttctgtgtactggcatcattatatctttcaaggcaataacattttcatggcgcaagtgtcgcagtagtttcagctcccttagggtcctcagtgcatccacacggttgtcaaagacattgttgatcttctttattgcaactttttcgttggttgcacggtttatagaggagcaaactattccataagcccctcttccgatgggcttgattggcacatacttggtgtcaatctcaaatagcgtttgccacattgtgtagtaatgcttcccttggtttcccatgccattaggagggtccaccatcatcgccatcttgtactaaggaaaataaacatttagataactcagtagaagataatttgtcaaaatcaggaaggggagaaaatgcagattatatatattcttatcgaaaccgcataaaagagatggttctatgcttgctgtttacagccacatacttctatccttgcttcctagagcaagacaagatctcatggcatctgaaacacctaagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctctaagagcagagtttgtaaataggaacaattcatcatttacattggatatgatcaaatctactttggatattgcagacaataactgtaatattcaatgctttcagacagtgacacctatgattcgtttccatatcaaatcccatcccaactatacttatgttctcctgttctattcccaagaacagaggaagtaataaaacaaagttaatcctctagccacatcagctgatttagaagtattaaattgttagcggtatgctcgtaatcctgcataatccttcccaattaacacgacaattatgaagtgtgtacataaccaagcctcactaattggagtatttcaagcaagttgcatgctgctaccttgaattccaatccaaccgaggaaagaaattccagagcagcaggtgaggggggtggtgtcattggtggc

SEQ ID NO: 64598 - DNA, 1331 bp, Oryza sativa
aggagaacacgcggcacttagatgtcaccgcgcgagaggagggagcgaccaccgcacggactcccccacttgccactctcgccgtcgccgcggcctatgtactctcctactactagcaatagtggagtaggagtaggattatatatatccacatccacatcatcgcttgatttaattgtccactttcccgtgcgccgaattcggaaaagtcgtctagatcgtctccgcctccagctagcgactccgtcttcttctgccgcagccgccgcccgcgcctcttggcttcttcctccggcgagctaccggcctcctgttccgttcccgttaattttttcctaagccgcgaggattagagcaaattaaatttaatagtatagcccactactaactccaattcatttatagccaatctaacagccaattcttacgataattgtttactatacttttagtatatggccccacatgtcatacatacattgtgtcttaaagtctgtatttttctctcatcttttatcttattataaaatatgtttgtacctggctaatagtctgttattgtacctgctcttatatatatgcgtgaaaaacacggtttctccaacaactttatagaacaaattagtataaacctaatttgttgttaggtttataatgtatgtatactaagggagtgtttgaggagaaggggattgaggagattgggaagatacgcaaaacgaggtgagccattagctcatgattaattaagtattaactattttaaattccaaaaatgaattaatatgattttttaaagcaactttcctattgaaattttttgtaaaaaacgcaccgtttagtagtttgaaaagcgtgcgcgcggaaaacgagagccaatctcccctatcacccctaaacgaacgatgcctaattcctaattcgtaccgtaaatgttaatcgtttcgttcacggctcacctgattcaatttgcgttgcgtcattgttagggagctagtcagatatcgaaacgtacgacgatcgagcgaagagtatatatgtggtgatggcggcggcgtcgaccggcgatgatgacggcgagacgagagagtatgcatgccatgcatgtatgcaatgcatccaagggacgttttgctcgatttggcaggcggttacgccgctttttcgatgatctagttaatgtccaacaagtatattaaggaaacacaccacttagtgctgcatggtgcatgcattgcatcagccgtaccgtaccgtatgggtgatgtgacgaagctaagtacggagtactgttaatggcaaattggcactggatcacatcggagtgaacg

SEQ ID NO: 64599 - DNA, 4729 bp, Oryza sativa
catcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaattgacaaaataaaatggaaaaattgctactgttctct

SEQ ID NO: 64600 - DNA, 6864 bp, Oryza sativa
  unsure (1)..(6864): unsure at all n locations
atcatcctaataaatacaatgcatgcatccaatagaattagagaacatgagagtggagaattttaaaaagtaataatttaatggaaaattggtcatagttaattgcctacatgcatgcataccttgtactcactccgtgctcgtaaaggaagtcgtttaggacaatgtttaagtcaaacattgggaatataaatcatgaataactctcaaattattgagtttgaaaatgtaaaaattatatgaatagaattttcttgaaaaatactttcacaaaagtatatatatatatatatatatatatatcacttttcaataaatatttttatagaaacaacaagtcaaagttgtgttttggagaccgtgtcgttgtcctaaacaacttcctttacaagtacggagggagtactattgaacatctaaaaaaatgattgtgccttatattatggaatggagggagtacttagggcagtcccaacccatagtgtccataagtagtgtctatggtgccatgtcaataagacatcataatagaaactacactctacaatccatggtttcttaaagtgggccattaataaatatatcatctctcttctctaccaatcatatttattcttcatctattatgaagacactattctctcccaatgcaaaacttgatagtgtctagtgtataggttctcgtgttgaagctgtgtcttgcatgagacctagtttcttcctctcttcacactctctcttaattaatatagtgtcacataagctaaaagtcctacatggcaatatagttaatgccatatacaccatcctaagtggagggttgggattgcccttattgtttgcccattattccttaataagccaaaacaattttgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctagaaacatgtgccgtgccggcctccaccctcttttatatggcgcagtgtgacgggggcccaccagccattgggctgggcgcccccgatcagggcgcggtcaaggcccccttgagccgttgggctcaaggggagagagatctatctaacaaatttatcaaggaataaaaaataatttataagtaaaacatttatatatgtgttttagtgatttaaaaggcaacgctgaaataaactactctgaaagtaccttaaaatcgacatcaaaattaaatttacaatttaaattttgctttggcttcgacttattagggcattcaatggggatcctacatactagtgatgtcattgcccatgaagctacaacgatcaaaataaacaaacttaggtgtgaaatatgacactgtccatttattttgagacagtgagtagatcgtatgaaaatgaagatggaaaggcattgatgctgttgtctccgtagatctcttttgttttttcctttcgttggcttgtgcaaaaacaaaatcctctgaatatatgtagtattctttagatcccaaaacgaggccccagtcgtgttaaagattgcggtaatgcaaatgcggttgttgtctctgtcagccggcactcaccacatcagccacagctagcttcccagctctttccatgtcaaaaaaagaacatattttttcagctctttctgtcacgccatacatgtgccagtatcatgccagtgaatgggcacacagctgacgtcttgctgactccatgtccgagccactacaccctctgaatggccagttttttcagggcctaattaattaattcgatccgtagtactaccgaaaattcaatctaaactttgaaatcatcagcaaatattcatagggcttatgattctcaaatcaaaggaacagaaaacgtaaaggattaagatgtcacctacactccatccttcagaaatttttccaagagctctcatcttatcctaagaatctatgaaataaatttgcaagactacaatcctcaggaaattggtagtgtccatttctataaaacgaacaatacatacaatggaaaaaaaaaatctaatgattcagttcctacaataattctataaaagtacttaaaatttaataatcttacttggctagtagcctagtactactcctacttgccacagcaaaaaagttttcttttcagctcccctcgtcagaagaaaaaaggcacgagaaatggggttcgctttcagctacaggcaggccgcaggcaccactccactgctacttccccttttctttttcaggcctctcacagtgtaagctacggggctcgtacccctagcctaaaaaatttaccccaagacactcaccccacagtgtaagcatccatatatgtgtggcttaattggatggagacaggtgaaggaaacgaagcccacagtgcctgttaccccaaatacgttacctcaagcccactgacgaaatttattccccacctacccttccacctagcgactcgtcttctcctccactccatcaccgtggcctacctctcctgccgcgccgccgctctgcttctcccgcgcctcctcgcctcccacaccgccgcgcctccttctcctctcctcccaagcagcagcagcaggagatggggcggtctacggcggtcggcggcggcggcttccgcggcgcggtctttggcggcacggtctgcggcattcttggcaacgactcaccatcgtgtgggcggctggcggttcttggcagcgcgcggcgaagactcggcggaggcggactcgagcagctgctccatccacggccgccgctctgcttcttctccctcgccgcgcctccttcccctccctctctgtctgccgcccctcccctctccctttcccactccgtcgcggcgatggtgaagggccatggtttggttgcgttgcaaatccatccattcactcccttgcgccgtcatggtcttcatcgccaccaccacagcggcactggcaccggcgtcatggcgcggccgccgcccgcgtcacactcaacgccatcggagagacgctttgccacagctgaatgtacacagaaaaaacataatattctctctctctctttgttttttgatctatttgtgttcttcgatttgtttgcatggttctgatttgattttgattttgatttgtatttgtgttgaagcaactggaagtgttctaggcccctccccggcagccaccggctcgtcgtcggcaccccgacccagcctcccgcgccaagcccgccgcccccaggagggcggttcggggatttcaccaggcgaaatcgatgtgagggcagagctcggccaggaacgatgcccacagtgcacgcgccttgctttttcggcgccgcgcgcttcctcgcttcgacgaagtttcgcgctccttagcttagggacaagtcgccaagtgaggtcccaggcgcatgctccacgtagaccaaaagctgagctggcgcgacgaggttacgcgccaactcagtgaggcctcagaggttggtgcactgcactactgtatttcctattcatctagtagaacactaggtagacctgggacttgggctgtactttatcgggccggcccaagtcacgtcggcccacacggtataaaaatcctggcccgttttggcactaagcacgatgggcccaagtcccacatcaactaggcacaatttccatctctgcagggcccaatggaccaactataaggctgtagctaattcaaccaagtaaaaaaaaagctctttcttttaagacaagactattcggaaagcaatgattattttcgaaatcaagctctctcacgaaatttctggcagtgtacggcaaatcaggtcgaaaactaaatctctgcggactaaaaggaacatatgattaattaaatgtcagctgtagcaattttaaaaaatagattaatatgtattttaaaaataaactttactataattttgttttaaaaatgtggacacaagagttggaacacaaattttgacaatttgactctttccaaaaactaattttacaaatgaatcgtggccaaaacttattttaaaaatgacactttttgtttagcgtcaaatcgtatgtcgctaaacttagacacctcagtgctacgtcaattggcgcagaatatcgtgtcaccgcggacgagagactgagtcggcgtgccaacgtgcattcagcgtcgttctatttggcgttgaggtgtctaatttcagcgccatacgatttgacgctgaacaaaagcgtcattttttaaataagtttgggcacgatttatttgtaaaattagttttcgaaaagggttaaattgtcaaaaatttgtggaagttggaaaggcggaggaaaggacacagccgaaagtttctgaaaaaaaaaaaaaactatgagcaacagtaggggagttgttgagtagtgcgatgcgatgcggtgggaggtggcaggcggcgaccggcgagatcgatgggttcttcgtcttccacctccctcgtctccctcctcctcccctgcctcctctccttgctcctcatccgcctctccacccacctcaaccctgacccgaccgccgccgcgccccgcttcaagaggacccctcccttccccctccgcttccgccatgacggcgccttcaagatcctccaggtccgtccgtcgcttcaagctcacctccactcgctagctagctagctcagcgagcttcgcctgatggccttcgagatttacctctggttgctcaccgggcgcggcttctgttctgtgcgtgtgtttgctatgctataggtggcggacatgcacttcggcaacggcgccgccacgcggtgccgggacgtggcgccggaggtgggcggcgcgcgctgctccgacctcaacaccacgcggttcctgcggcgggtcatcgaggccgagaggcccgacctcatcgccttcaccggtgcgtttttccccctcctatccccgctccgctcttggtggcgatctgcttcgcgcttgctcatctggtcgctgcccattagtggcggtccttgctaatcatgtgcaaaacttagtgctattgatatgtgattggttgattttttttttcactctcaaagtcatggaactagtactaaatgtgagtgttaatttacaagcaacataacagttactcacaacaaaaacaaattagttaatgctccatgtagtagtagcttagtagagttagctggcagaatgtctgaataattgtgtttacattcagaggggttgggtggaatatctcgccaaatcacttgttgtttgcctatgttcgcaattgtggagaagtatctccggcaatccactcgtgtattttcacgacccaaatgaaattacttagcaactagcaaagttctgtgaatccatgctttgggttttctgctgttactgaattagtggcagagtagaatcacatgcagtttccaaaaaagtttgactacatctcttcttctgggggtaaagaggttacctttttgaatctctacgttacgtgtttttttaaatttccttcaccaacaaaaagggggtcaatctggtttgcattgaatgcttgtgttgtttttaatcaggagacaatatatttgggggcagtgcatctgatgcagctgagtcactactcaaagcaattagccctgcaatcgagtataaagtaccatgggctgccattttaggaaatcatgaccaggagtccactatgaccagagaggaactgatggtgttcatgtccctgatggattactcggtatctcaagtaaaccctcctggttctttggtacatgggtttggcaactatcatgtcagcatacatgggccgtttggttctgagtttgtcaatactagtttacttaacctttacttcctggatagtggtgatcgtgaagtggtcaatggagtaaaaacctatggatggatcaaagaatctcaacttgcttggcttcgtgctacctcacaggagcttcaggtaccgctgatgataattactagcataatcacagcacccaagattttattggaatatatctccgtcattgtgaaagggggaaaatgcctttgttcattacttctgtgtttcttcttttacaaacttatgatgtacatgtaaatctgcattgagctgcattctctggtcaaatattttatcatttgcctgagcaaaacacacacccattagttaatctcagattattggttttcatatatcagtgttttttttcgaattacaaatacagtacttttgaatctatgcttctgagttctgactcacggtacttttgacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64601 - DNA, 986 bp, Oryza sativa
ataaatacattagcttaatgactcactacggtcttatttgcaacaggagcagttctaggggcttctctgatgtactcttccattgttccaagaaatgatgacggcggctgaagaaagtacagagaagtccatttggcattagaattctcagtgaaaacaaaacaatgataggctaagataaaggtaattgcctctcttaggactggaaattggaaattcctggcgagttccaaacccctgcagagatcgtagaagtcggacaggctttttgcctgatattctaaagctcattagctctccatatacatttctagagaatcaaaatgcatgcaactctacagaataatgaaagcacactgtgattacgcgtaccagatgtcctgttcttctgtagatgtcgaaagctttgatagcatcaatttttgtcatgtcgaagaactacaacagttcagaaatttaatttgatcaggatcatatccattagatccatcgatgattcaaatgcagagaaagctggtaaataataaaaggtaccatttcgacaagattaatgattccatcattgactgcacaataaatcttgaaactttccttcagcacctgagtaacattttcattcatcatgagcaagagcaattcggataaattgttctaactagtagtatctgaagttcagatatcagaattaaggtcagccacaataccagagctaatgcatactgtataagatagtttccaaatgcggctccttcaggcttcacacacagttacagcattggtaaaaatgagtcagaaactaatctagatcaagcagataacataccacaaagttaggtgtgtacattacctggcagccgactagccgatagagcagctgctgcagtgcaggaagttgctccaagagctcatccttacctaagcttctagttctactctgaccctgaacatcatatttcaattggtacatatttgtcaccaaaaaaaac

SEQ ID NO: 64602 - DNA, 722 bp, Oryza sativa
gaactctctctctctctctctctctcctcttcccggcggagtcccccacctcgcctcccctccctgcgcgcggcaccaccggcgggaaggtctccggagtgcgcggcggtgtggacgtcttcctaccctccccgtcccaaccccgcggccgcttcgttcttggtcgtcctcggtgtgttcttgttgttgttgttgttgttcggatcgagttgatttcgtgcccctcccattatggaatcaggtttcttcagggtttctctgatgtagggtagaagattgtttggagaggccaagaaaaaaaaagttcttttggagttcagctgaactcgttgttaggtcgtttgcccctgatttagattcgattctgaggtaataaagttgcggaattgtggatgtccggaggatatccgagggttttatccgctcaatttgatgtgatcaagcaaaaaattcgtttctttttatgtttaaaggccttaatactacacaagctagtagtagtttgttttcttctgctctactgcaaaagtaagtactccttgtttgcatcccttggtggctttccagtacctaccatctgatgttgtagctccttggaaactgcttgcttatccctttgtcatgataagaatgtggtgtgaggaagaaacctgtattctttgtagttatacgctttatttgctttccttaaactctgtctttgtctgatttaatgtaaatac

SEQ ID NO: 64603 - DNA, 1755 bp, Oryza sativa
catatgtttaaaaatagaagtttcacttacctccattagaagatccacagcttcaggttcagcattatgctgcaatataaataataatcaatatcatcagtccatccattgatactagttgtttattggctactacctccatcccgcaatagttgtcgctttgacttttttctttcaatgtttgcccattcgttttatttgaaaaatttgtgtaaatatgaaaaaggataagtaatacttaaagtacttttgataataaagaaagtcacaaataaaataaatgataattttaaaaaattttgaataagacgaatgatcaaattttacaaacaaaaactcaaagcgacaagtaatatgggacggaggtagtaatatttaatgcattacacagagtgtaacaagacatctgtgatgaaataagaaaaacaaatgacacccatggactagactcagaattgaccttcatgtggaatgaaacgatttgctccaccagttccttcagggaatcagttggcatgccatcatcctgcaaagtggaaaaaaaaagttaggattataaaaatgaggtccacacacctaaactttgtgttgtcttagtccatgcacgtgtgataacataattgacagaagaaatcatgtgtgtggcttctaacagaacaaaaaaaaaattatatagcaatcatgctatctcaattcttgccaaataacaatcagtacggtatagatgtgggatacaaaagtcaaaagggtctcagggaagatcacttaaaacacttgttattgaaatcaacagcagctagacaagacaatggatgctaaactaaagaatatagtgatttggataatataaataagggtaatcttatcttgtgactttatgacctattgttaatggaattagagttttgttagggattaaaacaaaatttcaaatacttctttcattggggtgaagaaatacattatgcaattcatatgatgatatggattagggtccaacctggcgcttctggaattcctgtgcaatttcaccagccaagtttctagcaagcgagacattgacattgttagaaaatccaattcaaattcaaaagacaaacatatgtattccaacagaagacctgaaaagaataactttttatcaataatttcttgagtacaattcaatatttttttaatacactgagaacagttaaatatttgaccacaccataaattctaaataagctgatatgaaggtaattgtttggtaattcatcataaactacctcaggaataaatctttacaattaagattcacaagcagcaactgtctcattaataaaattgcaagctaaacaatttaggaggcctggaaattggtgtcacctcacatattcatgaccccatgaaccaatgtcaccttcagagcctatcattcggtagttgaggctctcctgaaacgataaaagaaggcatattagccaattcttgaaggattgatactgtacagttaatggtgagaaaaagttgaactctatctgtctatcatttaaaacccacgaaaaaatgtatgactatttatagaagtaaatcattctcagaagttagcatgcaagcaaattaaaaaagcactgggaaattgacacaaggaaaagacatcagaatggtatttttcacatactctttctccttcagcggacattgtcagggccaatactgacaaaatatcagccatatacttctgcagaataattgaagaatatcatataagca

SEQ ID NO: 64604 - DNA, 3447 bp, Oryza sativa
atcccctttcagatcagcattctggcattgtctcaaagtaagccttgagagttccatagtgcgggcgaaggaatttgagaggctttgggacagaggtcattgaacttgtcgcagaacggatctcctgcctgttaagcataaatcaccattaacaagagaccaataagagaaatgtgaaaactgtctatgcactaactggttgaacaatgcaaagtgatgccaccaatagcagcagtagccactcagatgcgacattccagctgagcagatcaaacaatctcactatgacgcggtagagattagagaaattgaacagttaaagcatgacctcatagtaattgtgattaagtagtattatacccaagatttaagggcaaaaggataaacaagcctccaacaatgtgccgaagatctacattcttgcaacaccagcaattaagcagccaaaccaataactcgggcagaatttatgtggattttcaattctcaggactgtaagtttgcagaacaacaaactcttgcacaggacaagtaagcagtgcaaccaaaatacctagcagttaataatagtctactagatgacatgatcatccgtccaaaccatactatgaataatgtatggaacttgtaataaactaataggtagtgtgataaatgcatccacccaaacgaggtaccagatgacacaaaacagaaatccctgaactacgcatcacgcacaatcagaattatacagttccacaccatcagaacaatcctcgttacctcatgctctcgagggcgagcttctggacgccgggatcggtgtcctgcgcccgcaccacgtagagctcgagctgctccttgagcgccctggtcctcctaccggactgcaaccacgcaaagcaatccgtaagagagagatggggggagggaaggagatggcgaatcgggggtgggcgggtgggtagctcaccaggtcgtcgtccttcttctcatccttcttcttccccttgcccttggccggctgcggctgcggctgctgcggcggaggcgggacggggtccgagggggaggcggaggaggcgtccccgttggggtcctcgcgcggcggcatggcggagggcgagggcgatctccccggcgcgcggcggcgcggcgaggtagggtttaggaatcgagctccgcgcggaggcgagagcgcgagatgaggggaagggaagagaagaggagttggagactgctgctactggaacacgccgcaactcttggggagcgatgaatttcgctccaagaaagaaaaagataacgagagagaaagagagattcggtttaataaaggttttggtaataaactttcagtttgatgaaattgcattcttacattgttttcttattattattgtgatgatgattagtcgacggtttggctgattacatgttgggaatgaaaacataacatgggtacaaataaaataaaaacataacataggtaagtaggaaaatgagcattgaaatatactcctccgtttcatattgcaagttattttgactttatactagtaaaaatttcttaagtttgattaaatttatagaaacaattaataaaataaacatcaaattatattcattaaaattaacatttaatatatttttataatatgtttattttatgtcacaaatgttgttatgtttttttataaactttgtcaaacttaaatattaagaaaaatatcaaagcgacttatagtatgaaacgataatttttttattattttttgaaacttttgattttttttattttaaaatcaaacaattctaaaacttattttcaaaatctaaacattttagcacgtcaaccctcgtggtgtggcaaaatagtactgtcacgtcacccacaacgggcacgacaattttgtcatgccacgccagacaagatgacgtggtaagacaaacgttgtcacaccaattagaccgcgtagaaaaaaaaattgctagcatggcgaaacaacactggtactcatccattccatgttttttttaaccttttgaactttttaattttaaaattaaacatttttaaaactttgattttaagacctgaatcttttttagcgtggcaaaacaataccgccatgacaatttcagagaaaacgttatgccacatgcataaagaaataattacccgtaaacacggacacatatataagtcgttccattcgtaaggaatctaaccaaataaattatgctcaaattgtaaatgtttttcattgttttatgagattattggacaaattctctaggagaaaggttcgaggtataggtagcaaattgtactaaatccaaaagtagttcaagcaagctataacagtttgcacgccctgggcacttagtgacccttacataatttctcaggtgaagacaagactactttgagttttttagtgatttttaaatctatgatatgttaatctcgtgaactagcaaataattagtgaaattagggtaaaaatatcactggctgtctccatggatgcaataaaatgcaaacatttaattgatagaaaggatttataacagtagaatttcaatatagtagacactacatatattgtggcctatcatcgtctacgaccaaaatttatttatggtaaaacttttatactctattcatatagagttagcgatttaaaaagtcaaaaataagctagataagaaaaattcaaaatcaacttaaaatgaagttttaaatccaaaatttgccggtgaaagataagccaaccagcgaatgacggagctgctaacattctcatgccccatcgggtgccctaatcagccaaagataaaaccaaaaatagctaatcatgtccccatcgaatgccctcaaccttaatttcgagattgatttcaaaatattttcaatatagttcctttctcagtattggcttttaaatcaccaagaaacacgtatataaaatttttacctataaattatttttttctctaataaaccaaaacggttttgtagtgaatatggcaacccatgggctttcaaacattctacattctgtcagcctagtttggtttcaacctaaaaaagaaagcctgatctgatcggtgacagtcggagccacatgaaaacaacctcgccaccaccaccggcgcagcgcgcagtgtcgttcacgtgctgttgcttcttcaatgccgttgctgaataatcttgcgcctgccgcgaggtcactgacatgtcggtggtgatcagctcatcagtgccctctgcccatcactgaaagtctgaaaaaactcatccataaaagcagagccacttcaccagaattcaaagctaaatttatatattaatttagagtattaaatatagactacttacaaaactaattatataaatgaaagctaatttatgagataaattttttaagcctaattaatacataattagagaatgtttac

SEQ ID NO: 64605 - DNA, 1025 bp, Oryza sativa
ctttacaccaaaacaaatactcaaagaaaagtcatagctaaaattatttgttgaaaaatttatatgtttggtttatcatgtgggcaactattttggtatatatagaatagttttgcaattaatataggtaaattttgagttgtaatccaactggtaagggcatatttttgtttgtgcttctgccacattttcaattccactattccatagctgtgtaaatacaaattcttgaataaaaaagttgtagctgtacagctttcttcgtgtttgctgcttttatgttccactctttgggtttcggatattttacaacaatttgtgtatgatacgggagcaaatccgagttaaaatccaacatttcaacaaggagagatctgattcgcttatagaaagctgtgttgcaatctagatagtactacaatttaatggtattatatgagagtaagcatgttctataataatttacaatttttgcacttttttaaatgaacagttttagaactttttgtgtagacaaggtgggtctaagatttggagacaagtttattggtattatatgagagtgagtataattccagcttgcaacttgtagccttctctttttcttgaataaacagttttagaactttgtgtagacaggatgggtctagatttggagataatataaagtccaaagctttatagaaaagaaaaggttcagttttgttcttgtcatctgacgtcaagtgacaaggacatttcaaggcatcttggttgcttcaatactaagtgttcagtacaagcatcctacgtaacttcagttattttacattaaaatgacttggctgtaaataacggctactgtaaaaatttacacttaggattgataattgcttaattggtgaagcagttagctccttatttatcacttgggagaccaacgaatagtatcagcttatcacatatatggccacctaatgtggattattttcaactgaacattttggttgcagatgatgtaaaccagggatgatttgttcatgcaa

SEQ ID NO: 64606 - DNA, 1843 bp, Oryza sativa
atccttgaatataagaccccaccttgggatccaggttatgcgtggccaaacctctacctcttggccattgaaagtatcaattacagggtcagctatctgtgcaccagcctggaaaaggtgtaagagagcttgtgttaagctggagcacaaacaatttcctatccaaaaagaatatttctaaagtgatcacctttcttaaaataaggctgtttgccctgtaaattgccatctctcctgaagtagcactatggtaaggattaccttttggaacctgcagaaggcatattagaagatagaagaccacatgcgcagtacagtattagactggaaacgaaaagggaagctgatgtaaagcaactgaaccaaagcagttggtataaaactacaaactgatgcataacctcttaacgtcatcaaaacacagatcaggtatgtagctagtatcttcagaagtatggatgaaatgtagttttcaatgaatcacaaagaagggcaagttgaatctgacaacaggcctattgatttataggaacaacttttaacctgaatcataattcattgacaccggcataaaattcagagcaaggccagttctcacgatgcataacttcatatgcgagcataaatatttaatgattataatataaattttcagtctcgaaaggcagtgaaatcatactttagcagaatcttcaggattattctttacaggagcataagtaagccacgcatccatcacctagcattcaaggaaaaaagaagagcaaagtgagaacagacagattaattatcggaaaaattctcgctcaatatgaactttgcattcccataccgtaaatccaacttttgcagagggaggtagtgtttttggatagtcctgcatcatgcactcaagacgagtggacgatttaaatgctgtcttggtagaatcagtatacctaaattgaaaaaatgataacagattggggttaaacatttgaaaacaaaagtattttaggaacttattcacaaaatcttgaagtgccctgacttgtatctaacaaaattcaaaacaagacttatctactccgttgactatacgaaatatttgcaggtttgctgcaaacttgttctgaagtttactttgtcagtgcactagctcagagtaccttaatggtactataggaataccttgtcgcatagtaactaagaacaacttccatgatcaatagtacaagaattggtgataccactgggaagataagatgattatcagcacatcgattggaactgactagctgacattagtgaggggaaatattttcacaacaaatgtagcagcagtatgaagtgaaaatggaaaagaagtgtgcacaaagaaatcagaggcatacaaacaagagagaagttttgcttccttaaaaacccactattggaataaaatgggagtcagaagcagtgtgcaatagtttcactggagtaagtaggcagaaaaattacttagggtttacaaattccgaaatggcaccgtgtgttttctggagctcctccatatatggtccaatctccagtatcaactgcagaagtgtaacgcacagaatcagtagaacaaaaatcagtggtcccaacaaaacatgcatggctaacagaagagtgttgtttatttctaatcaatatgcacatcgacaagtaaatagatttatcagaaaatcatatttgatcaacatctcatgttaagcaccatgtttttaaaatgtcttgaaactttcaagtcggggtttggatggtcagttggcagaaagtacctggtttatatttccagggtatggagagtaccctgtttcacaatttgcatctccatcag

SEQ ID NO: 64607 - DNA, 5965 bp, Oryza sativa
gggatcccccaattttgctggaactgtggagatgtaatcactttcttcctttttttcattaacatcttagttttcatatacgaattgtggtgcatgatgttgtgataggacgattcagcaattaatgtgaatatatcttagcaaaataagaggcatggaggtgaaatgtttcaaccaaacagcacaatcatactacatcctcatgactgcaaaacactagttctactaccacagcatctactttggaattgtaataaatatatgcccttttgtttgctagaacttgggtcggatatcacaacatgtcataactgggaatctttaactggagttaccagtcaagaagctagctattttcatgctttgttgcaagaatggtatttccaactggggtcacattaccttaattcctttgtaaccaagtctttcaccaagcccaccagctacaagaacaaatgctgcatggcgggcttcttttaccccagcttcttcaagcgaaacaaagttgtcatcaccaaaggtcaatacttcccctgaaggaacctgtaattatggtacctctgtgaacaccatgtagtcatttcagattgtagaaaaatgcacatgcaagtgcacacggattcagactagaaaagggaagaattaacatcattcagatttgacaatagtgagctatacaccatatattagaaagattatgcagtaggagttatgacaccacgaatccaattcatggaaaaacagcacacatcaagacttacagaaggtgagaagccatcatatggattttttcctgcctttgaatctgctaaaagctttcttgcattctggatgtacgatgccagcccaccaggatagcttgaattaaggcggcagacctgaacaatgacaattttagcagaaattcaaaataataataacaatttggttatttaagcgcctcttcagctttcttggcctatagatgatatcaacaatggtaagaggacatggtgcttcttagagtaagccgacaaaaaaaaagaaggtttataggtgcctcatatgaggcaatcccaacaagaaagcaagaagaaagtattttagcctttgtgttagtatcagtaaaattctataaaaaatattgttgttttgtgaataagggacaaacctggtcaaagaagttccttttcttgtcatcatcaacacctggttccggccagtgttcaaacaaatgtgactgtccttcactcagcagcaattttgcaagcttaacctacaatcaccaccaggcaggaagcattatggaaaacacaactcaaatatggtaagtaaacaatacattacccattccgagtaaacagttgtaagcacaaatttcaggaattttttttccaatactttgtactgtgttcccgtagaacttactagtagggtggggactgaattgatatgaaaattgcaggagtagaagcaaagtagttaagactacgttgtcgaacaaaatcccaacgaaacagaggtagttattcgttctagcgtcaaatcatctggtactggacctaaacttacgactcgtaatcacccaaaaaaaaatcaaatttgcagccgcaaggccacgcaacgcgattctagcagaaaactgcaatctatccatccgacatctaacgcaggacgtcgcaggttgcaagccaaaaaatcacctcgtggggcgcgagcagcgggagattccgccgcagcggcggcgcccagtcgtcgcccccgccgccggagatccccagcgccgccaccgccgcggcgccgtcgccgtcggaagccatcgcgcgggcgtggcgtggcgtgtggagtcagaagtgggggagcaacaaaaccgtctcccaaatcgctcacaaagtcgcggtttttatatttttttttgcggaggaatcggtggataaactgaatcccaaatcaattaggagtagtaactgcaactcatcccgatcgatccgtgaagatgatggtggtggtgggcgcggcgcggggcccacatccaccacctcggcgacgagacgagcatccgaacaacgggtgacgcggtggcaatggcattccccggctttcacgtgagcgctcgcggcggcgggtgggcccgcccccacggcgccgggtgtcggtggtggccgccgccgataagccccgtaagacttcaaacttccaaaaattattccgtccgatcaaatgtttgggcatatacacgaagcactaaatgtgaatgaaaaaaatcaattataaattatacagattgcatataaaattacaagatgaatcttttaaatctaatttcaccatgatttaacaatgtgatgctacggtaaatatttactaatgacgaattaattagacttaataaattcgtctcgccatttacatacggaatctgtaatttgttttgttattggtctacgtttttaatatttcaaatatgtgttggtatactttaaaaaaaattggcctcacgaactaaacacggccgtactagattttatctagcatgttttactgtattttggtgagctagtagattttagagcaccttttttaaactgttactccctccgggttgataatacttgtcgttttggacaagggcacggtctccaaaaaacaactttgaccattattttctattataatatatataaagtgttaacaaatatataaattttattaaagtacttttcaagactaatctatatatgtagttaccatatttgaaagataaatattttaaaaatgattcataatcaaagattctaaagtttgacctcacccttgtctaaaacgacaagtattatcagcccagagggagtaaacaatgttatatcttttggaaaaacaatatgtaaaagttcttttaagatataaataaatacattttttttaggattattgtaattaaaacttaactgatcattatctttcacgttttgcaagcgctgagttcatcctcatctagattcagacatctgtcgcagactcacgggttctaatctggaatctcaaatcatttacaacagcatattcgaattttccaacatggcatcacttggcacctcacagttgcaaatgtaaacaggaaaaatgaaacaaaaatcttgtatacatgtataatttggagtatatatgacgaagccacatccaaatggcataaatttgtactactatattgtactaatacgtatacccggaaagaacattaatttttcccctcattttgttatatcatcatgagtttactcttacctagctacatgtgtatatgtatcaaagtgtatgatgaaatgtcagtagtagtggcctggcaggttggtgctactccggcggcgcgaggttgagcaccatgtcggggcccttgtcgccggcgacggagaactcgtcgggcaccggcacgcccagctcctcgcacaccagccggaccacgcgccgcgtcacgccgcccagcgacatcttgttcaccgtcacggccatggccagcccgtgctccacgtcgcagaaccccgtcgacccgcccatcccggagtgcccgaacgtcgtcgtcgccaccttctcgccagcgccggcgccatagccgtacctcctgaacccgagcccgaacttgccgttcgggtggatcatgccggagaagtcgccgacgcccatgaacgcgtcgagcatcttggtgccgccgtcgacgaacatgctgctgccgctgccactgccgttcccggccaccaccgctgacaccgtcgacccctcgtcgctgccgtcgctggtgcggagctgggtgtacccgtccttgtcagcgacgccgacatcattcttcgaacctcccttcttcttcttcttggacggcatggtggggaacttgggggtgtggacatggctgccgagtggcggcttggagccaccaccggagtgcggcggaggaatggcgccgcctgcccccagcgcggcgtagtatcgagccagagcgcgcgccgagcagtggccattggcagcggggaggatggcgcggcggatgttgagcgtgttgaagaggacaggtaggccggtggccatctgggcgacattgctgagcagctcctgtgggacgtctggtcctgctctgaatcctgacagcttctcgagctcctccatgtcgactgtcagtgccgcaaggcgagattcgacacctgacaagggcggaaaatcgatgaacatcacatattcacatgtaggatattatctacaacggtaagaatatagcagcaatttcactcatcaaacctatggaacacatctccaaaagcgtgggtgagtatgtttatggaacatgtcaaaacaagccagagacagagaaaatgcgttctttggacaagcatcgaactcatgactgtacttcacatatgcattgtagtctcttttcaaataatctttggaacagtaataatagcaagaatatagcaccccgcaaaaaaaaggtaagtatctagcgcaattttttcactcatcaaacttatatgacatgaacacgtctcgaaaaggttaatatgtttatggatttgtagaaaaaaaaaatatccatcattatatcaatgcgtacacctattttgttgaaagctaaactgggaagttttgttagttatacctggaggaatgccaatatatagctccccgttaatgtgaagaggatgaacaatggcctcttctaggacctcttgaagcttctttccggacgcatgctattatcaccaaatatcagcgttaggattcatgaaattaagttcacacagaacagtgacatacaaacacgtgttgttttcagttatttacctctactttgccaatagcccataaccaaaaaaatataacttggtgggctgtgcatttaattaagcccataaccagattaaaaattagtataactatgtgaagccataaagatccactgatccagttaaaaaggttcagtactcccattgaaaataaatgaactcggtgtatgtgatgctcgggagagacatacctctatgattccaccacacagccaaccaaaggataagtagtgatacatttgttcagaacccggttctgtttccggcgtacacttggtaatctggtgcagcatctcttcccagtcacataccaacaacggatcactcttcatcacatctcccaatgcattatgtaaaccagatgtatgattcagaagatgatgaacctttagtagaaaattgcaaatcagagtctgttaatcccaagaaacagtgtttcaacaaacaacaaaaaaagaagttctagtacctttattagctcttttttgttagttccgaattttggccatatattggcaacagtctcctcatacttcaacttcctgaaagataacagtatgctgtcagcctgtcactaataataaaaaaacactggatatgagaggaaagattctcatatcaaaatttatcaagaggggtgaggcttgaacctgggtcggctagcccacatcttgtggtgctagccagaagaccccaggcctttctcagcctgtcactaatggattgcaatgcacataaaagcctaaggtagcagggaaaagatgctcaatgttctctgtagtaccatcactgttagagatttagaggagttgcttgctttatacaagaatctgatgctttatactttttaagcactagaatgtagataatatcaagaaatattgtgacctggataacgtggatgcaactgcaggaaactacactgcaccaatctaaattttatgtttcaacagtgactcacatgtcataattgtgaaggattgccacctgcactaacatggttcagcctaatcatgggaacactggcacccattctccatgtccatttttattgttcaacatagactcacagaaatacggtacaacaatttgatgcttcagaataaaagttgtttgcgcatgtgagtgactttgcaatgtatataaagatg

SEQ ID NO: 64608 - DNA, 1600 bp, Oryza sativa
aatgcaccatgccagcagtgataccctttgtcactgaaaaaactggaaagagagaatcaggttgaacaggacgtggatcatacttccctaacgtaccagcagcggtatctattatgacctttccatctttataagcacaaacctggtaaaaggaagatttgtaaggcaccaatgaagcaaagtcatagcatgtaaatgaatcgcatgagattatcaacctacttgtattcctaaaattttgttgcttcccaactcaagcagaaggttccgcagtttagactccacctctgagttaacaggtgagtcataaatccactgactgttagctgtgggcccacgtgtcatactcctaccatcaacgaaggcataaataagcaataaaaaagatgctttactctaaggctcctgcaaacagtagataaacaggcatctcaccctagcaaagttgattcagcaaatggcctcatgatgtctagataaactatcctaacatttagtgatgctgatagccctgcataagtgcagataatagagagcatgttaccatgatactggatatttcaaaggaaagaatgaaaaacatacctctaagaagattcaaaaccctcatgaatataattgcatcaccagggaaagcatcaacctaaaggcgagaaaatgttcatgtaacacctatttcttggttgacaaactaaacacatatgaagtaaaaggcatgcctactcactggattgaaacgttgaacctcctttttattcattttcatcttttcttgaagtgccttgacatttcgttctctttggtcattcaatgtctttatgttctcctaaagaaaagtcataaccaaacagttaatccaaacttccaaattaatacaagaggagggatacagattacagtagtggtagcctcctacctttgcttcatttgctgtagtggactgccgaaaaaatactgtagcgatctccatagcctgctcaggcatgtcaacccgcagcttaagccccatctccgcaaaggctgacagcagtgccacatggtctccctacccattgacatgttaaatatcagaaatgtagtttaagaaatttaatcatagcatgagcaactggttcacaaacagcaaaaggtagaataaaccgaagaaccctatctcacaaaattttaattatcaaattttgacacgtcaaaatactagtgcatgtggtcacttaacgttccagtgcactttctaagtctcaaagttgattcaaggaacaccaaagcatagtagagaagaaaataaagattagttccagattctgtctttgttttcttatagcttgttaaatgtgatattcatctgccactttgcaataccacttatgagtaaagactgaaagataggactaaactaggatacaaaaagatcggaaagtaaacaaaaatccattcttgttataataaaagatcgcatctactccaatggaaatggctgcagcttgtagatgccaacaagacaaccatgtttgattaactccattatttgtttccttgtgtatgtattatttagaagatcaaagtgtcaaacctcagcgcatgacaaaaacatctttgctag

SEQ ID NO: 64609 - DNA, 1844 bp, Oryza sativa
attgcctacaggaaaataatgcattgtcagcacaaatgaatttgcaagaattacagatggagaataaaaaaattgaggtgacagaagatctcttcaaggcacataaaattgaaataccagggtgaggatcgccgttaaagaagccatcaacgtatatttgatgagcatatgcacgggttatctcctccacaagtctttgcttatcaacaccatatgcttctaacgaatcattgtcattcaaacgaattccatccatatattgcaaaattagaaccttatcagttgactggtacacaaagaagaatggattagatgatctgtcaactgaaccggaaaaactgacacgatgacaaacaggatgaagtaaaagaactcagacctgaataacttctggaatcagtacgtcaacagcactagagacagcaccactctcgcaattggtttttcgactaagattactggagacagcctttgtgttctctaaaattaaggattttatagcatacattatcaggatgatatgttcattagtgactagacctttacttttaaaaaaaatatggatgagtcacaagagcatgcatgttcttttatatggagagaggagtatgagaactgaaaggggtaattacctgcctcatggttgaaatcaagttcctttggtgcctccttgcaccattcatctatcatcgggttaaaattatattgaggctctgcccatgcaatccattcaactaatgattttgcattcttcaaatcctgacaacattaagaaaatgatatagcaatcctgcacattttacataagtccgttttttcagaatagaggcaaacctctaatatgatatctttgataccatcatgttggattttcacaactacttctctgccatctacaagagttgcacgatgaacctgtgctatctgacaaaagtacatgaagactcgtatgaacatactaccatgacaaaaaaaattagcaagttgctcgaggatttcgtcaaaaaaaacatactatgaatttccatcagatgaaagaagttcattccaatataacagaacttactgatgcagttgctagaggatccagcacaaaattagcaaacagatcattcatgggtttcccaagttctttctctatggttccacgaacctgaacatgagagacaagaattgagttaacgactacgattagctacatgttaatatttggattgactacagatgaagcaaaattagttatgaggatgaacctcttcaagagggcgaggaggaagcgagtcctgcaactgcttgaggacatttatgtagggttcaggaagcacatctgctcttgtggataaatattgtcccattttcacccataaaccttctaactctatcatcaggttgagaacacgacgagcatttcgctcgtgtgtttttgtccatatagcatcctttttaccagcgccaacccatttaactctcttctgaactgcctgcttgtacctcaagaagatgttaatctgcttctactagtagaatggattgagactttttattgaaagaacagcatgaagaagtgatacaaccacaccttatagtcgaagtatataaacaaggccatggaaaagactttgaggcgcctggttaaggtgtttccccatcccattagaagtcagcacaacagcagaagagataacaaaaaaactctgaaacaccgtagttaacaactctaggctcccggccagacggttgatcttctgcaatgtcacaagtacaagaaggtaaatccaaatcagcattccttagtcactaccgatcacatacaataggctcaaaacttcttcatagaaaggact

SEQ ID NO: 64610 - DNA, 3008 bp, Oryza sativa
aggagcaggggcaattctggcaaattttcatcgtttttctcatcctttataattttttttttgaaagttaaattcttgacactgtcaacttgaaacctgtttccttccaaaccggtggcaagtacagtaacaacaatcatatataggagtagtccctatgtcattagagaagtgtatggatggtctctaaaattatgtgggtatgttacctgtgtgtctgaaccttaaaaatacatttctggctccaaagttatcatgagtatgttcaaacaagtttcaattcactttgtgtgctgacatggcaatatcacggtggcacttatatgtcagtgtgacccacatgtcaaccatatagaaataagtttttactgtttttattttctatgtgactaacgtgtaggcaccactgtgatgccatttcagtgtatggagcagtttgaatactatttggacctatatgacttcaaagacaagttcaggaacccgaaaatccattttgaaagtttatggatgttgatgatacacctgtacaaatttaggtaccatccgcgtacttcactcttttttatagtgaaaaatggttttatgttttcggcttatgtaaatagacacataaccaataagctttagagtcaaaaatgagaaaaatcgagtgatgggaaaagtctccatctcctctgacaaaatgactacctgaactaaaagataaaacaaataaaaaaattagcaaatggttacacaggtgctacgccatctaaaatgttacaaaagataacgactaccaaaaccaataaaatagcatcattatgcataatatctatttgttcttttatccttgtcaccaaacaatattcatatttagaattcgactacttttttgtaaaaaataataaatacttaaatagatgtcactttatcgaagtgtattatatattaaacataattattaactttgttcataataatctagtcatttaaaaatacattaaagtttgccacaatactgatcaatggtgataattatataggaattgagggagtatcatttttagtggttttgagaattaatataaaagttttggggaggaggattataagctcttttttcagggtgaaattgtaggcatctaatgtcatgtttgtataaaagaagcatagtttatccattttttgtgctgtttggctgtaaagaggtggattatttttacttgagtgggatgggagaatcgaatatatcttttttgtttcatttggatatgacatgtgagcatccaatgaatttgtaatcttttgagagaacaaaaaatcatgcaacaccttaaacagcattaaagtaagtcagtcgttgatatagatagtagagcaagatgacattgaactcaatgtgaatacacaaggcgcaataaaatcgccagcattactacttgctatggccagatagctgcaaattaatcactgtagcacgacactatttatgcaaaaaacatcatgtatttggaaggccttaacagcagttaactgatggcaggagagaaaaaaataaataagaagagggggcaacaaaagtaataaaaattcagatggacaatccatagattctttttttttaaaaaaaaagaaaagaccagtccatgaaattaacctgcatataattcaatgagcaagtagacttcagacagctccttggaaacttcttggccaatttcttgacatactacgttgctgtcggcttgtccctgtctcttttatggtgcacctatattgtattttttttcccccaagttttcatttaccctttcgcaagtctcaaattaattcgattctagaataagaggagatggagacgcaccgaaggctctgaacatgcaagaacctgtaattttttccaatgggagatgatcaaggtcagactgaaaatgtgggttcatgaaaagtcttcaaaggcggccaatgacttctctcatacacactgccaattccaacagcaaagttcatgaaaaaactacggcgaccactcgaggagaaagtctttctgcccatcgagagagaatgtacactgtacatgtcaccaaaaaatcattaacatttttttatatataagatggatcaatatgcagagcgctgtagagaccgatgtgcagtactccctctggttctataataattgacgttttggacaaggttgagatcaaacttttataattttgaccatcaataactttaagaatatttagtttaaaaaaactagaaaaacatatatagatttatctttcaaagcactataataaaagtaaacatgcatttatttattgtgtatattataatagaaaaataaggtcaaagatatattttgtagaccgtgccattgtctaaaacgtcaattagaatgaaatcggagggagtaagtgtatatcatgattcatgacatagttcagaatttcagatatcacatattgtttgagtcgagtggtagcatgcagcgatatctgatgaaacatagaaaacggactacaaggggcactaataaagtagtaataaccgagtagaaattgcatagtactactacaaattaaaggaactgattcatttttaatgtcactattaagaacttgttccctttgaaagtcattatataaagcattatattccgaacttaggaggaaagcagaagaccttaagaataaagtttatgaacacatggtaccatttcaaagtcgagaagagagatcattgcctcattggtggccagttcagttactcagttgggtagttcacccacttgacttgacccatgcagttcctgtttatctgtctttttcatcaggcattgatgcccaattacccatattaccatcactcaaactcaattatcatgtgcttgatgtactatattttagcatccttctgttttcatagacagaaccacacctaccaagcaaagttgggccgaaataggatttttacatgctgggccaatataagttgggccgcaacgggattggggatcc

SEQ ID NO: 64611 - DNA, 1118 bp, Oryza sativa
cttataattattacataatgcaagattaatcatcaatgagtaaaaagtgcaattaagatctttattacaatagcgtaaatatcataccatgaagaacttttcccaaagcttctcgaatggcaatgaactgggtgtcaagaacatgaaagcaatttttggattctttgactgaactggctgtgccaaaatgatatctcttatgacaatacgagcagcaatctcatcatcagtgtaaaccctagcaggttctggaggaggccgagaactacaggaatttgatgacaccaagtaacaaggtgtgtaatgctggggtgtataaagataggctccaatgcctactgcacagacaaaagcaatcaagatgacaatccagagaggccttctagctgaagacctgttgcgcggtgccatgataaaagtgtatatggccgtacgcaggaaaggagaacttcacaatctacattcagcaagcttcatttatgcaatcatccagtgtcactctcctggcagaactgcccaagaacccccaaaacctgaaaaacatggggaatgagaattgcagcttaatgatttcaatcagcatttttcatattctggttaacaatatggaccgaatgataagggaaatgtatagattatgaaacagctttaatcctaaaaatgatgtcaactcagcatttgtctataattctcgtgtttctttctatgaaagttatgggcatatgctcgataatggaacaaggttcttttacagaagttgtggtgactcagatgaataagatgcaactcctttgttttcgagagcagaccttattccttaggtgaaaaggaagaaaatgtatgcctaaaactgtcattgaccattgactaatgttctagcagacaaagcaaaggattaatctagggtttgatcattgcacagaaaactctgcaagaagagttgcagatcttcagcccacagattaagccacagtaagacgaaatcttgagcctatagcttacactatgtagcacatataacaaacaactttgcttttgtttcttgctggtttataaaacatgtgtaacttgcattttaaggtatgcacgctgcctgcgtgtttcagatgattatccca

SEQ ID NO: 64612 - DNA, 3779 bp, Oryza sativa
ccaaatcacaaatctctttcaagaacacacacacacaacacccataatcacaccaacgcaggcaagaatcacaggagagaggccctaaaaatccctcctttcccatctccgcatcaagcagaaaccacccaaaaacccaaaaaaaaggggcctttaactgacaagcgtagcaagagcagaatcactcttatcaccttcttgcgaagctggatctcactcacccagggcttgggattaccgagttcttggcgagatctagccggtgtgcaggaaacaaaagcaggagaaattttttgggtttggaggagcgaagcacggctgtgaatgatggtgggagaggagtgaggtggaaaggtggagagacagggtttactacacttttgctgctaaagcaccgggaatttaccactggtaggagtaatagcagctgtcatttagtttttcattttattagtcccaattaagctgcgggtttggatggtgatttttgcggattagcccggttcggtcagtgcctgccttgccggagcggaagctcgccgccgccgccgccgctgctgaccgtcgcagccaccgctgctgattgccacgcgtgcataggcgtcgcggtctccaagttgagatgtgtagggaaataattgcagcagaggtggccaaacgggccgggccaaacgggccgcccggggcacggccgaacctgtagcaggcacggcccggcacggcctgctacagtaacgggccgtgccggcacggcacgagtagccgtgccgtgcttgggccgctggccgagcccgcgggccggcatggcacggcacggctactgtagcaggccggcacggcacggcccgcggcacggcacggcccgtttcgccggtggcccgtcaggcgtggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggcgatagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccagacaagatttacccctgaactttggggagtcccctgcttttgaacattacattcagcaatctcataaccctaggtttaaagctgtgagtagacaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttgtttggacagcgacgccatccaccacgaagcacaagatttcaacgtcctcgggtggtggaatgaccacaagataacatatcctgtgcgttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctaggtttttaatttttacaagggggatc

SEQ ID NO: 64613 - DNA, 4511 bp, Oryza sativa
ttaacattagcaaatcattacttttttaaaaaactttaatttccattttttaaataccattttttcattttttaacattagtaaatcattacttttttttaaacattttatttccatttttaattttttttccttatacatttcctttgtttttttttttaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataaattgaagtgctcgtctcagctgttttgtacttttttgttgttatatcatactaggattatgttgatttagtactggcaagaaaacacatcctctgcactattgtgttctgattttaagtggttgctacgtactccctccgtcccaaaaaaaaaaaagacaaaccctggtttccgtgtccaacgtttgaccgtccgtcttatttgaaaaaattatgaaaaaaattaaaaagataagtcacgcatgaagtattaatcatgttttatcatctaataataatgaaaatataaattataaaaaaatttcatataagacggtcagtcaaacgttggcacgaaaacctagggtttgtctttttttttggacggagggagtaggtcacacatttattatgctcacatgccagaggatccctccgtctcaaaaaaaaaagataaatccaggtccggatgtgacatattatattacagcgaatctgaacagaggtatgtccagatttatagtactatgatgtgtctattactgtgttggttttttaatgagaccgaggcgtctcaaaatataagtatttttaaactccgacacgatctctgagatgttatttaactaagaatatatataaaactaagatgttgtaaatacaaagagttacatatcatgatagtttatttaatgataaatctagtaatatcaattttacatgattaatcttttttttctattaatagttaaacttaaaaatgtttgactcgtcagtcgtcactatgctaaaaatatttatattttataatagagtattaaatactctcccttcacttgtctagagttcaaaatttgaatagagatcaaacacgtcatggcaaatctttaaatgatgttacaccgtatataaaagatatttacgaatgtttcatcactcgatgaaataatgttttagtaaaattattataaatgtatcattactcaatgaaaaatgtttcatcacttagtggacaatgcttcaaatagatgcaacattggaaaaaaaaaacagctacttgcaacatcaaaacatttatatgtatcaaataaaatacatcgctcgtcgtatgcaatatctaatcaaaaagtcaaaagaggatgaaacactcaaatacaccagaagtgcaacaatgttactatccaccttcttcctttgctccaatgactggatccactttctttctctattatggtggctggatctatcttcctcctctaatccgatgatcggatccatcaaagatcaccatttcttccaaaacataggccgagtttagttccaaaccttttctttaaacttctaacttttccatcacatcaaaacttccaattttttcatcacatcaaaacttttctacacacaaacttttaactttttcgtcacatcgttccaatttcaagcccaacttccaattttagcgtgaaacacacccatacccccactccccccccctacccccacatttagatatatatatgctagattggtttccattatcaaaaatgcagaccaacgctagcatagatgttggactagggtgcattcctttggccaagtaggataaggttttcagtcccacacaaaacaagaaagcttattaatgcacgattaattatatactaactaatataaatttaaaaaaatgagtttatttgattttttgaagaacttttatatagaatagtttgtagggaacgaaccattatattgcttcgttgattcgattccgctgaaaaaaactcaaccatttccattagagtatctgtctacaaatataaagaattttagaatactacttgtcgatagttgtttcactagatgtgatcttgtgatatttctagatcgagtaaactcaagtagtaatctcaaattaaccttaaacttttcttaaataaaaccagcaattcctcatatttgtgaaactaaaaaaccctgaatctttgcacggttttcaaaactaatgtttaactattaattttacacggtacaaggtttgtagtaacaaaatcatatagtcataggagagcaaattcaagaggcaatcaaataacattgttttcatcgaatagaatttaatttatatttgactaattgttggtcaaatgtttcaaaatctaaagagtttttggaagcaagttaatcccagcaccagctagtcctcccgctcccagaaatggcagatttcatgcaccttctcagattcttacaggagatgatgcctcgatcacaaccgggaaagaaaaccacaaagcaggcttatacatttcatgattcaaacacctgcttcgtctcaaaaccagacacctctacaaacaacatttttttctttagctgaagcaaaagcagcacgactaaaaaaaaaaagatcaaacgcatagcagcatcggctttttctacatttcgccgatgacgaggttgctatattttctgatgatatgtgcagacattgctgaatttcctactactccactacgatctcaggcagcttcactatgctgtggctgcagcaactcctgctgggcctggagcatttcacatagctcctgcagcaccggctggcctggctggtatgatgatccctgtgcaagctcgagcaaatgtctttacctttgctggtattgctgcaacagtttctgctgatgcagtcagttggaggtggagcacaatctttcggcttcggatgatgtccgcaatcttcggctttgtgttcttcgttgtggtgatgctcatggtggtctgatgattcttcgatcgagatcgagtgctcctggactggatgagtatcattcttgacctgatcatgaggttcatggcagcaatggttgtggtggtgaggtggttcagcatggcagtcctttacttcctcgacctccaggttgtcatggtcatggtcatggcaggggtgcaaatctgcggtgtgcggagtttgctgttcatcacagcaatgatgctcatgaacctgttcatggtcatggcaagcatgcttatcagcgcaatgcgagccgattggctcgtcacagtggatatgctcatgctcatgctcatggcaagcatgttcgccggtagagtgcagagcaacgggttcttcacagtggctatgttcatggccatggcaagcatggtcattggtgggaggcaaagcgttgagttcttctttgcaggtgctatgctcatggccatggcagtcatgcttcttggtgtcgtgcagattgctcgtatctgcgcagtggttatgaccatcatggcaagcatgcttgtttgtaatcagctggttgcttggctctttgcagttgctatggccatggctgtgatcatggcaaccatgctggttcgaagaatgcttgtgggctggctcttcgtgatggttatgctcatggtggtgatcatgacaagcattctttgcaactgatgattctttgcaactgaccattgatttgcacggaccatccgaacaatggtgggaaacgccatgatttttctttgcatgagatccatgatgagaagaagaacagcacttctttggagatccgtgatgagaagcagcacatttcttcgcctttcgactgtccttctctctcagcaacagcatgctgtacatgatcaccagcaagcatgtgccaacatctgcaaggacggctgcccagataagtggatgtccggcaaatgcaagcccaacgattgcaagcttcgtaatcaccgagaatatgatgttcacgatgattgtccgatgcgtcctccttgccagccggacagcctttggaatcctgcggatgtcatttgacatcagagcaacgtggcttgtctccattgcaacagctgaaccagatacacccatagagactccaacatcagctttagccaatgccggggcatcattcatgccatcaccaaccatcagcgtagggccatctttttccttgagttcaccaacaattctcactttgtcctctggaagaagttcagcatgaacctcagcaaggatatttcccagctgccagaaaagaaaaacaagagcaaaattagatgctgtaatatgcaaaaccgaacaacagtaaaaacagccactc

SEQ ID NO: 64614 - DNA, 1413 bp, Oryza sativa
tctgctctcccactaatcacccaccatattggtcctcgtgaagaaacttgcttttgtctctttttttttcacaacccattgtcacactggtagaacaggtatcaataatacccacaacttcaatccgtagttgaatatttacccaaagtggtgttgtatttgtgtcttctacacacaagagaatactatggtaaaaaaaggaacaagtatactgttgcccttttaatacagaaaaaaaagcttcaaacccatggcatcaacgttaaaactcaatgctctactactaagctgtgtcaataatttgttttcttatttcaaatgagactattcaattggaggatatccttaatggcagatgtgtttgctaccattcgatactatttaaacgttcatttcttttcaaaaagtatggtgggacctctgcttttcatttcattaaagagagaaagtaggttttggtacaagccaaaatgcatgcattaggccaccagatgaaggaagcctatttaaaattttataattcagttatctcctaaagatcaaagggtcttcgatcgtcggaggtgatggtcagggccatcctccaacaaaagggagcttctttttttttcaaggtaccaataacaggaaacatcattaatgtcacaggtgaattataggctgttcttaccagcaatcagcatgagtatgttgacatccagggtgagtctccggatggccgcaatgctcctcagcacgatcggcggcaagccggcggccgcagccaccagcgcgaaccacttgagcgggtgccagaaatgctcgaacagcgacacgaccagaagaagtccgcagaggagaacatacgggctcggccatttgttggtgatcttctcactgccgttcccataagcccgaaccgacgcctccaaccttgcctgattcagcgccttgactgaaaacagcaaatatcaaaatcaaatcaagctttcaagagttttgtcatgctaaaatcgtgattgattttactgtccatctgtcataattggtatacctcctcaaggacagtaacatttatctaaaattatgtaatgactgtttcaagaaccaaagatgaaaaactggcggtttcattgagtgtgacagtattgtacagtaatcaagttccttaattctcgtgacagaaactgcaaaattagcaggatttcgggggtgctgaggtcagaattaacgagtcaagagatatgtccaatcgtatcagtaattgctccctgcgtcatgaacaatagcgaccactgccaagacggttcacttgtcgctagcaaacatcccattttagtagagttggagtatgaaattttgcacttattttctgacatggtaagtggtccccagcctcgagccatgaaaacaaacgaacacatgacaccacct

SEQ ID NO: 64615 - DNA, 1526 bp, Oryza sativa
gggggctctcaccgatttgggattgggagatggcgtcgacgtcgtggacgacgatgaccgtcctggagggaacgatcacggtgaccttctggacgccctccagcggctgcagaagcttctcgacgaggggaacctccgacgggcagcaaatccccagcacgtcgaagtagctcttctgacacctccctccctccgccgccatctctcctcactctctccctctttgcgtgcctttgccctctctctctctacaaacctgaagaagcaagaacaagaacaagagtgagaaggacacagcagcaaaagcaatcttggcgtgtcgaccaacctgtcctttggttggtttcaggttcaggaatttttacttcttgtcagaccaaaaaaaaaaggaaagaaaatgagttcagtgaattcagttctccatctcacttaccccccaccacaacacacacttcttccaacctccaaaacctcgatcaatcgatccacccaactcccaagaagaacaagacgcaggtaaaacaacgcaagaatctctctaccaagaatcgtcgtcggcggcggcggctggaggaggaggaggaggaagcaagaagagattggctgtgcgaatcggggataggaggagacgaaggtggcgaggaggagtatttattaaggattcggtgacactcggcagtcggcagcacgcatcaacgagatgtggacgatgacgaagacaagcatcaccgccaccgctaatggcaatgccgagtgattaatcacctataaatctataattaccagtgattaatcccaaaaggaggtagaagaagaagaagaggggagattaatttgcattgatgattttgggggaggggattaataagggaggaggatatggattatggttaactactactactagttggtgtacacgcgtgtttttgcaactgctcgatcgcctcatcaccgtccacgtgtctaatctctagctagcacgacgcacacgtctccaacttattagcactaataataatcttttacctttaatttttctttttgggcagaatccagggagataaaaccgcagatacagcatcgcggatctctgtccacctacattgaccaaaaatgagttcaaggttttaacactataatccagggagataataccgcgttgacggtgttgtagttgtggttttcgctcagtttttctaattaattagacactagggtttggttacgttttctaattagtgggacactttttttctttgtataaaacatcggcaacagtctaaccgttcagaaaaacagtataatcacaaattgacatatattacccttcccttaaaaccttttttaaaactttttaaaatagggataacacgtgagtatgaaaaaatgggttttatgtttgtctaacagatgttttcgcgcaattttacgtggagcttcattttgaaaaatagaaagacatttatatacaaatcatatacatttatggcttatggtcgatgtttttgtcttcttccgcttttttt

SEQ ID NO: 64616 - DNA, 955 bp, Oryza sativa
ttaacacgcacatgtatgtaatgtaaccatagtactccaatgaaagatcgacacaaaagagtacattgcatcggttgtgtggccttcaaccataagagtggctcgaggagaacaatgatgacgataaaggtggaagatgagataaggaaaggaaacacaggtgaaggacacgacaagagtacaatggatcggtatgcgatgtatcatgtactcccttcatttcaaaatatttcaaatatagaataaaataaaacataacttatacaatgaatctggatagggatatgtttccccaatatgcatgaactagtccatatatttagatggaagtccaaaaaccggtcaagcttcgatggcgagatactattatctatctctgatctgtcgttgctccaattgtttgaagaatctggcaatatcgttgtcaatcccacaagacaaattaaggatctattatatatatggcaaaacggagagtttctcttataagaaagttgatctttgcgttactctggcaatgttgtttaatttaatttctctctaaatttctattgctttgcttcttctcatcttatggcttctattgtaattttaaatgagttatacaacacaatttattaataagtacatattacattaccatatgaaatagacatttcgttaacacagatgtagccatcaatctatatttaagtactgaaaatcacattggtttatatctcacattgagaaatatagtcttaattattgtatttttatttttgtttttttaagatgaagaatcttgtttcaaccaagtagaagctatttctttcaacaagatttttttttatgtttttcctattttgaataacccgttgcaatgcaagggcattcagctagtacattatacatagtccagttaattaccttaacatcaaacgatgacttcgattaatatatctgagagtacata

SEQ ID NO: 64617 - DNA, 3480 bp, Oryza sativa
ggactatgcacatgattacaaaatgatccaattattcaatgaaatttacggctcgccgattcgttaaaaaaaattgatccaatgttttttgttttatatttctttatgggctagtccttatagaaaccccttggggatagcctcttgcaacgttagattgaagccagtaataacttcacttgactccacaaatcatgcaaatgtcactactatactatgacaccacaagctcctcaaatgcatgcatgcatgatgccacatacccccagttggcaccactacaataaatattgctatacatgctaacatctgtcactcatggatactaattaactccagcctaatttgagtatgccaaataaggaacagaactaatgctggagataacaaaaaacggaagcattgattcttgatgatatactcttgtagtcgtgtccctataaatcccatgaagaggatattgtcattgtggcagtgaccagcaacgattctcctctcatggcggctatcaagaacaacggtgccatggttctgtgttttgcaactctgtttgctatgtctgttgttttcatgtcttgcgatgcaacaggaaggcataatgctggtaagttccggcctatccagatccatttctactactgtagtacttgttctctctgttactgtctatgttgctgcaatgtttattcagatatgcagaaaagtgaagtgcatctgacttactgattgatactgtttggtggtcaccgtgcttcatgatgtgcaggtgttctggacgatgctggcgtgttgtgcttcacttggctgaactgcacgaatgcttcatgccaaaaagaatgtaaggctggcaaatgggatgctaagaaaagcagttgcggcgcaagcgacgtttgctgttgccgagctgcaaagttgttggtgttggatgagcaagctgttagatgaaattttgtgcccaaattcatcaaatcagcaagctgttagacttagatgcgacggggaataaatatatgtatgcaattatgacctgatttggtcagcatgtccaacaatgaagttgtttgatgaaattttgttcccaaattcatcaaacgaaataaaggaagaaattcaaatttaccaccttgagactcctgaggtacaaaattggatatatggtccctaaaaattgaagtgtgaccgaccataacttgctgaaaacaatcatttttcatctatatgcatcatttgtaggaggatgcaagctttcagcattttcttcaacattgacttcaacataggacagagcagtactgtaccttgaagtctctttccacacacccatctccatccttacatccacaacacgtcgccaatcctcattggcagcatacaagtttgacgctagcacataattccccccgtattcaggctccatttcgatcacatgatcgaccaccttcctcgcgagaatggcatttcctagatcccgacatgctccggtcaatacacgccatattacagggtcaggcctcactggcatagccaggacgaactcaaatgcctcttccagcataccagatttgcacagcaggtccaccatgctcccatagtgctccatccaaggtgtgatgtgatactcttcaaccatagacttgaacaattggcgcgcttcattgacgagccccgagtgactgcaggcattgatcacgctcaagaatacaagttcatcaggctggaaaccttgtctgagcatctgcgaaaactggacaagcgcagccaccccatgcccgtgcacggcgagggcctgaattatggctgtccatgagaccactgtccttacagtgatcgagtcaaatatctcacatgatctccttaccctccccatcttaccatgcatatgtatgagtgcgttggcgacacgggtattctccaagaacccattttcatgggcatactcctccacccactcccccagctctgacctgcagtccaacattgtgcacgctgagatgactgcaagaagggttacctcgtcaaccttgaccccagcaagcctcatttgctcgaacacttgcagtgcctctgctggctttccattctcgcagcaagcattgatcatgcaagtccaagaaaccacgctcttcatactccctatgctgtcgaacaccattctcgcattcaccagccggccgcatctcccgtacatgctgaccaaagcattcagcaagggcaaatcaagagcagcgagatttctcaccgcgtagccatggatctctctcccatgcaccaagctcctcagccgcgcgcacgctgacaagaggatcgtgacggagacgttgtcgggccgggaagaacccgcccgcgccatggtggacgccgtcaccaacgcgtgttgggggagcccagaacgcgcacaggcagacaacagggtgttccatagcgggacgtccgggcgggggatttcgtcgaacagcttgcgcgcggcggcgaggctgccggaggccgcgtaggacttgaccagagcggagcaaaggtggagagacgaggggagcacgccgagcttcagcgctcgcgcgtggatttggcaggcggacacgtcggagagcgcggcgaggatggccgcgccggtgcgcaaggctgcggcggcggtggcgctcatcggtcatggcggcggcggcggtggcatttgcaagaaaagcacaagcatgtttggaaaattgtatattttgcgggtctcatttgcaaagttacccatctaacgctccccgcctcaatcttgaccgctcaaaatggatcgaacggtgttccgggatcctagagtggaccagaatattgggccaaagatgcaggagattacatggcctaatggctaatgcctaatgggcttttgaactagagtcaagttaggactgcttaaactgttttactgtgtttgactgaagatcacatactgtacttatttgtgaggatgagacatacaaaatatccataaacaagaacataatactcctgtcataatatttgatgtttagtataaaatttagtcgaattttataactcgagcaatcaattttatatttaaataagcttatgaaatctaataagctcatgattttatgatagtaacttttcaaggcaaatatctcacaattcccctttgttttacaaaccaggcatttgagagttattgattgatagagctttaaaagtaggaccaaatcttgttctaaacgttaaatattcattatcgactatcgagtcgtgtgagtagcccatgcattcagatttggacacattaactccagatcatttcatagaggcttcaaagcccacatatattttacagccaggagcacaagtataacaacatggaaatacagcatcgtactgactattattttctttctactaagctacaaaaaattacagcattcctcagcttgaagctttcagaggcagacatagctctagctcacctggagccacgggggatccact

SEQ ID NO: 64618 - DNA, 1622 bp, Oryza sativa
cttcccctggaatatgcattgccacaagagaaatatattttaggtaagccacatgattgacaaacgtccatatgaattaccacatagaacaatcaaacatgcaaggaaaatttcaatgcaaccataacatgcttaaaaagctttgtatgcttcaagggatataaaagtacagcaaagcttaccagcataattggcttcatcagttccattaggcgcccatgctgcccatataagattgccaggagcgagtatatcaggctttagaacatcagcatcttgaaagctaaaatcttttacatccggtcctcgagaagagaacaaggcaacctggggggcagagttgtatagagttggtgccaaaccatctgcaatagctgctgttgcttggaaggtcgtggcccttcctgcccaatctcttattgtagaagagttgtagtagtctataagatcctacagaaccaaaactaatgtcacctgactatatcaaaaaaaaaacgtattatctaactaacatgcataggttttccctactattcaattatcatgtcatcctacaatagcaggcatatacaattcatgtcactgctcttgaagcatgtacattctaggggactgactttctgagagtagctcgactaaaaaagaagacaactatacgagaatagtttgtgggcactgaacagacaccaaaactagatggatggttacacaagagctatacaatccactacgctacataaatagttttttctagttcatgtttacataagacgtagccagataaaagaaaaacattccagataaaagaaaaaacattagaatctgcagcttttcaatactccactcatggtgttctgcctacagatggcatccatgatatctacacactgacacttttggggatgcaatacttcctccgtcccaaaatgtaagcattttttaggttggcacgggtattaagaaagtatgtgagaatgattgaagaaggtgtgtgattggttgaaaagagaaagtaggtgaaaaagaatggttgtgattggttgagaggagaaggtaggtagaaaaatagcttcattttgggacaaagtactgtgctagaaatagctacattttgggacggaggtagtacctttgttctgctgacatctgtgatgagaataccaggcatgctgacaggtacaggatcaaattttgttcctgggtaactattctccacagcaacaataaaaccagctgcaccaagactcctagcagtctctgacactttcttgatagaagctgtcccagaaatatagttgaaagaatatccacacaaaagaattttgccctgaattttcctcttattcaagagttctggcctttggcaatctaatgcactgtacttggtggcagatgaacccagcagagcatcagccgcagaaatcaggctgaatgatttattctcatgggttgcagctgtagccaaatgagaaaactgtaaattaaccacaagtagaaatttctatgtaactgtcagattgcctgcatttgttgacatgattgcaatctagtaacatatttgctatgggatgcagtaacatatgacagtggaattacaaaggaagaaaaacagaggattgtct

SEQ ID NO: 64619 - DNA, 3395 bp, Oryza sativa
ccctcttcccaacccatctccctcgttttccgcgtgcacgcttttcaaactgctaaacggtgcttttttgcaaaatgtttctatacgaaagttgcttaaaaaaaacaaattaatccatttttgaaaaaaaaaatagtaaatacttaattaatcacccgctaatcgctgctccgtttccgtgcgggcacttagtgttgggaaccaggggttccgaacacaccctaagcgcagacaacaacattgagtgatttttatttatttatttattttgggggggggcgaagttaaaaggtaggccacttagcttaggtcattttaattcattttgtacaatttttgttgcccatgaatgcatataccatacatgtagtaatagaaaaccaaaatttgagctaaaatacatgaataaacagaacttacgtgatacaccaagtccaggaagaagtttcccatttcctagcaccaaatgatttttgtatctgcggtcatcaactccagcagcaacagtggttatccatgggctgaatgataccagtgttttcggaaatggtcctccatttcctgctgcttgggcaacaaacaccccagctttcacagcggaaagaagtgcagcatcaaaaggattcaaaaatgtagtccgcgtagcagttggcgggctatttgggccaacagaaaggttgagaatgtcaacaccatcctgcacagcctgcaaaatgcagattgccatccatgcattagttcctacatattgaaggcttgtgatagtgacatgcattacataactggcagatgttgtttcactcatttctgcaatagtctatgaagaaaacaactactatggcagattccagaaataattgttttgagtcactattgtcaggtactaagtactaacatggcagcacctgcattacagtggaaagaaattcagataagtaactcatatgttatacctgatcaatggctgcaacaacatcagatacataaccaccaaaaagcctgtaaaggactttgtacacggctatcctgtcaatcacaaactcaggaaaatcacaatccggaaggagagcaaaagcaaaggggaataatagatattgattaacaataacggcaagatagaaggaagtgaatttcactagcacaaggctcacattcattgaggtgatttttgtgcattattcttagttgttcaatgagatcttgaaattagaaaatgctgaagaaatggaaacttacctagcacgtggagccataccacttgctttgccaaattcgtgaccatgcattcgtactggaatcccattatttccagcagcaattgctgctgtatgactgtttaagggaaagcatctttgtatcagataactagataagtcatgccattcttctcaagatgaaacacaaccagaatagctaattctttggacagaacaattttcatgtatggcatttttcttggtataagaaactagaacagaacatatattaattaggagcatgaccttccatggccatcgccatctaatggagatgcaaaatcgacatcaggattaaacgctccagcagcaattgcagcttttgcaaaatgctgggcaccaactatcttcccattacaaaagcttcttcttgttactggatccatctcacatttccccttgtaatgaggaacaggcccataaggatcagttttgtgggcagagaagcttggatgttgggggtaaattcctgaatccacaaagccaatcacaacatcttcaccagctctatcgaagccaccacccgttggccatacccctgttggcaatccaagaaattgtggagtgtgtgtcgtcaatttctgtatcttcatatctctctccacatgctttactcctggggctttccttaggaattcagcctaacacagtgaaagattgctgtgttcagccaagataataatcttaaaccaggaaagaagaaaagatataaaaatgctaaatacctgtaagggtgacatgtgtactgcaaaaccattaataagatgatggtagctataaagcttctcataagttccttctaccaaaagtgagtctagaagcttgtcatggtaccttcgtaggtggagtgagtatgaagtcacagcctcactgaaatcagtaaattgcacatatacagaattgtcatgtttccaccacaactccacaaatacaagcaagctgtgattaaaaacttaatggggggataatcaatttcaatatcagagagctgaaagacagtaacagtggtgaccttttttttttctaatgaaggctttcgagcagatattcttaacatgttggaagactcttaacagctcaaacctcacacactacatatatgatatatcataatgggaagaaaatggaatccatttcaagaaacatttaggaggtgcacttcctcagtagcaagctccaagtgcaacaagacatgtgaaatgcaattcaacaataagaactaacaagtccaatatgccatgcaacccaacatagactccacaaattcaccaagagtcagccaacacaaaataaatgttcgaaggcatggtgaaaaaacatcatcaatagtaaactacctggtaatttccatatcttcatccaaatctatggcggttgcagggaatccttcaactccacctctgtagctgacaacaggttcgccttccattgtaacaatgtacacatcatgtgttccaagaaccacttgtggtacaatgataagaagcaaacacgcgagctcaagcgccttcatcttcagcaatatccgaattgccacaccacagaatcttccaaagaatggaactgtcagggaagtgcacttacaagttacaagtatgcatgacactagacatcaatttgatggtttgggagagtcaagagtacaacaactacaggagtacaggactgcactactgactgagtaaaatcactcactaccctagtcatccactactggtcccggcagtgcccacaatttctttgtgatactggagttgcccacctcacaagcctctcatggagcacgcatttacggaaccttattaaattagggcggccgatgacattaaatggctcttcagaacgattatactctacagtctacactacaatatagcgtactgtaaacggctagtctgtgtgtactccgtatgcattttaatagctgcattttctttagaacagattgattttgaaatgaaactaaaaatttataccactttgctaaaggatcaagcatgagttaagatctactagaacaggctgaacaaatattatctcactgtaaccaatactgcaagctgctaaaaaagggtgaaacaacaaaatcaaagatcaatatgaataatatcatgatctggtaaaaaatacgggggatcc

SEQ ID NO: 64620 - DNA, 1540 bp, Oryza sativa
aagaagattcagaaaggcttgtctcgtggcatgcagcgccggtaacttttccaactctacagctttgaagtgtttattcatgctctttttttttttttgctggtatattactctctacttaattctgaaaagaagaagaaaagaagagaagcgacgcatggctaaaaatttcttatatttacttaaaaaatctggaaaataagtcttcctttaagtcacttgtcactaattagaaaaaaaaaggaaaaaagaagagaagcatatcaatgttgtctatcatctattaaagaagtaatatatattatgctaacttcatgtctgaaggaatagtgatattttatattctgcatgacaaattgtcaatgttgcttacatgagatcatttcgggtacgaccggtattgtttactcctcttacgtaagttgatcttctacctaacaaagcagtcaaaaatctgcgtcagttgctgagaaagtcctcgccttccatatccgtttcccaaccagtggatcagtgttgcttgccactgccattaaaataaccccaaaattcagaaaatttgctcaaagctaagctaccgcatgataaccctcagagacttcacacatctgttattctgtttctccttttcaggtaagaaaaaaaaaacggcaccaaaggaaaagacctcctcgagatattataactaagaagaagcacctaaaacgggcagagatattttgtttctctttttcaggttctgacttcactttgcactgtcagtttaccaaattagcgaatctgctgtgtgttgggattcttgatcattctgagtgccacacactataaccgtacaagacctggcaaagtcctgaaatagttttgttgagatggacactgaatttctgaacaaaagtttcagtcacctaagcaagcagtagcagtaaccatgttcagagattcagaggtggctgcaacagttggcctaataaataaaaaagctaaattagtcatcaaggggcgcaatatttcgagggtgagtcaactaacatcgatgacaatgcaagaaaacgagcctccaagatttctccagattgccttgaagctgatcaagattggttgggtaatttgcacgaactcagtactttttttagataactgcacgaacttagtactggatacatgacagattaacaggtgttttttccctaatgaaagagagattcagattgctgtctgaatctgaaatctgaacagcaaggatacggaaactctgaaagagactactcatccaacttgatgtaagtacttgatactaatcttggtaagggctggaagaattgcctgaagattggcacatgtacgttttcctctttgaaattgtcgccgggttatcgtcgtagaacgctgtattctatccattttgacgaagacgtgaagaaaaacggtgtctgtaattttgtcccaattgaaagaatacagtggcgttgatgttgtacttgaacaataataatggctgcatattttgtgtagcttgtgtagtcaggttcaggtaactatt

SEQ ID NO: 64621 - DNA, 3839 bp, Oryza sativa
caaaagtgtatatgtatctatgatgttggtatttatttgccatttatttgtaggtaaatatggtcaaatggacatcgactggcatatttaccttcgttccataataattttacttttaggattcaaatctatcttaaaataattgttaaataaaatattaattgtctcataattacttctcatttaaaattatttttattttattcttaactacccttccacttttacttatacgtcatttaatgaggggtattatagtttttatctcaaaccttaatatatgctaaataacatagacttgtaattattttacaacggaggtagctagtatccaaaactacagcggaaattatgtgccgtaagcacgtcagttatctgtggttcctgctgtaagtggcattgtactgtaggatagggtgtagtactcgtgagctttttgtcaatgtgtaggccgtttatccgagtattctctctgtcttaaaatataagggattttagatggatgtgatattttctaatcctatgaatttggatatactctatatccagattcattgtactaggaaatgtctcatccgtctaaaatcccttatattttaggatgaagggagtactatccggtgtatcaaccaagtgagaaaaagatatttttatgaaaatatgtatgtcaacaaagtgaagaaaatatatttaaaagtaaaatttgtttgttttccttagtaatcattgggcttaccatgggaaaagggtaatccctcaccaaagaccctggtgttacctaattatggactttacatatgttgtgacagttttcaaaatgtatatttagtcactaaattttattataagaaatttaaaaatctcatgaagttatgattctaatgccataagtttttcttacaatttaacttcaaacttgttcaagatgacatgttattttttatcattttctggaacaagattgtcgatgtccccaatgtagccggatccggtttgcaacagagagatactttgtttgtgccgatggaaattactccattggcttacttgacgtcttgacgtgttgaccaacgacatggccaagcttcggcttggactcttgttggttgaaacgctcaaatcaaatgtgactaactcaaattacacgcgtttctacacttcgctgatcacatattcatacaacaaagtggtaattaagtctaaaattagctgacaacttctctctgtttaaccagccagccactgcacactgatcagatcaagatatatacagcacaacattactgatattattatatacatacctgctgcattaatttttcttggaccaaaatgctccattaattttgacttagaaatacatgcgagctcatgagctcgtcagcttcacttcacagagacgaccatggcggcatggcactcacgttgtcggcacctgccgacctaattctcattcattcgttcagtttttttttccttctctgaccaaaaacaagaaattcagttttgagtgtagctcgacaaagatcgataattcagtcagagttttcacggacggtgtttgtctgaatctcttcacctcttcaccaaaacgacatgtttttgttatgggtgtgatgtgagtccttaacttctcatggagaaattgatatgattctttgtattcgcttaagacatcattggtcgatgatttcagagaacccggttaattgattcagacagaaatggtttctttgtatcctttaaaacatcatggtatgcatgtgtatactgttagtcagattaagcaatggcaactcagtctttgtttaatcatacatatgtactcctatttaccgctactgatttgattctcatctctgatgaaacaataatgaccttctatcaatggaaaccaccggcggcaaagcaaaacggcggccagtttcagagtttttctctgaaacatacggctgttttttttttcatatcgtacagtacatagtccttttgcagatcatatgtgcctttcaatctgtcattgcagttcgttccttcttgactatgtatgcatccatatgttcgtggtgacccactcgggctagctgaaagtctgaaataaagtaggagtagtagtattcattgactttaattttaatattcagagaaatataatacaacgatctctctgacttgcgacttgttgatatcagaaattagtatactactgttgcctgtccaagtattcaaggaaaagagtaaattgcgttcacgatatataaacttgtatggtgggtgcaaataggtacaataacttgtaaattgcttattccggtacaataacttggctagttcatgcaaagatgggccaaaccaatccacacaagtaaaattgatgtaatatgatacgtactagtgtgtaattattgttacacatcaaaattttttactgacacatattattagtcgcatgatactttcaagatttagaccaacgaaaaagcaaaataattaaaaatacctgattgttaaaatacactttcaatgaaagtgtcagaacatgaacatgaaaattaaaattttcttttagtagttaatagtacatataacaattgtcttggtcttgaacagacaaataaaaattagacgagttatatagatgatcaaatttttccaaaaaatgaaacaaatattgtaccctggacatgaaaaataaacttttgcacatttttatttggattcgaaataagatctccaaatcacagttatatgtatatgctgttatgtcattagtgtgcactaatttagagcaattttacttgtgtggatcattttggcccagttcgcaccaactagccaagttattatatcaaagtgagcaatttgtaagttgttgtatctatttgcacccaccacacaagttcatgtaccgtgagtgtaatttatgttagagtaaattacatgtcaaaataatccacacaagtaaaattgctctaaacagtattttagagcaattgggaaaattttaggcatctgatttcacaatgaatggacaagatcgttccagcacagcacctataaacagtattttactgtgattttcactgttactacggtgcctacgctgtaataacggtaaattctagcatgaatgcaagtataaaatggacgattataaaaacacatgaacgatcttttgattagatcgcatgaaaaatataggaatcggtgtcgctctttgtttcagcgataccgttcggtctcgctcgttctttccgcgagagcgcgcggtctcgcgcggcttgcgccgcgcgataccgccctcgacgtcacgtctacgctattttcgctcaatggttatgcgagatcgacatcctgaatattcctgaaataaaattgaatgtgcggtatattttcaaatttaattccctcggcaccacccctgccggcaagcatgactcagtgactcctcgtctctaatgtgtgggaggatggggggcaatgttggaagggagaaaaaaattaactggccttgtgtacctttccaaatcttccccatatagtagtccttcattttgtgggtggaaggtaagattcagcagcacacatcttgacacacacggacggcgcagatgaattcgggcttactatatataatatacacacatacatgtctttgtcctaggggtgtaattttgacaaacatgaggctttgtatcatatgtgtaattaatttgactctaagagaattcagttgcataagttgaactcttgtgtgaaaaggtgtaaagttgattttgttttctttctttacaatgggcttggatcaggttgggtttagtaggctagatatctctcct

SEQ ID NO: 64622 - DNA, 1302 bp, Oryza sativa
gtatattatagaagttaagcaaagtgcgatggcatattagaacttgacaaacctagtgacatattgttgaataaggacaaaatcaataacacacgatggattctctatatattttatggttgtttagttcattacctatctactatcgtgcgacatttttataaaaatttaaatcttatactataagctcatatcttacacattaaattacatacacttataatataattttcaaattataaaatggccctcttcacattttataggagaaatatgaaaaatgatttattatctatttaattatgagaaaaaatattagtccaaattaacgtatatttagaaaaaataacatgtaagaattacggaaatacctacaatcgtatatcatgcagtgagagaaggagaccacaatcgaatgctttattgttgagcaaaattgatggcattaattttatctttttttagctgaatctatctaaccataattaatcagtccgtgttagtagaagtctgcatcttcatgcatcaacatatcatgagactattagtaaaagccaagtacactgaccccacaatacttaatatatcacaagactatcaggtaatggacaacttatctttaattatgctaaagacttagtatatcacaggagtatcgggtaataatagacaactcatctttaattgtgctaaagaaaaaaaagtaaattacagttcgtactatgtattcttaaaagttttcatattatgttatcctttaaccattcttttcatttatagaacaactaactttacatttcaatttagaccaccctatttcatccatctccaggtctagtgactcagcaaacacacactaactctctctctccatttttctttttccctccgtgtcgatgatatgggcccaagggcatttttgacatttcacgcgatttctctctcctccctaactggaaattattattttaatcggcgcggtgtccactggtaaattatcacgtttatggagtgttttccccaaaaagtgagtttgggcagtgtcctagggctaaaaccacacataagaagtgtcctgtagcaaaatttgccttatttctgttgggtgcttattgcttagtaaaattcataaagtttagctccaaaagaaaacagtaaaaattcactgtatattgcactttacaccgggtagtagtatgtttctttttctttcaccaaatttagcatatattttcactttacaccaagttatcttaaaataagttccagttaacatcagggtacatcaagaaccctataaaa

SEQ ID NO: 64623 - DNA, 1626 bp, Oryza sativa
tattttctatgcactagaaaaaatacacgtacgttgcaacgggtgaagattattttaatcttgtaattgttatacggtttagctaatcttgtaattgttatacggtttagctagggtgaaattcaccatggaagttcgcttggatattttattttagaaaatcatgagatgtagttaggagtccgacttttatctcaagttagcatgcgagttttttttaagagattgcttatacaactcattttgtatttccaaaagcaaacgaacttaaaatttaactcaaatacggatttgtatttctataaacgaataaacttaaaaaccgactcaaacatggatgatataccaaaatactggtaaaaacatctttaatttttataatagtagacatatgcagattaacaacactgcaaagacacacgtgtgtgatgatagagttacgggtgcataatttcatccaccaatttcaatttatattattttcgggttacaagtattttttaagttggtacagagtctaagtaaagagtagaagttatatactatctttgtaaaagaacacatcgattgagaggggataagggaaataaggtgtaccatcactattccttgctggtggtgcatggcaagatatggaagtggcagacataagcacaagaactgccaagcacagaaccatcatgctattgttcttcatgagcgccatgactgcaatggtatatgtatgtatgtagtcactgtgattgtgaaatggtatttgttatatatagtgtgtgtatatatagagagaggtttggataggctagctagcacattaattaattcatatttttattattttattggtactaagtgataatgcatttaggcatggatatcaatgttctgttatagtggtgccatttatagtgtatcctccatatctgctaggaaataaaagaaaaatcctccagatatgctagaaaataaaagataaatccttcaggtcttctagaaagtaaaaaagataaatcctccagatctgctagaaaataaaagataaatccttcagatctgctagaaaataaaagaaaaatcatcaactatgggcctggttcttcccacgcatgggctatagatgggtccaaattagactagatctaaattcattaggcttatgtgtttctccaaggggagtacctatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaagtttcataaattacactgtaacttaccagaaaatgcactgtaaatttgagtaagaaaatcgagtgagagataagaaaaaatctttcgagtgagatatagcaaaatcgttctccaagtgcatctttctttttgtttggtgcttattgcttagtaaaattcataaagttttgctccaaaagaaaacggtaaaaattcatagagtattttgcactttacaccaggtaa

SEQ ID NO: 64624 - DNA, 1311 bp, Oryza sativa
gaacaaatttgactgctctttcaactgcaaaccatgcaacatcttcgcgaaaaaggaaaatcatttgatgttccaagagagatcacaaaaaacaattcagcgagtctctctgggtttctgattttccaaggcctatactgtagtgttacatgcaaactaggtttttgattcatccttcccttagatgatagtgaagtttgagaaaatgttcatcagattgtcgagtgcctcgggatagaatttccgtgcaaataggtagcaaggcctcttcatgccattccataggcacggtcttctcatcacttggtgctgcaagaccaaacaatttatcaaaatcctcctcaaaagaattgtgaaaatgtgaaaaaaaattaaatcgatttgtagaaacagtgttgattcaagaaatttgttcagccagtcagtcacattagaatttcaagttaaatctaggtaggaacatgtcaaatatgcatgcagtaaagaaggggagaacttgttcagtctcacagaactaacttgaagattctagtactagaaagcaagaagaggaaaagatcaaataactctacctttgcattgcttgtaacatgaatactctcatcaatggactgcaaaaattcattattaattagacaaatcccaagaatgcagatttttgcgaaaattggccattaaggaaataagacatgtatgtttccccttcttttgcatgtacaagtataccagaggctcaccgaaatattcttaagcagttcaaagcttgtgtcaacagccctgtaagctttaggatgccattttccttcagaccaatcaacatgtgtcactgaccaatttgcaattccagttggatcaaccatctgcaggtacaataacggcctgaaatcactgggaagtaaacacaactgaaaaacatcatttaagagtttttgagagttcttacattaaagagggttggcaaatagtgttcatcagaatagcagttatgccattcgtttcccggctgcaaaagtgcaatcacaagatcagtaaagagctaaaattcaggaaacaacagcaattcagtggtcataaagatgtagagaaatgaaccaaagcatttcattggtcatcggaattgattaaaaacaatagtagtacaagtcaaaactcaaaactactgtgtaacaaatgcagtaaggggatttgcactcgttatggtttaccagtgctagaccatataatgctgcatggtgtgcagaaaatacaaagtggggctttctatgtgcattcactgaggaaaaatcacaaggacagagcaagtagcctagt

SEQ ID NO: 64625 - DNA, 744 bp, Oryza sativa
tatatattacaagtaagtttaataatttataccctgggttgcctcctctaaagtaagaatttgcaggttgcacgcagtatttgtaagaacaccggattccttcatacttgagtttgtaggttgtctttagaatgtagctgagcgtgtaaatcactgcatcttctatcgtatcttgaatactaaagtttactaattgtttgccctgaattgttatattttcatgacgaaggagaagaattgatagtttattgccgctctgaataacaacactactagtgctatagctcagttctccctgatctccaaaagtgataataacattcattgaagcattatatagcttactatttgcaattgttaaaatataacggaacttatcaccacatgcaagaatgattccacattgagataaatcaccaatctgaatcaacacgcaacagtttcgacaattctcatgcttttaacgcatagcatctccgtaaacatcctacataaaagaaaaaatacctttgctggtcaaaagtttttacagaaaattataacaaatacaactttggagcttgtaaaaaacaccagatacaactccaatatgaatcaacacgcaacagtttcgacaattctcacgcatagtatctccgtaaacatcctacataaaagaaaatacctttgctagccaaaagtttgtagagaaaattataacaaatacaactctggagctcgtaaaatacaccagcacaacttaat

SEQ ID NO: 64626 - DNA, 1503 bp, Oryza sativa
cttagcacacgtgtcgatcagcctctgtgtactggatctgctgttttgtgcttcttcaaccaaccttgccattttggccaccgcggagttgtcagccatagcagtcgtcctcacagcaatgtaacctgatacatcaccagtacagaattgatacagaatcaatagcacaccttgaaattttaggcatatcagggacatcaaatcaactgacagttcatcatatattaccgtcaatgttgagtgtgccagcccagacctgggagtctggctgcttggacactgggaaggactcccccgtgagggtgctctcgtcgacctcactacgtccatcaacaacaacaccgtcgattggaatgacttcccctgccttgacagcaattactgtattgaccttcacatcccgggctgcaaccacctccccggtctctgccagaatagccttttgtggtgccatgctcattagagctgacatcccagcggtggcctacatgccaaaggaacatttaattacagagattaagtaaagagaacaaatataactaataccaatatacacatgtgtgctgactattattgccttttgaagactattgttttagtagattcaccttgctttcctagatcatgctttatatacgcattatgagtgtagatgcatgtttgagtccactagatacaaaagtttatttgtctttcccttgacaattttggggtgggggtatatgctaaaatgatgataaactgataactgatgatatatgagtaacatgggcctgattctggtccaaccagttcatcagtccaccaatcagtggggctagtgcacatccaaatctataggcccagtatgctgcattagcatgaatttgtgcccataaatgtgacacgtcataaacaatagatccttctcggttagtggcctgatcatgacctcagcaatcaaacatgaatagtgaggcaaaataaaatagctaaaagagatggaaatagaccttgtggctggccctagtctcaagccattcagctgtagtgaagaggaagacgatgaacccagcctcagaatagtccttgagagctattgctccagcaactgcaccaaacaaaaaaagtaagtacagacatacaaaactctgggttttgtgttgtcatccatctcctaccaaaattgcctggatttaatggcatgtagaaagtaatctacccataggtgctggcaagatagcatgggtcatccaagataagaagatagtgccaaaaaggatatagaaatcacccggcgaaaaaaggatatagaaatcatggttcatgataatatttgttaaaatataagatattcacatatacaatttgccttcttcttagtagtaccaataaaaccccactttttcacttcacttccgtgtcaaataaaacattatatacagaaatcatttgatatattcacctaactaagaaaaccagaaatgttgtcaacatacgacaaagaaaattcgcactttcctt

SEQ ID NO: 64627 - DNA, 736 bp, Oryza sativa
agttccttgatgttctcagctgatccagttcggcaggcatccgatagagtgaatactccaatcaattcattgttacatgccacatatccaatggtaactcctttcatatctttcatgtccggaactacaaaaaaaaaaaattaaaaagataaacatgagagttacaaaaacgcaagactgttcaacaggatatctcaaagatcatgttttggtcaaaagaaagtgaagcaaaacctctattcacaattactagttctacttaatattcctgaggcagaacaattttatttactgttggagtgatatttttcttatttaacaacaaattcaacagtgactaaccgtaaactatcaacagtgttctaccacatttaggaagccttttaatttcaccaacctgtttcgcatgaagctcttgacaaaattcttttgttcccaatatatatgcctgctccgtcgatttcaccataaatcccctcaccaggatatatttggaattcactaacattctctgattttggttccacagactttgattgagcataatcaaccaggacagatgccatggggtgacttgatctgctctcaacgctcgagaccctgtgatatccatataattaaatgcaatacacaagaagaaattttaagtgaaagtttcgacgagtctcaccagtaaagaagttgtgcaatgaaacacgttcaccaactggctggaactcctcaacactgaactctc

SEQ ID NO: 64628 - DNA, 2636 bp, Oryza sativa
aaagactgccaccttctgttctggaattttgcagcaacttgactatgctgtggttgagtgccaggccttggtccttgctcctactcgtgagcttgcacagcaaattgagaaagtcatgcgcgcacttggtgactatctgggtgtgaaggttcatgcttgtgttggaggtacttctgttcgtgaggaccaaaggattcttgcaagtggagtgcatgttgttgttggaacacctggtcgtgtgtttgacatgctgcgtaggcagtccctccgtcctgattacatcaagatgtttgtccttgatgaagctgatgaaatgctttctcgtggtttcaaggatcaggttagcattatcttagttgtttgtattttgcatttggtttgcggtttaacactatttagactttctgagagcatgattcattaatgattgtacaattcttaatatgattagagttagatttcctgggagcatgtttcattgatgttatacaaagtctactaaggttgatgtgtcaccaaagatctcaatttgatctcaacttagctatcctttttgtgttatttaagtaactaattcttttagaatactaagcagcaggaaattgaaagtagttaagccagctgtatacgtttcatctctttatgttatgttattggactattctgaaaatctgtttgacatgtttctgttattccttctattacgtgcttcatatctatagtaatattaatttcccttttgttatttgcagatttatgatatcttccagctcctcccgtcaaagatccaagttggtgtgttctctgctacaatgccccctgaggcccttgagatcacccgtaaattcatgaacaagcctgtgcggatccttgtgaagagggatgagctcactcttgagggtatcaaacagttttatgtcaatgtggagaaggaagaatggaagcttgacacactctgtgacctgtatgagacactggccatcacgcagagtgtcatctttgtgaacacccgccgcaaggtggactggctcactgataagatgaggggcagggatcacacagtttctgctacccatggtgacatggaccagaacactagggacatcatcatgagggagttccgatctggttcttcccgtgtgctcattaccacggaccttcttgcccgtggtattgatgtccagcaggtgtcccttgtcatcaactatgatctgccgacccaacctgagaactacctgcatcgcattggtcgtagtggtcgttttggtaggaaaggtgttgccattaactttgtgacccgtgacgatgagaggatgctgtttgacatccagaggttctacaatgtggtgattgaggagctgccggccaacgtcgctgaccttctgtgatcaagttcagaagagttatgttaaggggcctgataaggattgtttttgtctgaagtatcactgtcttatctggggggggggggagtgataaaggtgggggttctgttttaaaagtcactgtggtcgtagacaatttccaaatttttatgccatgttatgggaatttttgtagttgctaggctgtgctatgtgctggtgaggagggaggagtcttttacttttattatatctattgttaaaactatgtatgaccgaatgatgttatttatttgtgtcatggttgactatttgccatatgtattctgccaccggtcctgctactgccactggtatctcgagtgaaaactgtttgctcctcggtgcaataagccagataacatgtcacctaccggaatgccgttgatgtctagtgatgttttatctgttgatatgcatgtttggttggatacttgcctggacgattataataattttttgagatgttggcttcattttggtgagtgaaaacattggccagttctcttcacaagggaaacaggttttctgtccatatttcgactgaaatggtacaccgtcaatcgcttgctgtaatctgaagcattgtaaattattggaagcatagatgtcaaggtacaggtaatctgtatcctgttagatcagcgccatctctacattctactctgtaaataaatggttgcatgagttgaggtcccagtaatagctgagaaacggaaataatagtaactgactcttttttactcatcatcgctgccaaatgaactgacgaaagtatccggaattttagttagttttctgaacatttctcaatcttagctagatgggaaaattgacctttagtttttctgcacctacctatcatcactgctaaatggagagacgctaaccatgaaaacatccaaacatttagcttgttggaaaattcaccttaacttttctgcactcgtagaacattcagcataccctgccaaatggagcaagctaaccatgaaaggcatccagaatttcagcagtttttctccctgaatttctgaatcttagctagtttggattcaccttagcttttctacaccaccagaatttttcccctccaacttaacaacatttggatgacctccttcggtcatcccgacaaaaaaacaccaccagaatttccaatgtattatcctagagtcccgctccggtgctttctacttggaatagaaagcaatctgagccgttcatcatatt

SEQ ID NO: 64629 - DNA, 5022 bp, Oryza sativa
ggccagcagaactccatcaccgcccagtcccgcgccacaggcttctcgttccaggactgcagcatctacgctgacaccgacctcctccgcggtgcccccgccggcaacagcgtggagacctacctcggccggccgtggcatccgatcctgagcagctcgccattctccgacacagtggaaaactaatggctgattcctccgacactatggcaagaacttgccatggagctcaagaacaccctctcgacctcttcagaggcatctctgctaatcaagcacatgacgtactccatcactgatgcatcgcacatcaacgtgatcctgccatcatcgccggcgaagccaaattcctcttgagacatggcgaggagctcgccgaaaaccaccgtgcgaaggtacaccaatggcaccctcgaaccgtgccccgtcaatggtgtacaccgcgctgtggcccttgtcggcgagagacgacgacaccatgctgcagcaatcgcctgtggtgcctgccgtgcccatccaccgaacctgatgcgatgcgaaccgaacaaaacatctcatgccaaaattacccctaaactatattaggagattacttacctgcccttttaaataaacggtcgagattaattctacttgtagtagaatactgcaagtagagtgcaccggagcatcacccattatcctaatgttgggttctgatcacatatgagagcctgtgagtcagtgagccactgctttgcagcagttgatgctactacaatgtctcattcctcaaaaccatgctaacatgtgggctggttcataatgttaatgcactcactatatgtacacatgatccacaagtgcatgtgtagtgtgtctgcatgatctgactgactgaactgattgattgatttccagatgtttcatgctctagatcatggcagattgatccatatgttgactattaccttccttgtcgatgccgacgatgatccgtaacctcctcttcctcagcatcctcgtcgttttcgcttttttaacttctttatcctagttcatcttttgattttctcctttgcccaactagctttccttaattcattcatccatccacgttctttgtacagtagatatagagctctctttttttctttcttctttttctttgggatgcataaagctctctctactccaccaattaatccacatatgcagtcaccatcacacgtaatcttgtgcaaacgtctggtacaaaccatttgaacattctcttgctatattttgcgtgtgattaactttttagcttgttatatattctcttgatgaacagactagatcactagccgatagctgccttggatgtgtagacaaataacatgtcacccattttcttttattttttgctgaagaatgtagtaataatgtatgcatcgatgttgatgtgtaacttccatgacaacaaaaacccggcaatgctggaaatttgtcaaacactcaaaactttttatatatatgctcttcacatcgaataggtcagattcccaaccgaccacaagctgcaaaaaggcaaataatatcatcttctaagattttctgctgaaagttaatgaaaaatgtgagcatcaatagatgaaaatgaccaatcacatgtatgctcttcagaaggagagaaaagctgaatttattggtaccagaattagtttcagagttagccccactgcagatggggatcaaggaggctatagcttagagatgacccaccctaaatcacatccaaatctcaacactgctttcataatgaacagtcccaacagtagagctgtttcattcttgtccctctactacaaattgatgatcaaagtctcaactttagtttcaacatctcttttgaaaagaaaaaaaaaagaactttaatcccaacatctcttggttggttggactgatgcatggagtggatcatctttctatatatatcttcataaatttgattgttcaattcatcagctggaaaatggtaataaataattgatttaccatagttttcctgtgattaatctaattgtccttctatatgagttggctctatttagggaagctggagattgagaagctgctggtgagtatccagctagagaagctaggaaacccaatgttatgctaccagttcattttttgctacccgttttaaatgttattcttttttcagaacttttgaaattacatgcttgtaggcacctacgtatacgcaaggcagttagctagtgcgatgtgttatttgattttgatatgctgcatgattcatcgtcctcttttcctagcttttattttactttcttatatatatatatgtacacctaattgattctcaactatgttatatatttcgataagacaatatacctttcacatcaacagtcaacaatctgaattaattactatataatattagctttttattggtttgcctgatctcacaaagtagcaggctaccgagcatatgaaagcaacttgaaaccaatgtgtatcctaccttttgggaagatgggaaaaatgaggaagaaatatggtggtggaagcatgaacttttaaggcagttgatagaaagattcattttagtaatatattgcatattgttgctagtgggctaattatcagatcacttttgatcttgcagctagcactactctgaaagtgcttacccttagctgataatctttttggcttgttagcattagctcattagagtagatatatcatatatataaggcatatagctagtactaataatgtactagcaccaatccaatgatatcatctttaagttgatttcaatgagatcaactcatctctgatgtcacatcatagggattaatcggtcaatgcaatatttcccaaaatgcattatgcatgattcatgccttcaatgcttagacctaattagtccattacctgaacatatatataggatattaggctcccatcatgtcacataacatttagtaagacaaaaggaaaaaagttcataaggatccacttaactcttccaaaagtttgatcatttcaaccaagcatcgattctgggcaagaatcaattaaccctcaaaacatcaatgccgttagctttacatcattgacaccaaaatcacagtgatcccagagtcaaaaaccattctttctgaagcttgcagggatggacaatggaatttctctgaaaacaaaatatttccttggaattgaaacatgtactgtatatattcgtgcatgcacattgtcatgtctggttaaacatagtactgcaaattaatctcgttccatgcttttagcaacaacacaagttgtattattggcagctttaatttctaacgcatttacagatgataattaggccccaaccatgtgcatggtttggtcccttcaggctacctgacagtggatttgccggccggccggttgcaaattaactgcatatccacgaatatattagatggagatggtgctccaatcaaattaaatccagcttaataaaaagctagctagtactagtccaacacacactccacttaatttgtacgtgcagatcgattatccttgtcatttagatattcttgtcactctgtcagacttccaccatgcatgatatccatgtctgaatattggagtccctttttacagctcaagctgtaacactgattggccattaattctgctatgtggtaacctttgatcatcccctttacttcattatatctcatctggctatgattaattgttatatttttaattgaccgaaaggcgttttgatcgatcgagtccatgtctgcatgatcgaatgcagctcaaatcattctgcactgactcgtttttctttctgtttatgtcgaggccaactaagtgtagtggaatggttaattgataggtaacctaatcaattaataattgggccggtggatctctgatcaacgaaccttgaacgaaaaaataatgtcaattaatctatatatacgacatactccttccgtttcagaatataacatgtatgttttggtttttgtctgaagttaaactttttaaagtttaataagcatacagaaagatataacaacatatacaatatttttataatgtatttgtttggtgttgaaaatgttacgttgttgtgtttatttaaacctgattaaactctaatacgtttgacttacaaaaccaacatcttacatcctgaaatagaggagtaattagtcaggagtgcattcattttgcctatttccttccggacttggatttccttaatttggtcttatttaggaaaaagttatatgaattaaaaatgtgatgcatatatgaacagatcatggagagtatatatcttccaactactctctgaacatgcttgcctggaacaaagtcacaaactatagtgtctcagcttgcagatgattgtccacgtgcacacgattatttatgatgcacttttagttgattattattggagctacctagagccttggagattaattaattattgtccagcccgcagtttaattaattaattaattagcacagtatatatactactctaggtgatgtacgatcaagtcgctttgattagttgtttctggtcctggcagaatcatctacagctcgacgctttattcctaggacagatcaagggacaaggagaaaattgcatatctaccatcccatatgaatggcttcgctagaataccattatgaaaacgggcttcgctggaataccatcctcaatcagagtgtcttcgccaaaatgccatcccggacggaaatgcccctggctcttcttcttcctccatcccgcgcgtgaagagctcgccgacggccatggccatctccaccgccgcgccgatgccgccttgctgatggcgattggggcgctgccctccctgccatccccgccagcgcctgtgcagatgaggtcgtcgcggaaggactccggcgacgacgtgtcggatccagccagcgcgcgtgcgcgtggggccggtggcgcagctcctggccaccacc

SEQ ID NO: 64630 - DNA, 1492 bp, Oryza sativa
ttaaaaatacaaacacggacactcacacttcgcgcacactcaacattataaacacacacgtacaccttataactgtgaacatctccggaagactagactgacatatcttgaaattgatgaaatcattacggacgccttactctcacgagtatgtcatctaccactaaaagaataattagttataaatataagcattcatgtcaagtttagaacttgaattcagatgagctgatttcacaacaaaaatctaaccaattaaactactctcaccttataacaaaagttatttattataattaaataagtcaaatgtttcaattggttatatgtatgaaaaaagaaatcggtcactgaaacactggaaaaataaatatatggtgaaacatctttgagaagtgaagtacaacataaaaaataaataaaaaggagaaatatggtcgaatatcaaataaaacactttaacccacatatgaaacattgaattttaacagttggaacatcaaataaattttcttaaaaatcaaaaactggttaataggaaacacttgaaatattttactctcatgcacgaaacattttgctctcattcatgatatgttgaatgtcaagtattgaaacataaaagtagtaatatactctcaatggtctcaagaaaaattaaattcaataaagcaagaaatgcaaggaactaacttaagggagtgaagaaccgatattgcagtatccataacttcatccattagggtttaaattttagtgctcatgaatatattatgtatacgtaaatagcttttgataaaaaaaatagcgatgtcagtaatatatgtctgccgttaatttttatttctttaaatatatgttagggaacatattcgtctgcacgcgtgtgtgcgtacattttaactgcgattttgtttttaaagaaatggggtagctcttcttaatttttgttgctaggtggcctagcttttttatttttttaagaactatgtggcctggcttgcgtgatgcatgcttccatccatccttgtggcacaatatcacgtcaggtccgatcgatcgactcctccagatgcatgaatacggtgtgggcacgatggagagaagaatactttattactcatatgacactttacaatacaacaaatccggatatgtttattgtccagatttattgtactataaagtgtcccatccagtcctagatttctatattatgggacggaggagtcaatttggatgattaaactgatacttttatatatactatgtagaacatacttctaatcttactcccttacatcctaaaaaattcaacctacgaagagacatgacccattctatgtcatcttctaaaacaacaaatctgaacaaaggatagtccaaatttattgtattaggaagggatttgatcctttgttaagtttatttgggatggagggattacttcctctaaaaaacgaatctagaaatatatcacatccagtattag

SEQ ID NO: 64631 - DNA, 1892 bp, Oryza sativa
ctccggtcgtgtcccatgccttgctgcgatggttcccagctctttcacgtttcactattctcttgtcctcgtgcgaatgttgcatgcatggtcaatgtcctattatgccatcccaagtaggcaaagctgtagggcacatgcctcctttactttcgggcccaccaaaatgaggttcttgtgttcaaaaaaggccaccggtttttgggtgaaaaaggagggcgcataaggctagaaacaacactgtgaagcgagtagcgtcggagcgaggggcgctagcggtcgtgggggacaggtagggcgtgtcgccgcagcgccgcccgctccgaggtcgtcccgtgccgccagatccgcgtcgccggcctggggaggagggcagcgcggcggcgaccacggtggcggtgacaaagccacggccacggccatccacgtgccgcgccggacgagccatcgccgctggatctggcgagctgccacaccgtacgtcgtcgagactcgtcgctgccacgccgctccctaacgagccacgacgcgcgaggaagacgcggacgaggcggcgggggcacgcgagaggaggggaggccaagaagttcgccgccgtcgagcgccaagcccgccgccgccgtcatccccagatccaccgacactccgcccggtcaccccggcaccgtctctgctcgtcgctgctccgcccggccccatcgccgtcgaggccgccgctccgctcgaccgccctagcgtcgtctccgctcgagcgtgagaggagagatagggaaggcgtgagagaggggaagaagacaatgttgggctcgaggaaaaggggggagagagcggaaaaggtggagaaaaaaaaggaaaactatatttttgtggaccccacttgaggatactgcattgtaaagcttgtgtctatcaatgttcctcagcccatgtggcacctcaggtccagcatattacgtgacgcattgctattgccttttatgctcgtgtcatttttcttccccgtcatatctcacctccttgtcgtcatcgtcctccttctctttaaacaattgagatatccgtgtctaatttaaaaaatttatgaattttttttaaaaaatagtcacccataaatcactgttcatgttttatcatctaataacaataaaaatattaattatatttttttttcaaataagacgaacagttaagcgttggacatgaacaattgcaaaactgcacttattttgagatggagggagtattatatagcagtatgtggtacttctcgatacagagaacctgcgctcctctctaaagtcattactccctccttcccaaattgatcattatataatataatctaaaaaattgcagtagccagctagagaagatgcatgggaaatataagcgatgatgtgggaagggcttattcctggattgcacacagttcttttattaattatggttgtattgcaaattgaaaatgaattagttgaaagtcaatatgttgtttcattttttaagaaaacaattaatttgttctctgagtgtaatgtatatgatttttgtgaagttgatacattttacctcaacgaatctaaatgagtggatatcctccaattgaaatgttattgcgttggattgagagtacaaaatcacttgcactgcaagtcaatgtacaaaatcgatcccttgaaagttttaaaaaggataaaaacaagttgtggtaactaataatgcatggttatatgtcggcatatcttccttatagtaaaacgaagggaaaaggactgtacaaacaacgatggacagtggcatatcttaattatattatctttcacggaaaaggacggttactgttaaaaaattgactatagaaacaccaaaataaagtatcaggtcatttcacg

SEQ ID NO: 64632 - DNA, 822 bp, Oryza sativa
gctcacggacaccaccaggcatacaggtcgataatcgatcgatcggccggcggagaaagcagggcaaaaaaactggttacaaatttacaactgggatcctcaaccgaaaaaactctggagacagcagggccgataaaaatctcctaaccattggatcctaaattttcaagattcagcaaccacacaataaaccgtatgacaacagaattacacaaaaactggagaggtttaaggagtggagtagaatcgagagggtttagagtccatcagagaaagaagaggcagccaatgtctctgaagacattaacaccattagtgccataggaagggacaaacttctctttcagttgtcactatcacacaccttacctccctgtggaccccacctcctctcacgacatttctcctcttcttcttccctctaccattctagactgactgtgtttagttcaacgcaaaatttaaaatttgattaaatttagagtcgatgtaactaaaaagttgtgtgtatgaaatgtttgatgtgatagaaagttaaaagtttagaaaaaatttagaactaaacacacccacagccctattctaccctcacacctcatgcgtagtgtagttagcatcacccctacatacatgtgttcttctggtccaaagctatgagatacacgtgtgagactttgcacactgcgtctgcgagtctggctggctctcacggtcacacgtagtacgtgtgactgacctagtacaccatcccacggccaatgcggctctcacttgctttgcccgtactgctgctaacaggggaggatggaaaggcacgtactc

SEQ ID NO: 64633 - DNA, 966 bp, Oryza sativa
agtggatcccccctcgtttttgttcttgggcagaaagcctgacgaaactgaatcctccaacaaaagcaaatggcgaagcgtgggctttgttgttaattatactttttgagtttgcccattcctcgaggttggtagtggtgaactggttggtgttggtgttgttgttgatgcttctttgatgagcgcactgttgcttgcagggctccttaattaatcgctttttcccaagatttcgtttttaatttatatttatatactcttctttttttctccggcttctaggtagaagcagggggagacagagcggccagtgtctttctctacaagaaattcctcggtttccacgcgcgctttggcatttcttttcttttgtttttcttttttttacctttcctttcatctcttccgctggttttgtgggatatttgtggggggttttgggggtttagaatctctttgatttcttgtgctttttcttgctttttctcgtgatgttggagtggtgtgttttctgatttgatccgcccaagtagcgattttcttttttcttttcttgttgtttgtttggaggggggaaaaggttgcgatcttggtggcgcgccgatggcgtcgtcgtgcatccccaccggcctccggctggacctggagatggtaaaggcggcggcgccgcccggtggctcgtcggcggcggcgcactcgtcggcgtcgtcgacgctgtcggaggcgtcgaactcgtcgtcgtcgtcggtggcgtcgctgtcgctgaagcgggcgcgcacgccgcggaagcggcccaaccagacgtacaacgaggcggcggcgctgctcgcgtccatgtacccctccgtgttccccgtcatcaagggcgccgggacggcgccgccgcggctgctcggcctcgccaccgcgctcgccgacgacccctcctcctccgatctcctcccgccgttccccgtcctcgggaac

SEQ ID NO: 64634 - DNA, 3111 bp, Oryza sativa
aagacggattcgacgccgactctttcctcgccgtcgatgacggcgtggccgagggcatcgatagaatcatgggcaaactcagcatggagaagaactccgcagccgcgtcccgcgccgacgccgtcctgtccagcgccgccatacatccatacattagaagcctcatggtgctcggtctcgggttccggcaaggccggctcaacgccggccaagcactgaagcggcatgacgatgagagtgattggtggatgtgccctgccataccagtgaaggaaatcgcggcgcctcctgcgccatcggtggctatgccggtgccagtgccgatgccattgcaggcttcagataagaagaagaagaagagtaagaagaagtcactgaaggaaatagaaagggataatgccattgctgttggtgaatgtaagtttggtgatgagggaactctgggctttgatcatggtgatgctggaatttcggcgctgaaggacccaaagataggattgggcctgaatctgaacactgaagaggtgctgaaggcttggtgtaacagtggttctgttttcgctggctgcgatgcacttgaatcaccaagatcctcctctgatttgcatgtaagtatttctagctcatttgacttaaatctcttttaagatgataagaagaaattttgaagtgttgtatacttgtattataccttagttcagaattatgtttcatactgcttggcatataaaaactttaggcttttgtgtggcatatgttgtacaagtgcttgaaaaaccatttatgatttggttagtattactctcttcttctgggactattattttcttttgaatcaagccagcagttctattatgttatcctcatgtgtaccataattttgtgtcaatacacttctttaggagaaggggaccatacgtagattttgttcgttcaaatttctgctatataaatgtaaaaggaaaacatattatccacaattccaatcatcctatttttatgtgaaaatataaacttatccttgataattgtaatgatgtggaaattctcaagatggtatatgaaaagcacaacatgaaacttgataatggtctcatttatagagggaattttcaaagcctataagaagaactataagaagaacagaaaacttcagcacgataagtgttatatggctcctttgtttgtctatgtctgaagtaaatccttcttcaactaatgggttattacaattagtactaaccactctgaaaatatttagaacaaggagatgccagaacagaaaatcaagttttttttattctatcatgggggagtgattatgtgaaatcaacttttggtctgactgctaattactattacctccgtttcaggttataagactttctagtattgcccatattcatatagatgtttaatgaatctaagcatgcatatacgtctagattcattaacatatatatgaatgtgcgcaatgctagaaagtcttataatatgaaacggaggaagtaccaattttgatgaacatgcactgtcacgttaaagaaaactgctgtttcaccctttacaaaaaaaaaaaaaaaaaatctgctgttactgacaaactttaacattcttcatcgcaggctaaacttgcagacattgatctatttttagataataatacaagcggtgttatccgggaaggaagcatgctgaaattgcggcacaagcagaagcagtgcactcccctcctctccaataagacccggtatcaatcgcggaaggtgaatgctgaatgtcggcctcgggtcaaggcaagttctaagaactcattcctatgcaaacaacttatgcaaaggcaaaattgataactgttccaaatcaatttccacaagttttattccccatctctctaaagtttcttatgtatttgtctatgtttttggttctttgcaggggaagtatgttagccaggcttctcttcttcaacaagcctcagagaaagagaggtagaaaatgataaaagtcctcccatggacatttttggggcctcactctccccctcctaaagagaagcaaatgtgcttctctctttttcatttctgcactttaatcatgtaaagggtagagatgcctgtagagtggcatgttgctatggggatcagataatctttgtccagttctccagctataaaaatgatgaggttatcacccccagttaatggagtagtagtattttctgttctgttctttcatcttaatcctctgaaaggcaaaagaagagaaaaaaaccaaacagggagaaatgattatgagatgaaatttgttagccatcatgtccatatgacgcctgcaaagccgtcagagaatagaagctgctaaaacacctctgatgctctaaaattgtcaaatggagtaaagtttatccactgcgcctgaatctggaaggtttcctgtctacgttcagagattcccctaatcaagatttccttatgtcttactccaatcgaaatggcttgtccaagttgcaggctttcagcttggaagggaccaaaatgctgtagggttggtgaagattgggtatttgggttggtggagattgaaatcctgtgctttggccatttctatggtctcataaatatttgatgcttattagatttgttttgagaagtacaattatagtatcatagtaataaacttagatagttagagttctacaaaatacagttctgaatgtcaaatactcaaatatttacaaccagatcgagtacaaaaaatagtttgattgaatggaaaatgaattaaaaattcatactgaaaaaaaaatgatgacctaagatccccttttgttctaattaagatatagattttaccttgattttcattagcacacatttcaatattgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaa

SEQ ID NO: 64635 - DNA, 2910 bp, Oryza sativa
actattgcccttgctcttataggtgagtcccaccttcatagcccatatgtcagtggcaacgctgtcgttctctctggagagggagacggcgacggcagtgatggcacagccgccaagacgataggaggtgcggtcgccaaaaaagcgcaaacccagattctcacccttttataaccattcccccccaccaaaccaaccaccgccccaaaaaatacccgccgccttttctcccctccccgccctgatccaccgcacggccgcgcgcgcgccacgccggtgtggagaacgatggccgccctccgcctccccaccccgccgccgccccgcgcccccgcgccgtggctccattcttcccaccgccgtcgggttgcggcgccgcggggcgcgggcgggggcgggggcgggggcggggcggtcccgccgccgccggtgaggacgctcctgatcgacaactacgacagctacacctacaacatcttccaggagctctccgtcgtcaacggcggtgagcctccgcctcgccttccctctcgtgaaaccatggcttgtgattgtcactgcttttgctcaacgtttccatggccggtgttttttttcccagtgccgccggtggtggtgcgcaacgacgagtggacgtggagggacgtgtacaggtgggtgtacaaggagagggccttcgacaacatcgtcatctcgcctggcccgggatctccggcctgccctagcgacataggtgagcatctccacttcagttcaatcgtgtggaatcagaattagaaattgctgcttgtgcttgttcaccatttctacgtttgtatctatgcaggtataggcctgcggatactttgcgagtgtggagatatacccatcctgggtgtctgccttggccaccaggtcgattccttttttgtgttaatccttgtgaactcatgatcagtcctgtaaaatggaaaattcatggacaatttggtggtaggttgaactgaaatggccgttttgttttaccactgcaggccctgggatttgtccatggtgctaaaatcgtccatgctcctgaagctatacatggccggcttaggtaaggccttgaactctattacatgcttaatactttcagctttctgacctgtacagcatttattttttatcttgtgcaattgctatggattagtgtgtgtcatgcataatcttctaagttctaggtgttctttcagttaagtagttaacacatgtcttgattttgataccccttttttttatgtcagtgaacttgaacacaatggatgctacctctttaatcacatcccatcaggtataaactctggattcaaggttagtgtaccactcatgttgctagccatattattggggtttcagcctctatatgcaccgcaaagaacactctacttacagttgttatttttcaggtagtgcgctatcactcacttgtaatagaaccagactctctatctgaggatcttatatcaatagcatggactgcttctccaaaaatgctctcattccttgaaagcgataagcctgatataactagcagtaccttgtggggatcattggataacttattcgtaacaaaccagtcagagtgcagtaccactgatggaaaaatgcccagcataaacgatgcaagtgagttagatggctacagggttctcatgggcgttaggcactctaccaggcctcactatggagtgcaggtatactgtctatatctctgcaatgttttttatttctttttttcactattcttatatttgattaccgtcaaattcagtttcaccccgagagtgttgctactcattatggaagacagatatttcaaaacttcaagaagataacaactgactttggattacagacaccattgcttcaggaaagaaaggttcacagtattggtaaactggaaagatcccaagtactaaattttttgaagactacaagtactatatgtgaacaagtattttccacgcatctcctttagactccaccttattgactttcttattgtactgcagatcagttctccagatctcaagaactttgttgcaaatgacttgttacattctgcaaggttgaaactttgggattctgttgggccttgtgctcttccaaagcgaagcagtggggacaaatgcttacggttgcaatggaaaaagattgataacttcctcaatcgcataggtggctctgaaaacattttttcagtgctttttggccatcatagcgctgaagatacattttggctggatagctcatcagttgaccaggtgctaattcagctagctcttaatatcgtttagttctgtcctgtatagattttatctgatgttaaacgaagattgaagggttttgagtctattaacaaaaatgactagatgatcatggacatgtggaacttcactgcatgaagaaacaaaaaaagtattcccctgattcaatatacttaatttcttcattctgacattctggcagatatagtctgcagaaattaaatgagataaagttattgataatgatagttttttatgtacatgaattgagttggttcaaaccagtgcctatttgacagagagtagtagatgtgtcaaaacttatcactgttatcctgtcattttctccccctcatgaaggcaatgcatccacttttatgagttgagaggttttttcttcaaagttgtgatgtggtgctacttgcagaatagggcacgattttcattcatgggcggcaagggcgggcccctttggaagcaaatgacatttcaccttgccagtcaacggtaggaaggcactttcctgaaacagaagaaaaacattctctatgtatttatataaaccttcatgttatttctgattcctcctatttcgttctagagccaattgtggaggaaacct

SEQ ID NO: 64636 - DNA, 4359 bp, Oryza sativa
tccgagtgcaaatttctcaccagcacgtatgagtcatctcggtccattcacatatgccagcacaatgatgtgtttgactattatcggaaatgttgggggaaaacatgttgttttgttctgggcatctcagtataattgtattctgcacattatcctatccttgagcttatcagctaagcagactctatctagctatatgtgtttgtgttgtttaaagctttataattccaactaatttacaccacaggagatgcaatccattcaatacattgaaaaggattatgaaggacttccatttgacttccatggtggatttgttggatacatagggtatgcagatttgtttttgcaattcatatgctcttttgtaacttgtattggatatatatgcatagttaattggttattatatgttgtactgtcttgttttatccacagctagcttattttttaaaattaacatgtccactgttttttcctggatatgcgtagtttgttactccttccgtccacttttatagggcttgttttgatttggcatagtcttcagaattaaatttgaccattgagttatcacaaaatttattgttaatagctacaaaacggtgcaatacacgaatctattgttataggttttgtacactaagtttatgtgtaatctgattattgttgttcaaaacataattagcttgatttttgtaagtacacatatgctttattttttgtggatgaaggagtattcaactttttttctcaatctgtgctctttcacgtgtttgacttacatggttgcttcacttttttcttacatggttcattacatttccacttgtaccagatatggtcttaaagttgaatgcgatgcatcatctaatagtgcaaaatcaagtacccctgatgcatgcttcttctttgctgataacctagttgtggttgatcacaacaatggggatgtgtacattttatcattacatgatgaatattcttctggtaatggagatggagattaccaaaactcaatacatagtttatggttagcaaatactgagaagaagcttctcaggatggatgccatggccccaagattatcgatcaatggaaactcgtcgatcaatgggaactcatttaccatatcatccagtgtgaataagcaaagatttgtcatcgagaaatcaaaagatgaatatatcagagatgtgcagagttgcctggattacataagagacggagaaagctatgaattgtgcttaactactcagatgaagagaagaacggattatatggatgctttgaaactctacctgaaattgcgaaaacaaaatccagccccttatgcagcttggcttaacttctcctcagaaaacctgagtatatgttgctcttctcctgaaaggtttctgcgactagaccgaaatgcaattctggaagcaaagccaatcaaaggtactatagcacgtggcagaacaccagaggaagatgaatgcctacgtttgcagttgaaatacaggcaagtatctgatagatacttttttcactgttcaaacattatgattttggttttaccagtcctcacaatactgatattttcttatgtgtttcaacagtgaaaaagatcaagctgagaacttgatgattgttgacctcctaagaaacgatcttggtaaggtttgtgaacctgggagtgtgcatgttcctcgcctcatggatgtggaatcatataaaactgtacataccatggtaagtaccattcgtggaaccaaaatgtcggacctaagccctgtcgattgtgtaaaggctgcctttccaggaggttcaatgaccggggccccgaaagttagatccatggagattcttgattcacttgaaactagtccgagaggaatatactcaggatcagttggattcttttcatataacaagacttttgacttgaatatcgtgatcagaacagttgtcctgcacaatggagaagcttcgattggggcaggcggggctattgtagcattgtcagatccagaagcagagtacaatgagatgctgcttaaagcaaaagctccaacaaaggtggttgaagagtgcagtcaacaaatatacaacccagatcgttcggattcaatgcagacaaccgtaagttagaatggagggtgaaaacgagtcttcttatgaaaacacaaccagcattacaaggtttggtatacaatgaccatcagtttggatctgaaaaattcgatctccgctgttggtgcacatattaatggctaaactacaaggaagtcgcagcacacctattctataattgggaattctaaaagcaacaaaaggacattttgctgaaagaaaggtgcctatgccaaggtggtgaaaagcacattggagcaaaattcatggtgtactacaatgtagagttagactagattacagctgacatgccttctccacaaaacaacagtgcacatgattttattgattgattgattcccctattgtggtgattgcactgtgtaataataataaactgataaaagaaagaaacccatactgaaatgcatttcatagcagattcatatatatatatattggcatgtatttgcaagattgcacatgtctcacctgagttcaaatatctgaaatttaccatgtactgtttctcaattcatgctagtattgatcctactggtgattgccccatcttgaaatttgagatttgagggcgagatggctgtttgctaatggcagcacttggttgagcatggctggcatgagcactgaacaccagatgtaagcaagggttgtactgcaaccagatcagatttgtgagctgaagaaatcgtctaagattgcatcttttcaactgattccaattccaaattacaatgggcggccggcctggcacgccattattccaatagtgtttatgaatcaattgcgcacgtcgcattatcggattgtgtcgtgccatcatcccagaatgtttctcatacgcaaatacacccctgtgagtttcacaacttttcgtagcctttttatctctgctcatgaatatttgactttaggacaagatttgatcaaatttttaaatgttgataataatgactcatatgtttacttttaaaaaaaacaaaaaaacgtgtggaatttctttgaaaaatgtaaaatttgctagattttacaaatttattttagtataacatcaacggcaaaatcttcaaaagtttcaatctttacttaaacgtcgattatttttggactgatagaacacttgcaattttggatggcttatggttctaagtttgggaataatgaaaaggtgagggagtttagtgtgattttgggaggatgagaaatatatatatggaggcgaaaatttaaaaaatggagccactcgcgagccacgactcgacctcgccgcggcggcgacgacgacgacgaccagcacgcactcgcaccggcggatcgccggcggcggcggaggaggagacgatgggcacgacgtcggtgcagaagagctggcgcaaggcgtgcggcgcgatcaaggactccaccaccgtgggcctcgcccgggcgcactccaaggacctcgacgtcgccgtcgtcaaggccaccaaccacgtcgagcgcccgcccaaggagcgccacctctccagtacgcctccttctcctcctcttcttcctcctcgcctccgccgcccaatccatcgctcgcgacctcgcgtgctaactcgattgccgtcgccgtcgccgcagagatcatcgccgccgcgtccggcgcccgcccgctcgccgacgtgtcctactgcgtccacgccctcgcccgccgtctctccaagacgcacaactgggtggtacgccgccatcgccaatgttttcctcatcgctcgccgccgcgtgatctgctgacgacgggggtggatggatggtgatgcaggtggcgctcaagacgctggtggtgatacaccgcgcgctgcgggaaggcgacgccgcgttccgggaggagcttctcagctaccggcgcggccgcggcggccattgcctgcagatgtccagcttcaaggacgactccaccccgctgggtcagctcccaatccaatctgaattcctgcataaactgaactggattaacatgaactcaatcggttcaaaaaattttgtcaccgatcgttctcatttctttgtgattgcaaatttgaaatctccaattgctttgctcagcgtgggattgctcggcgtgggtgcgcacgtacgcgctgttcttggaggagaggctcgagtgcttcagagttctgagatacgacattgaagcagagcgtctgaggacagcagagggagctccaaaggtttgtgaaattgtgattatggctt

SEQ ID NO: 64637 - DNA, 1662 bp, Oryza sativa
accctgctgccgcccagcttgaagagaacaatgcactggctctggccattgtatcaccaggtgattagcatgcatctgcctatactatctcccgattagataattcaagaatcactagtaattctcccaaatccatgcataatcacatccttttggattataacaggtagcaacacatctgctggtgcaggcagtggcttcggtggcatgcttggatcgtcaggttgggagctagcgttggtcactgaacccaccaacagcagcagcaaccaactactgacagagagcaagctggtaagtcaacaactctctattgcttatttcaagaactctctattgctcaatgccattcttttgatcatactgtgactgagagtcatttccaatttttgcactcaatgactcttgtaggctggagggttcgacaagctgctgcttgatagcttatacgatgatgcatcaaggaggcagcaaggagcccagatggatcatcctcgggatccgttcgccatgtcgacaagtgtcgcgccaccgaccaacgtgcagatgtcgatgatggcacagcagcagcaatatttccagcaggagcagcagcagcaaatggtgttagggatgccacagcaattctcagggtggcctcagtatgctggtgtttctcaggcgaatcctttcggtgatacgtattcaggtggtactctccatggaagcagcagcttgatctgaacatttttttttctgattaaaagtagagtagctttgatgtgataatctgagaactgccattaattcagcttgctcttgttagcaaaacgttgtatcttcttcagtcttcacagatctcacttgtgcacagtgcactggcaatttacaagactggaaaacagaaattcatttgttcatttctcaggacatgcttgtatattaccagttaacgatgacattagataaacgagtacagttcaaaggtaaatttgtattttgggtattacacgccgtggaggatgtccaaacatatatggacaagcattgcgcagctttgatagcatagtgccatcatgtagtagctggcgtatacccatcaggatatccccagctgtatcctgtattcagtgcaaacatcacatgaagtacatcgtttctgctagacactgtaacaaaggatccaaacaaaaaacgatcaatccaaagaaaaaaaaaaggaggggaacatcagacaagcgagtagtcgtacatatgtacatggacgtggcaacaaactctcgggtcattttcattctggtataacgagtcaaaaacattttcggccatgccattacacccaacgattctattcctagttcttataaagttctcctgtcatattggccccattatacctgaactcctgttaacccagccctcaccgtatctagtatgcatcgtcttcatcgtgctatttgttcgtcgctttgtgtgacaattagatattgatccaagcctcttcatagtactccaggccttaatcttcatggtattctgggttcttccttaggatcacaaaaccctcaagaactggtgtcagtggaagatatctgcacatagaaagagcataagcataagcataagcaaagatcaactgacaaattagaatattgtactccagatgttatagtttacttttca

SEQ ID NO: 64638 - DNA, 1889 bp, Oryza sativa
gggacagaaggacccgtcagagtaatatggtaaagggtcagcaacccttcccaaggtgaacaagactttgagcatccctcacctgaagtcaaatgaaatgaactgatatgaaacttgaatgcaacagcatgagatcacaataactggcaaaacaaagataaaaatgtttattttagatttgaacttacacaaaacagatgtcctgcttctttgtaataataacttgagaggttccgaagcatcccagctatacgggcattgtttgtaccagcccctatcaagcccagggagatgattgcagcctgcatgtaccagtttgatcaaattaaaatcaatgctcatagaaattaatatggtaggttttgctggtgaggttactaaccatagaaacttccgcatctgcatcatggctcagtctactcattgtgtccataacatttacctaattgacaggcaagtggtagaaatgtagacatcagaaaactagataagatatttatctagccaaatgatacaatctactaattttcctcgaataaccaggatcaaataatagtcatctgacaaagcacattctcaagagtattgaattgaaatagatgatgcagcagagtacaaaactaactgtcacggcatgctattaaatagttctttctcaacaattcaattgaatgattgtgtgcaacggcatgaagatagcacacatttaatgctactagtatacaaaaagaactgttacctttggattggatatgcaaagcaaacccagagctagaggaaccgcccttctaatattctgctcgccatactgtaaaagacgctcaagggaacgtacagccatttccgcccctaattcttcagccatggcaattagggagattccaagaactgctggcccttggtgggtttcacctttctcaagatgctcggagcaaattccaaggagtttctgaacctgcaaatcaaacgggaagattcatcaaaaacaaataggcgctaaaaaaatgtaatcctacaacctatgcacaattcttctgttaattgggaatcaccttaagcacgttccctgtcccagcatatgccagtgacatcaatgtcacgtcacaataattccttatcttctcatcaaaggttttagaaacctctgcagtcgcctccacactttcctgagaacagtagtcaagaatgagtataatagtatattaacataaaactggctaaaaacagacggtgtaggttcatgaagaggttgcatgttacatatgcaagacaattgacagtgcttaatccagagaaaaaagcaattaccaaaagaataaaattgtacttgggatgaatgaactaaaaatacatttgagccagttcaactacttgcatggtgcacgcgaaccaaggccaaaatagtccacgttagcgaatctgagcgttatgctgctgaatgcatgcataaatcttgtgatccagaaaagatagggatagttctcctatgccttttggaaattatcttgctaggggaatttgcagaagattgatagaagtgcctgatgttcctgataatgatgagcagaatgagtcaccatacataccaaattccagtttcctttatcctgattgatctccctcctcactgcgcaaatccctcatctcacaactcagtggcctggttgcactattggtgccgcactgcatgagtgggccccacgtgtcgcatgaaataattcaaagagaaggtagcctccatcaggaaagaggcaagtttcggcagggcatgttactgttcgcaatgatcacatgccttatgcgcactcacatgcttgctggtatggcatcctagtcagcactcaaatgatttgattaatcagatgtgaactattctcagggggatccac

SEQ ID NO: 64639 - DNA, 4829 bp, Oryza sativa
  unsure (1)..(4829): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatttatgccttgcatgctttccaggactagcattccatccactggatgggattttgcaagccataccgcatgtgtttgcgctctaccttatcccaacacacttcaggacacacattgctctcttgttcatagaggccgtgtggacaactaacatccatgactgcattcacggcaaggtttggccggtcatgggtgctggctatcacaccattcaccatacaacataccgtcacaactatggccactacaccgtgtggatggactggatgttcggcacccttcgagagccagaagatatcttgaagaaggattaggatcgaattgttaagcacggcgcgacgttcgcctctcgtctttgtagcagtcggaagaagggggttctatgtatttatcctgctcgatgctatctgttatctttcatgtaccaatgtgctgtttcagtatgctaggtgaacataaaagtgaactttagtgagttcatcatccctggaatgcaatggaatcgagagatatatcctgggtaggttccaggtgtttgtaccattcctgaatttctctgtacttctttgtgtcaaagaacatgatgaacagttgtggccagcttttgtacagcaataactgttttattgtaactgctgccatccttttgtatcatgaatttttctccgtttgttagtctggtagtaaaatttcttgaaagcttatattgggctttagcctttagagagttagagatgaatttttgtgatgggtttaaattagggcccaatacgaactggccctgaaattgaagccttgaggcccaaacagtctgctggattgccggcctgtttaaggcagggaaagaactcaagcagtgcagtgcaaaatgaaaaaaggagccagaaaatcatctcccagtcaaaaattcaccttctcatgactcatgaactgtgaaatttccgatcgaaacgtgtgaaactttctccaatttagaactccaaaccattaatcctaggtaaccttgttcagctgttcaaaacaaacagcagccatataatcacgtcgagtcgcactgctcgtgtaagtcgcgttatattacgggagggaaatttgggcaaagatattgctgtctcgattgatgtctatcactcacaatctttctctgtcgtactagcacgacggtggagtgacatgctttttcccagttgctgctgcttggtcggtccagtaacgtgcacaccaaaacctcgttaattaggttgttacacccgacagtcaaaattaaatacaggttaatgagtcatcaggtcatgcagtatgtttggtaaaagtctagctttcctgtaattgcacgctcgaaagtggcatgccatgattcaagtgaattcgtcttttttgttaattcagtactactcccaggaatataattgctgccgaatccgttgaatcaggaaatgctaaatatgattaaattgttgtagattactagatttgagaggagtttgtatgttgcatctgaatgcaagataattaccggtggacaaacttcatataggtctaggtcggtctcgtgcaagtgacaaaatcaacgcgttttgtagcgtgtcatgcatatatgataggattaggatgggtctgcttgctcgtcctgacgaaagaaatgaaagagatacatatccaatggctactggctagtattatctctttttcaaaatgcatgacgatactattcatttttcacgcaacgtttgattattatcttttcaaaaatttagttaaagatataaaaatataagttaagattatattttatttgataataaaacaaggcacaacaaaataaataatattgatatattttttaataagacgaatggttaaatgttatagaacaacgttataaatttaaaaatggagggagtatatattttcagtctaagagttaacctcttttgtttcctctgcttgtacccaaaaggaagtttggcatgaactggtgatcattggttgctaaagaagctgtagctttgttccaagctattagtatacaaaagtagcgtccttttctcctcctgttttgttggttaccaccaacagtatattccatgcacctttgttcatgctaacccctcgatcgatccgacgtggttgatttggtaggtctcataaaagaattaacgctagcttttgatttgtctacatgtatgtgtcgctgttaatctcagtattagcaagatcaatggcaagtctacacgcggagatggagcgaatgacaccgacgtcggcgaagaattaacgctgcatgccttgatttcttcgcctgcgtgtgacagggacatgaacacgatgtgcatatccttttctgaacttttacgctgagaaatactgtagtaaacaagacctgattcgatcggagatatttaaccatttgtcacatttaaatgtggcaattaacattttatcaatagaaccacatatcatagatatatgtggatccacatgtcattgtgatagaggtgataaatagttatttgctaaatttaaaagtgacagatagttaaaagcccgatcggatcgatcgatggaaacgacctactgcatcgtcgccgtgagctttttgctgcgacatgtttggggaaaaacttgtcccatcgatcaacacaagacgacgcgtttgtggtttggttttttgtatggttcggtggaatctcgtaacacggattgttccggtaatattccactgctaattacagtacagccgaatacacgcttttgagtgtttctgaaaggccaccgtgatgctaacagaacattatcttcagtgtttgcctattttctttagataatgaaataaatttcggcttttcttgtaacggagctataatcacttattacacaattcgtccgagagcatatataatctagtaactcacgatgtaaagactaatactcccttcttccctaaatgtttgacgccgttgacttttttaaacatgtttgaccgttcgttttattcaaaaacttttgtgaatattattcaaaaacttagagtagtagtatatttaacaatgaattaaatgataaaaaagaattaataattgcttaaattttttgaataagacgaacggtcaaatatatttaaaaaagtcaacagtgtcaaatatttagggacggagggagtactttatcatttaatgagactagcatttattcggtgtttgcttatggatcggcgataattttgttaagtttgcacactatcgcactatgatttggttcgatcttcttttaccgccgctatttttaggcttgttgggagtgtagtggagctccgccaccacttttcctctttagaggtgtagcgttttttaagtaatagtttctttaccttagcagtcttttttttctccttttttttctcctaggcaattatgttttcttctaatatattgacgtgtagttttatttacgtgtgcacaaaagaaatgagaatgttctacatgcatcaggccgactttagttccaaactttttctttaaacttccaacttttccatcacatcgaaacttttctacacacaaacttccaacttttccatcacatcgtttcaattttagtgtgaactaaacacatcctcaatcatttactgtcttcaagtaggcatagtaataagcctccaatggtccaatattccaagctagctaggcacatcggccgtatcgcggtcggagaatttgcgagccagcgaagagaactttttcttcgtgcgatgcgatgaactgctgctgcgtcgtacgttccgggccggacaagtacgcctcaagcggatgaccaaactggttaattagtctttggactctagatccgtccgctcaatttcatttcgccgtacaagtcaccgcaccttccatgtgcaaagtttgatttgaattacgaaaagtcgggagaaaacagaccgtggtacgttgaatgccgaatgaaaaaaaaaacctatactttaatggttgatatgatatgaagtttttcttgatctgtttgacaatcaagaagcatgcctattttcaccgttgaaagaaaaaataattccttttacctttgcgtaaggtgaggctttagtcatctggactttgtttgttcggtctgtgtggaggccaggtttttaattattttttaaaaaaaatactcccttcattaataaaaataactcctttgtggaagctcattgaaactatatcaagacaaacatttctaaatgctactttactcacattaaccatccatcatttttcttatctcatcttaccttccactctaaccctctctaaatgaggtgcatgatagtcttctagtttgatctttatttttgcagaaacccatgaaagtgcttatatttttaacgaaggggagtaggaaggaagtctacctgttgcatatgtggacaccttgtttaccgtttcatgaaatttcattacctttaaatatgtaaattttatttataaagggtgatattttataatttttatttatttgattctctttctttgcttggccctactcccttcgtcccaaaaagactcaattcctgggtt

SEQ ID NO: 64640 - DNA, 20233 bp, Oryza sativa
  unsure (1)..(20233): unsure at all n locations
aaaaagcccaaacgtctaatgaaccttaaatctagaaattctcctaacaacatataatttgtggataatacttctatacctgtgttattcatgattaaaaagacattgctaacaaataaactaggatgaaaaaattctaaaagtaatttaaaaattaagctttaaaattaaaatttttacagcggcttgtgagctgaaagacagacgataggaagcattccatatgtcgcttttttgctgttaaatgttatcttaagatgaccttagcgttctctgaagtatccagattcctgaattcctcttcttgtttaaattgaccaaaaaagcatgagagtttgaatgcctttttcttgtcctttttgttggatggatgcgcacctttgagatacctacttcactagtttgtttgtttttaatggtgttagccaaatggtcatatttgagacacgaattttcccctgattagttcttgagaaaaagctcaaacgtctaatgaaccttaaatctagaaattctcctaacaacatataatttgtggataatacttctatacctgtgttattcatgattaaaaagacattgctaacaaataaactaggatgaaaaaattctaaaagtaatttaaaaattaagctttaaaattaaaatttttacagcggcttgtgagctgaaagacagacgataggaagcattccatatgtcgcttttttgctgttaagtcattttggatatattttttttggacaatcttttggatttatgaatctaacaaaacaaacaagagggaagatgtgcacaccaatgaaaatgatagatgcccatcaagtctacacgcgtcgtaagactgacatggagattctgagcaagacagcgatcggcatatgagcatggctgcaagttnaactaccccccccccccccccccaacgatgaaaacgactttgtcacatgaataaatccaaaccgcagatatgttcactatatgcatccatatattaatttaagaaagaaattgtttaaaactttggcacgatgcatttatatatgtgatcatttttcagatcttgactagagggatattacaagtctcggtacgcgttttcatgacaggagcaccttggctcttagatcttctgttcgttaagaaaatatggtttgctcaacaatgccattaacacagacaaaatccaaagtttcagttttgtcacattggtatagcatactaattgctcccttcatcactccacaaaatttcaaatctaaactcgatttacaaatttagaaacctaaatgatttccaacctaaacatagctcacattcgttggctatggttaataacgtagaaaataaacgagacaactaacaaaattttatggtaggatttttatatttttcactattgaaaagccaaatctgtaaaaaagataacgacgaaaaaacaactagaatcatttaaaatttataattttagctgtggatcataaaccagcaagcaaacaaatgatggtttcatcatcaaattgatcaagtgcagggcagcacaactgatgaactgatggccaaccacaccgcgggctacaaagtggggatctctaatttcacagcgttagtacgtgactacgtgctaactatcttgagatttggagcatttggcccaagtcaaggtcttttcctacgtgtaacgcgtactcccatgccaatcagccgccgatgcgccatggcaagtaaccgcgtggcccaccatgcaggttactacttgtactgatttcatttttattctggtctttctcgaggacttgtattttatactaccagcaaactactaaaatcattgttgtttagttaaatccatcttgagagagagagagagagagagaggtccatctctgcgattgtcatggctacaggtctagtcatgcttccaagttccaactgtagcgtagactggagtgttattttttttaattagatgatgaagtgttgtttggggttgtacttgcaatgggctagttgcattaacaaaagacatttcaaagatcaaagagtgatcgagatactaaaatggcggttaaaacgcgtctttcatgcgccacttgcatcaccagaatatgaggaagatgcctaccacgacatgcttgttctagatttcagaaatttaaaccaaatctcagtatttgatcactatccctctttagcacaagttgacacaaccacacagcaatgatgatggattatggaatattcagattgtagagttagtactccaaatgagtactaacatgcttcactagatcatgttattgcttaaaacatgctttatttttaatggtcatttgtgattcaacggttcaggcatatcataccaccggtagtagttgcatgtagatggagcagacttttgtgaggctgtcagttactccatctttgtctgttgacaagaccatcagttagtttagttaaatcggtagcagatccagaatatgccataatgaaccttaattgaaaacacttgttaatttaccaggaaatgggtcctgcttcaggagcagcattttttgtcaactgctctagccgaaattccacctccaaattcaaaagttttcttgcttggacaccttcttgacaatttaccagttttggtgtttgtgtgcttggactcatgtttgttattgtccattttaaatgtcgactacatcagcccctgtaatcgccaaattttcaactctgtttagagagacagacagtttgcttctctgtatcacagaaataaggttcatgtatatgcagatgtacaaatgtaggagtacaatgcaagtagcgaacagtttacacaaagagaaacatttgtttaccaatcattacgatggtttcttatcatattcaacacccaaatcccatcgttcttgtattctccactagtcttgggtcatccattcttcagacagttttgtcagaaaagcaacaaagctaagaacaaatactaatgcaatccagagacaaatttaattttcctagaatcatcaataaaagtacattaggaatcctgttctttctgtactgtctacatgacggcggacggccgcctgtcacataatctttcggcgccggagaggagcgagacgacgacgcgacgacgggagagcgacgttgacctctgcgagcccatgacatggcaccattacatcactctctctctctcgctcgctcgctactccagactgaagcaacctccttcgtctcgccttcccggaatcttcctcccaacttccatcctctcactgttcgaaccgccattgcggctgcagtataaatcgagccgtccgcacactgcaactcctcctacgcaaaccaccccaacctgcacaacctctcctcaccgaaccaaaatctcacagcttcgcttctctctcgcctcccgaagaaaatagctagagaaaaaattcgcggatcaagaaggaaaaagaaaaggaacacttgagcttgtttggactgacaacaatggcggcgaagcggcttcacgacggctacggacaggaggaccagcccgacgacaagcgtgtgcgccgcatgccgtccttctcgacgtgagctagctttcttctccttcgctattgctctgcttgtgatcgttcaaggggagattggttctaattaacatgtgtttgcttttcgattccagggtgatccgtgaggccttgatggtgaagcagatgcagactctgttcgtcgcactggagccacttctccgtagagtggtaagcaggcaggagatgatcgatttgcagttgcacagagcttgttccaactgttcttggattgcagtgtgctaattgctctgtttctttgttacttgcaggtgcaggaggagctccaggcaggtctcgtgcgcagcccgcgttacatcgagaggtgagaattcacaacgaaatccgcaagaacagcgtcgaacagcagcaagaaatccgaatgatgtataacattgtttgatctgtattgtcaggatgtcgcctgagacgccgccggctcagccgccgatgtggaagctggcgttccggttcaagccgcagctcccgatcttcaccgggagcaagatcgaggacgtgaacggcaacccactggagatcatcctcgtcgacgtcgacaccggcgcgccggcgacgatctcgcagcctctgcgcgtcgaggtcgtcccggtcctgggcgacttcccgccggacgaccgcgagcactggacggcggaggagttccagcagaggggcatcgtgaaggagcgctccggcaagcgcccgctcctcaccggcgacgtcagcctcaccatgcgcgacggctgcgtcgtcgtgaacgagctccagttcacggacaactcctcctgggttcgctgccgcaggttccgcatcggcgtccgcgtcgtgccgggcagctacgacggcccaagaataggcgaggccatgaccgagcccttcgtcgtcagagaccaccgcggcgaacgtacgtttcgtcagagaccatcacgagttcaccacactacatctctctcctcttctctgaattgtttccctgacgatttggcgtgtgatttgcagtgtacaggaagcactaccctcccgttcttggcgacgatgtctggaggcttgagaagattggcaaggagggtgccttccacaggaagctgacgcagcacaacgtcaggaacgtgcaggagttcttgcggctgctcacggttaagccggacgagctgcgcgctgtaagcttccaccgcatttgatctcgcaaatcacaatgcttctccaacgcatgggtggattctgaacattgctctgttctttgtgttcagatcatgggcgacggcatgaccgatcgcatgtgggaggtgacgacgagccacgccaagaagtgcgtccccggcgacaaggtgtacatgtacagcacgcagcacggcaccgtctacgtcaactccatcttcgagctcgtgaaggtcgagctcgccggcgtggagtaccagctgcaccagctgaacaggggtcagaaggcgttcgtgcatcagctgctgctggcggcgtacgagcagcgaaacaacctccaagaggccgacgccatggcgctccactgcaacgacgttcctctgctgcagagtaagtatcggttactacagatttgctcaacatcgagcgttagtttcgcagtgttctcatctgttcttgtgcttgaacaatctgcagatgcagcggagataactatcccggcgcttggagacacgcagctgtggattcagaacagtctcaacagccaagaaatcgacttccaggtcgacgagatcccccaagctaactttgcgcttcagtggactggccaaatgtacaacatttcaggctaagaacagtcactgatgaacagtaactaaggctggggactttaaaaggtttcagaaatagggtgtacattgtcttttcaagttcgcgtctgtataactgtgttcaagtgacacgaaggttaagggtaggtgaacaacagcttgagcggccctcactgtctcgcagagaatgtggccaatttggccagcatcggcgagagcaagaagaggcgagcaagttaattctttggtttaattggtatcctttgttgcagtttttcttcttcgtgtttagtcaagtagtagtgttcttctcccaaaggttgcattgttaatgttggggtgtcgcaacatggagaaggagaacatgtatgatgataatgcagaacctgtaagagcaaaccggtcgttctgcgatgttaacattttgctgaagtttttgtgtctgtaacatcaagtcccagtaaataaataactcattttttttttgtacacagagtccactttgtcttcagatttctttagcagtggtgcctgaagcctgaaactgaaacacaagcttgacttgcattgcatatctgaatctctttatttccccgtttctgaacttagcttggcatgcacatgcatagtttcagtgggtgatatacggggaaaaatgaacgaaacgtctaaaaccaaaattaatgtatgaataaaaaaatataccagtattattaacggttcaaaatctaatactgtaaaatagacttacgatgaaagaaaccacaactccaactagtttcaaaatttaaactgtaactctaaaattaagtttcaaaattaaaatattgattacaattgacaggtctttgtttttttttaaaaaaaagtttacaattggcaggtgaaaggtaactgtggggccatcctctattcctgacccgcccaaagccccacaaacaacaaacaatttggagcaagaaagactgggtgccaggcgagtaggcgacgtggcctgagaagtcaagtcaagagatagagagagagagagatagtttgcgcgttaaacatcagacgtgggcgcaaaactgtactgcgacaagcaaccctaggaaatgaaagcagagggcagagcaaactccgggatctcttcccaactccgggattcaacaaaagcaaaccgcgttgcactctttttttcttcttcttttgtttttttggcgattgactatacactagaggacgaggaggagcataagtaagtcaattgttgttatctaaaacacatattgttccaattatcttcacaatgtatcgtagccgatttttgaccgtcggatatttggatctatatccggctcctccttatcctacaattaattaggtattagcaaaaagttttttaaaaatgattaatatgctttttataacaacttttctatagatttttttttaaaaaaatgtagaagtacacgtatgaaaccgttcaaaaaaaagtacacgtatggaaaacaatagagtagacgctgggaaactgtaccatagaatacacccgaatcctcgatcttcagttcatcagatcacccacggccaataatccggcaatttcctacttttctgggctttatctaaacctgattgtcatccctcgaaaacgtaattgtgcaaaaaaaaaatattatctttgatgtcgatcaaatggtgaaaaatatcgattgggattacgctaaaagcgataagtatgcattatttatctttagcaattttgttatgcttaataggccggctctatcaggtcagttcagattgaagggacgtgcaggcccagagaaaagtatccaacctcaaggcccgaacttccgatatctccactgcactgggccgctcaaagcccagttcaatttagcacatgaaaacccacaaaagtaacaacagaacgggccgaaatcggtatgctcatgcatgatcatatacacacgagacatggtactttaaattggtcgtttatttactgcaaatctgtaggtagcaaatacaaatccaataccctcttttacggtttaaattaccacacacggacacgccaaggccctataatcacaacataaaacaacatcacatctcttctgatcgatctaaaaaataatcccaatcccaatataatccgtatatatgcaatgcacttaaccgttctatgtactacacgtatgaacgtatgaatcccccccgatgatggagttggctggctagagatccatgtcgagcacgagtgggccatctcccttgccgacgtcgaactgctggtacttcatctcgccggcgccggtggtgagctgcacgacgtacttgccgtggaaccccctgaacttgaagtggccgctgccgtcgacctgcccccgcgcgtgcgacgtccactcctgccggagacccacgtagcggtggccggcctcgttgagcttcccgtcggcgtcgacgaggtgcgcgtgggagcgccacatgttgccctgcatgaacccccacagcatgatcccctccaccgccgggtgcgcgaacgcctcccggagcacgatctccaggtcgtcggcgcgcaccgcctcgtccgccgccgacacgtccagctccgtgatccacacggggagacccgtgacggcgagcctgtccagcgcgtcgcagatcacgtcgcccaccgggtgcgtcacgtggccctgcacgccgatgccgcccaccgccgcgccgcgcttctgcaggtcggtgaccagctccacgtaccgctccggcgtcgcgttcgggtcgttggcgctctccacgttgtagtcgttgacgaacagcgccggcgacgggtccatctgcgccgtctcccggaacatgcgcgcgttgatgtcgtcgcccagcctctgctggaagaaggcgccgtggagcatctcgttgttcacctcgtagtgcgggaacctgccgccgtaccgcgtcacgaggctgcggaggcggccctccacggcggcgcggagctgatcgccgttgagcgcgcggacccacggctgcacgacgttctcgacggcccagaagatgcagtggccgcgcacgggcttgccgtggcggtcgcagaaggcgatgagctcgtcggcgtcggagtagctgacctgcccctgcaccgcctcggtgtagtaccacttgagctcgttctcgagcaccgcccagtcgaagtgcttggtgaagaagtccacgaacgccgggttctggatcgccgtcttgttgatgcacgcgccgatggggaagctgttctccacctgcaccacgcggatcgccgtgccgcccgttcgccgccccagcttgagcaccacatcacgcttgcgcacctatgtagtagtttttgcagaaatttcgagtgttatgatattttgttactatattgggagaaagaaattcgtgtatgattgggtggatctttgattagatggggtgaaaatttttgtgcttgagtgagtgtgaagcaaatgaagcaaagtgtaatgttttcctttcattttacaatgttcctatgcaaattttatggtcatttgctcaacgcaatgatcatgtacgtgaattgtcatgtgggccattgcttttgcatgcgcttgagtgcaacgtactactcactttttgttgaggcagttcatagctcgtcatgttgcttatgtcattcatgtgatcacgttgcgtagtgctagatttttttttatgtaaaaagtgctatagattatagttatgtttttcataccttgtcagttttcttcctgaggtgcctgagcctcgcgatcttgttcacggcgaatacctgcaggtccatcaccttgagatccaccccggccggcggtccatggacgaacaccttggcgcagcgcggcggctcgtcgtcgtccacccggaaagagcccatgatctcgccccatttccccgcttccgccacgaccacgccgccgccgaccgggcgaccgtcgtccgtgcaaacctcgacgcgcacggcgtggcagcacccgtccgccgcccccgcgccctgcaggccgacccacccggccacgcggtacgtgactttggccgccggcgcgcgcgagagctcccggcagaggccgtccctctcgccggcacggtgcgccgccagcacgtaccgcccgctgggcctcggcctgggctcgtcggcgtcgtcttccgtagcggacagaggatgcggcggtggcgtctccggcgccgggtcgtcgtgcacggacagtgtgcaggagccagacggggtccagccggccactgccaggccgccgccatcctcgcagtgctcgacatggttcatgaccaagtgcgttgtctcctgcgggcgccaacaacacatggtgtacactagtgtcagagaaagacacatgtcgcggaacaccattcagagattgctggcgcgaaatgggtgtggttgaagaagaaatcctatagcagttcgatatgggtgacgcactggctagcttattgtcacttgtcaggatcagacagctaatttatgtgagacatctgtaacgagctactccagctcgtgtagttttgcttggctttaaagcagagaattggaatgcacctacaagggcataactactctgaattctcaagagaattggaatgcacctacaatgcacctacttttgtgccatgaattcacaagaccattgaagttgcaataaagttttaattttcaggttgccagagtcccagagaagaactaaacaacaagcaggtttgccagtgagctctcagctctggcagtaatattgcaaactttgccaccaaccactgtaagaattggtgtgttacaatctagtagagagcagtcagacatggtaattaagctctaattaagctgagtagctgacagttgagaacttgcaaagctgagagcatcacatacctcggtgaacgccatatggaccgaaggagtgcgaggggaaaactctgaatctgcagcaagtctcagctagcgtttgtgcttttggctgctgggttccggtggcaagtgagaccgactgtgtgagagatgagacgcacgcaggcgggcaatttataaggctgcgtagctgccggtttggtcggcaatcacacatccatcgcgacacagcggaaaggcagagtcactagccaaaaaccggtgtttcatacagcagagactactaaaaccaagcttagctacctaactcatatctttctcctatcttttgtacaaaactgaagattgggcaatgcagattagtcgtcacactggaccgtacaagtcgctgacgagtggggcccgattgtctcggatgattagtcgagaagataccgtaggtaattcggtcactctgataaattagcttcttattaatctgtcatggtaatgatcactagcaacatccaagcgtctccggatcctgacacttttcttggctttgggaggagtaaaagtggatcaatccttcggtcgttggtgggacaattgcattttattatattttgcatggatcgttaacctaaagctaaaaatgaaagcctgtccatggaagaaaaaaaaaacagagatgtcctcctgatgggcatgtactttcaacagacaatcttctcgtctctgctagtacgactcgtactagacaaacgtcgatgtgaactgcaaaagatttctactagcttttttgtgaaaaaaaatgtgaactgcatgtttcaccattggagtagtgctacttgcagccgtcccaactggatctgtctagcttttcggtgaacgaagttacaagccatagccatggcgtcaagctacgagaatcggccgacgcaagatcgtgacacgtctagaagagcagatcagaatacagcatatgcatatggttgcatctcgtgttccagacttgcacacttgagcttgcatagcctcatgtctgaagtctgaacatcgaacgaatggaacgaattcaacggatgaatcttgacggcacaaacaagccgccgaccggagcaaacattgtgaatcgtgatgcatttttacatgcaaatccttgcttagaaagcatcgaagcacgtccacgaattgatcacaaaaaattatagaagttaatgcgtaatgaacttgcatatgcatggagatcgcacgatctgtatatctagctttaataaatattttccttgcaacatccaacacatatcttcatatctcaaaagacacttaaacagtacctactattgcattggataatctagaagaccaatagatctagagggatgaactaatctagcaaaatacagcgtgtgacgaaaatacggtgatagtaatgaatgctataatacttttttgcaagaacaccagtaggagtatttgtttggcaacaaattttactccatttaatcgtcgcaaaaaaaaaggttttgttaaatttcgttgagggccttaatatatgttgggccaatgcaatttgggccttttaagccttcgatccagaaggcggtggacgctggtcatgttttcatttggaagtgcctctgttcaacggtcaaccgccataacaatttgtggtttgaattattttcgaagagtttttataccttttttaagagatgccatgttttttttactccttttaggaagtactgtcaacctctcatctccaatcattgacagcggtggaaacaacccccggacatgttggggcttccagagacctagataaattgggtggccactcacgctctattgttgtcacttttactattgagtgctatctatttaagtgaaatattggtcgatcatcgtgaaacgctattaatcgtttagacttgccgttgggaattaactgaacaagctctaaatgaaccgtgttttaacttttaagctctataaaacaacaattgagaccatgtttagtacaactccttgtcgcctcctctaacctctaaactttactatacgcctgcgcggactatctttttatcggttcaacacacctaaaaggaatataaatggctggaaattgagggggaaaaacattttctgaacctaaccaaatgtggtagtacaaaacatcgcatattcgttatattatatttaaaaaaagaaaatcatgttctataaaacgaggattagcccgtttttaccttatttcttgattaactttaaccagtacaataccttacttttctcatacaatacccaaatgttgaaaatgtaaaattgtagttgttgtatgtgaggtacaagttgctttgccctctgtccgaagtggccgtgcaatctgttctctgctctcacacagccaagagtggaaggaggactcattcaccagtagacaattaggatgcccaatggtggagaagcatccaccacagcttcctggattaggggcaggcgaccacgatatgatcaattctctcctcatattgctcgtagagaacacagagatccggatgcggtaagcctctggggcacagtctgtcagccgtccaacaacgctttagggcaactagccaggggaagtaatgacatcaagggggtgcaagagacctccagataggctcttgactgaaaggggattcgaccgaagaagaaagcattgtaggccgagctggaagagtagtggccagaactctcccacttccagataaagcgatcaagtcgatcctcgagctggatcgattgcaactatttaaacttttaaggtctattaaacaacgattgagaccctgtttagcacagctccttgtcaccttagaaatataaatagctggaaactgaaaggaaaaaaaacattttctgaacctaatgaaatgtggtagtacaaaacatcgtatatattgcacagataatcccgttatattatatatatatatatttttaaaaagataatcatgtactataaaacgaggaatagcccgtttttactttatttcttaattaactttaaccagtacaataccttacttttctcatacaatagttgaaaatgtaaaattgtagttgttgtatgtgatcgaggtaaaagttgctttgccctctgttcgatcaaataatcatcagtataaactgtatggagtataaaataatggaagtaatcgtcagacgtccatatccagcacaagaggggtgtcccccttctccacggtgaacgtcttgtgcatcttccccgtcgccgtcgcgagctgcacgacgtacgtgccgtggaagcccctgaacttgaagtggccgtcgccgtcgatgtggccgcgcgcgtgcgacgtccactcccgccggagatctatgaacctctcgccggcgtcgttgacggtgccgtcggagttgacgaggcaggcgtcctggcgccacatgtggccctgcatgaaaccccagaacatgacgccctcgacggccgggtgcgcgtacgcctcccggagcaccacctcgaggtcgtcggcgcggaggtcgacgtcagactcgcagacgtcgagctcggtgagccagacggggaggtcggtggtggcgagcttgtcgagcgcgtcgcagatgacctccccgacggggttggtgacgtggccctggaggccgatgccgccgacggccgcgcccttctgctgcagcgcggtgatctgctcgatgtacttctccggcgtggcgttggggtcgttgccgccctcgacgttgtagtcgttgacgaagagcgtggcgcccgggtcgaggcgcgccgtctcccggaacatgaaggcgttgatgtcgtcgccgaggcggtcctggtagaagctgccgtggagcatctcgttgttgacgtcgtagtgcgggaacctgccggcgtagcgggtgaggaggccggtgaggcggccctgcacggcggccgtcagctggtcgtggtcgagccccttgatccactgctgcaccacgttgtcgacggcccagaagatgcagtgcccgcgcaccggcttgccgtagcggtcgcagaagtcgagcagcgcgtcggcgtcggcgtagttgagctgcccctgctgcgcctccgtccagtaccacttgagctcgttctcgaacaccgcccagtcgaagtgcttcgtgaagaagtccacgaacgccgggttctggatcaccccgccattgatgcacgccccgaacgggaagctgctgtccatctgcatcacgcgtacggacgcccccgatatgctccccgccccaccgaacttgagaacgacgtcccgcttccgcacctgcaattaactcaccatcatctcaattaattcacgtacgacgcattgcatggactaattaatcttgcgttaatttggcatacgtggccgcgagagtgacttctcgttacgtgtcaatgatgctcatcgatgtcactatctaaacaacgaattatccattgtagccgtttatctactcacttgaaaattcgatcatttcgtactgtacgtggcacatcatgtgtcatgtgccacgtcgaaagtatgttggtcccgcctaatcatatatggtatagtaggtgctgatgcaatggtgaatggtgattgctcttgaaacgtaaaaatggagatgaaaccaatcgcctagctactgatcgttctcaccaataataaactgttttaaatttggtgcccatcgggtgatgtgagtgctcaccttgtcagtcttcttcctgagtttcctgaaccgtgccctgcgatccgtggcgaagatttggagatccatcaccttcacgtcgacgccgtcgggcgcgccctggacgaacaccgtcgcgccgcacgggctcgccttgagccggaacgcgcccttgatctccgtccacctgccggcctgggcgcacaccgcgccgccctcgacgacgcactcgtcgtcgtcgtcgaggcggaggttgacgcgcaccgggtggctcccctcggcgccgtcgccgaggctgatccacccggccacgcggtacgtgacgcggggcttgagcgcgccggccaccgcccggcgcagcccgtcctcctcgccggcgcggcccgccgcgaggatgtaccggccgctgggcttgtagtcgtcggccaccgtgttgatggtctcggtcggcaccttctccggctcctcattgtgcacggacagcgccgtgcactcgccgaccgccgcccagccggcgagcccgtcctccagcgtgctgttctcgagcaggttcacgtcgaaaaccaccccctgcaaacaaaaagctcaaccataatcgatcaccgtaaataatgctgcttttgaaaaggagtgagtacatagctggcaaagtgatcaatcaaccaattttgttgattgtgccgtaccttggtgcaggccatgatcgtggcagcaggagcaggtgatcgccggagtctggaacgacttgttcgccgtggattggtgatttgcggtggcgagtcacggcgatcggacgagaccgtatataaaggtccgatcggtcggccgtcaaaatcattgcgacatagttctaaagcgtaccgaccgccaaaaatattgtgcaaactcgaagcaaccaccaccacagcgagagacgacgacctctgcttctccttctctctctggctttgctgcgtttgagtaacagtaaagcttgggcaagcaaggctgcaattgcatgcgtggccgtctcgttgggtccagggagctgtgtgactggcaaagtgggacccacatgagacgtgccccacatgtcagaggggggtgctttgagataaggtgttctttttagtaagcatcattaccggcacatccaagcatgtgtcaaggccgggtccgtgcttttcttggctttgggaagagacaactaaaagcgatttgtttagtcgccggtaacgccaaacgtggaatcattagggcacaaaccaatcggagattagattcgacatggactttttctgtccacgataatctctcgtttttttagcactgttcgttaggaggactgaactcgtcatgtactgctaatctcatcatgctactgtgtttgctaattaatttaccggtaattaagcagagggcgcctagagctagccggaattgagaacttgggataagaggagaggagagtgcgacggcggcgtatccaagttgcaggcaggcagccgccccacgacatgactacgacgacgacgacgacgataatggaggatcaattaggcgtagggagtggaagtacgaagcttcaagacacaaacatcggctactaaaacgtgaggtttggtgacggatcgtgtggctgtcaatccaatgaaggaactttgtacttcatagccgcaggtccatatgaacatggatccttctcgaatctttgtttgaatcgatcgcatgatactctctttgctacgaaaatacgcaatggaaatgtacatgtttacaacattgaaaaagtccactttgactcccttaattatcggcagaatctaattcgtaaccctcaaccgcaaaaccggataagatgactccccgaactattgaaaccggtgcaatttgactctctcagcggttttggagggcggttttgctgatgtggcgctgacgtgttgatgttgacctagtctccgtctcacgtggcattcaaattaagaaaatatatgtgggacccatttgtcattcacacaaagaaatatattatgggacccactgacatatggagcccacatgtcatcctctctctctctctttttcaccggtctgcaagagcgagagctggacaagcggcggcgaccgacgggaggcaagcgacactagggatctagggcagcggcagcggcggtcgagggagtggtcggcagcggcggcggcgaggccagatcttcctcctccttctctctccctcatctctttctcccctgtttgtgtggccagcaggagtggtcggtggcggcgggatgacgacgggacggccggcggatgacgcctccgccctgccgtgcagcagccgggcaacctcattgtggcgcaccggcaagaaagccctcgccgcgcacggcgacgacgccgcaggtgcccatcttgaggtacatgatgggcccgtacttgcgcgctagcgacgccaggtcggtgtgcggggccgggccgacgagcgggagcgcgtcgaggacagggacgcccgggggtccggggggaggcggcggccgccgccaggggagggcgggcggtgtcacgccccgaactagtcccgaccggaactagcccatgacgctccaaattaacctgttaatcgataccagtcccaggaaacagtgctggtatcacaggaagacagattatcacagcaacagaggtctctttattatagagtaggagtacaatcaagtcgggctgcggacagatcccgagctcacaactgcattacaaaagggaggcggaagccaagacttggaccaaacaacacaggcgcgacttgggaactaggccgaaaccctaaaactcatcgtagccggcttgctcctggaagaactcctcgtcagcgggatccgcttcatcttcttcagcaactggggggattatttatatagagcaagggtgagtacgggagtactcagcaagccatgggaaataagtgtttaatgcaggcttcaaagaaagggctgttgtttttgcaattgattttatttgaactcttttctgaaaacaactaagtgagtgcttctcaaacgacacggatgagacagtgcgtctcgtccggtcggagtatgtgcaatgtatcagtctttaaaattgatcaagattggcacccggccaacaactttcaaacggccacccgggccaacaactttcaaacggccacccgggcctagctgatcccatcagctgcagattttccaaacaacgatccccttttcacgacagcaatttcacaaggcagtagtcaaacaaaactacgctaggaatcacctcacatccgcccatgaccgtgggcacggctgttcgaacagtttgttgacctctgcagagggggtacactttacccacacgacattactaacccggatcacccagcccgtggggatcagccacgtcgggagacctccaagctttcatgacaaggcatttccaaagccgacacaggtttaccatatgccgatgagaggggtcccagaccaacaacaggttaggtcccagaccatactgtgccaagaagcccagaggtcctccccgacaccaccccggcgaatccacatgtctctcggcatcaaggctcccctgataagctagttactcaaccaggggtgtcccattccacccatgtggtcgtacttgtcttatgttcggatgaaattccaaggaaacggtccttaagtgcaagagcgggaaaccgtacacccgatacgttccccggtccgcggttttggaaattcatttagttcgcaagcactgacccaggtgtcgggttttccaagccttttgtaaaacccaagttttacccaagaagtttttcagattttaagtttgaaggcgaccgtcgatactcgcatagggtgcacgaatatcgaggcgcaactagatggttacaaggggacatgatataacaattaacaaaggaaggatcaaatgcaacaaattaggtaagtccgccaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcggactccaaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttctaagattattggatttttggtctaaaggaaaaggatttaattaaatcctttttgaaaaagaaaagaaaagaaaagaaaagagggagggaaattagacttccctcgggcggctagggtgcggcccgggagaaaaggggcggctcggccgagcttaatgggccggccggcccaaaaggcggcccagagcgcgcgcgggaggggaggagagagggagccggtggaccgggctcacctcgcgtggtcccgggtgggacccgcttatcagcggctcggctcaccgtgcggagggagtatgcagcgtgcgctagggtttggggaagggacgcggtgcacgcgcgcggttcatggaggacgcggatgcggcgggcccacgcgtagcctcacggctcgcggtggaccgcacccgcgagcggggccggagggagcggctgaccggggtcggctcgacccggtcttggccgagctggcgccgacgtggcgcctacgtggctgccacgcgggccggcgggaggtagacgacgatgccggccagaacggacggcggacgacagcggcgagcggcggagcaaaccacggcgatacaggcgaaagcgagcacaccgggtggttgcacgagacgaggggagacgagccaacggctcggattcgccggagggagcttgatggcggcgaattgcggcggcggcaaccggcggcggaagaagggggaaacagcgacgaggtcacgaggggccgattcccggcggcaaaagcatctacgcggctacgggaatccgatgctagcgttgggttaggaggaaacgcatcgagggaggccggcgacgagaggcgcttccgagctcgggcggcgagcacatggcgagcggcggcaacggtcggggcggcgccggctagctacggggaggctacttgtcacgaccggaaataacccaacgggcgttccttacgtgcgtgcattaatccttgtcccaggaggcaaggtacaccaaaagttaatacaattcagagtttaacaagcg

SEQ ID NO: 64641 - DNA, 4312 bp, Oryza sativa
agggagtacaaaggagttatacaataaagggttagggtttgcagtaaacagcatttaaaggtaattagttgctcaaagctattttgtaaacgcgaatctagaactataccatattgtttatcaaggccgtgaacccacacgaacctgccttaacccaaggcctacgatgattcagaccgaactggcaacccgaccctgggtcccagctcgtcccaagccaacccaggccaaccattccacattttagttgctaagcaggttttaagaattaaaacactaacttgggtacattactcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataatccaacagttccaaaatgtcaaggtgatatgaatattcccaaagtctagagttgtaaaaccacctaatgttacctaattaaattgcgaagcatctacctaaaattaaactagtggtgccatgagtagagtgtccactagttggggttttgtttactctagggtgaacaaggaaataataacaataacaataataataaggtcgtaacaaaggtaaataggcatggctaaacaaaacaatgataacgcgggaatttaaataaagcgataatgcgataatttaaatcaacataattttgcaaactgggattcaatatgttcaaagatgatgtgacttgccttgctcgctttcccaaacgtcggcttcaacttccacgaagagcagatcttccgaagctgcagcgtctacacgaccaacggaaaagaaaaggcttttactctaataaactccatataacaagcagaaacaaagcacaaaaatgggttcttgacttcttaggaaaaaattagagacttgaacggtccaattccgagttcaaatggccaagttatggccatttgaagtttatatgctctttaaatgaatatttgcgaatttcttcatttaaattttaatttaaaatcggatttattgcgtcagccgaggggaggggtgcgcggaccgggtccacgggagtggggcccacgtgtcagcctcacggtccacggtggaccgggtgcacgcggcttgcgccggccggcgccgtgggtcccacgcgtcagccgcacccgagggcgcgggcggctgacggccgggccccacatggcagccgcggggcgcgcccgaagacggcctcgccggcacggccgacgggatgcggcgcgcccgcgcccctatggtcgccggcggcggccataggcacggcggagcggcggccgagagaggggagggaagggggaaacgaaatgggcggtccatggctcaccccgggtcgacggcgacgacgggaacggcaaccgaagcggagagaggcggcggcgcggctcgggtcgacgaggacggcggcgttccggtggtcggcggtcgaaacgaaggggtggacgaggtcggcgaggacgcggcgaagccgaaggaggcgatgccgaagcgggaggaggtccggtgcgacgacggcggcggaccggagctcggcggcgacggcggagagagaggacgacggcgcgagctcgattccgacggggagagagagcggcgagcggcggaaacggtggagataggcacggggagtgtttatatagtgttgggagtgagagagggcgaccggatgaggaggaatcggccgcggaagatccggccgccattgatgcgccggcgaagttcgcgggagggtttccaaacgaatccgagggagagagagagggaaaagtggggggggaaagagagagggaatcacggggagtgatttccccctctttattgcgcgcgggggcggcgggatgcggcgaaatctgcggcggcggcggcgctagggcacgggcgaggcggcgggtgcggcgcgaggtaggggatgacgggtgggccccacccgtcagcgaaaagaaaagaaaagaaaagagggagggaaaatagacttttctcgggcggctagggtgcggcccaggagaattggggcggaccggccgagctaaatgggccggccggcccaaggcggcccaagacggtcgcgcgcgcgggagggaggagagagagccggtggaccgggttcaccgcgcgcggtcccgggtgggacccgcttgtcggtgacacggttcaccgtgcggagcgagcacgcggcgcacgcgcgcgggcgggggagggacgcggtgcatgtgcacggtctgcggaggaacggatgcggcgggcccacgcgcagcctcacggctcgcggtggaacgcgtgcacgggaggggctgaccggggtcggcccgacccgacctcggctgagctggcgccgacgtggcgcctacgtggctgccacgtgggctggcgggaggaagacgaaggcccggccgccaatggacggcgggcggcggcggtttctccggggcgccttgcgacgatgaggggcgacggggcgtacaccgggacgacgaggaagaaggagagggagcgagccaacggcttggattcgccggagggagtctgtcggcggcggatttcggcggcggcaaccggcggagagcaaaggggaaaacggcgacgaggtcacgaggggccaattcccggtggtgagagcatctacgcggccacgggaatccgttgctagcgtcggattgagcggagctacgccgagcgaggccggcgacgagcgggtgctacggagctcgggcggtgacggcggcgagcacactgcgagcggtggcaacggtcggggcggcgccggctagctacggggagactactcgagctactaccgaaaactaagggggggagatggagcgaggaggaagaacggagggaggcatcaccgagatgaggaggggcgctgtgacgagaggccgacggtgcgggagggatctctccggcctcgggccggggaagaggaaggagaggacgcgcccggagtccccttccgcgtcctagtgcgcaccggctcctccggcacacacgcgacggctgcggtcggcgagagggacggcaatggcgcgggcgagaaacagggaagattgggaggggaaaaggggaagggagggcgcctgggtttatagggggcggcaatgtcggtttggaaaccgactttggcggtcaaggcgcgagctggcgctccggctagcggccaaaatggcgacaggagggagggaggatgacgccggcgggaggaaaaggggaaaaaggagggggagaaaggggcttgcccccttgccgatttgggaaaaaggaggaggggagcgggggcgtcgcggcagagggaggagggctctgcttccgtcccttggcggcttgcgcgcggagtggcggggccgaggcgatgacgacggcgatgtcggcggggcggtttggagcggagcggtgacacgggcgacaggcgcgggcaggcgctgacgacggcggcgactaggcggttggccaccacggcacgcgcgcgcggcttgcaacaggaggcgcgacgggtagagtggcgcggctcgggcacgcgcgctggcgcggacggcgcgtcacggacggcaaccacgcgggcgcgcgcgcgcgaacgacgcgcggggagcggcagcgaggcagcggaaaggagggctcggctcggcgcgggcagctcacgcgctcgcgcgcggcagagcgaggggaaagggggggcgctcggcgcgagcggcttacgcgcacgcgcgcggcgcgcgggcggggcggagcggagcggaggggagcggaaggggagagcgagagagagaaagggagagcgagcgcgggagggaagggagagagccgggggagagggggagatgg

SEQ ID NO: 64642 - DNA, 31030 bp, Oryza sativa
ttgagatcttgagaaggcacggacactagacgacaagcaaagaaacaaatttcgcaattagggtttttttttttggagataatttttccgctaggcgccacgacggaacgggcgctacagggaggagcttgggtttataggggcggcaatgtcggtttgggagaggggaaccgacattggacggtcaagccgacgagctggcgctccggctagcggccaaaacggcgacaggaggtgacgccggcgagagggaaaaagggagaaaagggggagagaaagggggcttgtcccttgcctctttgggaaaaggaggaggggagcgggggcgacgcggcagagggaggaggagctctacctccgtcccttggaggctagcgcgtggagtggcgggggccgggcgatgacgacggcgatgacggcggggcggtgtggagcggagcggcgacacgggcgacaggcgcgggcaggcgcggcagaggctgacggcggcagcgaccaggcggtcggccaccacggcgtgcgcgcgcgggaagcaacgggcggcgcgacgatttgagcggcgcggctcgggcacgcgtgctggctcgcggggctgagcggctgcgcggctgcaggcgcggcagggcagcggggccgggtgacgcagacggcgcaggcgcggcacggacggcgactacgcgggcgcgcgcacgcgaacaacagcgcgcaggggtcgagtcggagggctcggctcggcgccgcgcacgcgcgcgcggcgcgcgggcagagcggagagtgagcccgggagggagagagagagagagagccggggagggaggggaagatgggccgagagagattcggcccatccaacctgggggaggcgaaatagacttttgcggagggactttcgggaaggatttggattcgggattgaactcaacaatagatcggggatttaagatctgagatgacacggacactagacaacaagcaaagaaacagatttcgcaaatagggtttttaagagatagttttcccgctaggcgccacgatggaacgggcgctacaggcggtaggagcagagggagaggtggaggaggaggcagaggaaggggccggagagcacgacagggtcggtgcagagcacggcgagctccatggcatctggagcgacgaggcggggcggcaacggcgccgtgggggagggatgggcgaggacgtcgacgactcgcggggagagagaaagagaggcggcgagggggactccgctccgggctgggtgaactctggccgggatggggttggaggaggcgccggccaccgccgctccggcccccgtccgccgccgccgacgatctggcccctgctccggccttcgcccgcccgccctcctgccgccgctagcccccatcccacgctcgtaaacagaaagagagagaaagagagggggaggttgaagaaggtagataagaggggatgacacgtgggccccacatgtcagtgggtcccacaatatatttttgggtgtgaatgacagatgggtcccacatatttttttaattcgaatgccacgtaagcgccacgtaagatgaagactaggtcaacatcgacacgtcagcgccacgtcagcgaaaccgtcctctaaaaccactgagggagtcaaatttcaccggtttcaatagttcggggagtcgtcttatctggttttgcggttgagggttacgaattagattctgtcgataattaagggagtcaaagtggactttttccttacaacatcacgtatatggaaacgatggaattaaaatgtaagcccaacccagcccatctcacacacaaaatggaagggctttatgggcctgctaattaacttgaggaataagtttactacaggtccctccactgtcaaaaccgttgaggatgtaaaatgaacttgtattgacaattaagggatgttgtatacccggttttgttgttgaaggaagtgaaccaaattcatcaacaagttgagggacgtaatatggattttccttcagttgatcgtctgctctattgggctaggtctacgttttaccttgcgttggaaaaagtacaccaaaggtcactcaacttgtcatcgagttacaaaaccgtcctcctatcgcaaaaccagatatcagtcgtctctcaactaattaaaaccggttacaataggtctgacccgattttattctacatggcggctgagtgagcgtggaaccaacgtggaccccacatgtcaggatgccacatcatctctctcttctcttcatcggttcagagaatgccggggaagcggagcacgagcaccacgccggtggccggagctggaggagctcctgcggctgcctctacatgaacttagtacggggtcattgactgcttcatttaccaatttcccccccccccccccccccaaaacaaaagctgcgatgaacattgctacgcaaggacatgccgggaaaaggactcattgacctctagtgaagatggaaaatggtgatgagaaattggagattgacgctgtctagacatgaacttagtacggggctacggcgacagtgggcagccagtacacccgtgcagaggagtaaactgttgcaactcaacttgggtttttttcgacaacaaacatctcgtggattgagagttcatattggtttcttgcacagattaattgcagagcaacaagaagattgggggagaacatggcactataatcgaattaaaatataccaaaagatcaaattaaagaaaagaacagtcaaacccactagatccctgaaaaaaaactgaatctcacctagctgtcagaatcttcagagcccccttgattcttcagctcggcttctcagacacgagataactgaatcgaaccatggaagaaacaggaggaaatacggagaggaagaaagagtcttgagagaggagtggcgacgcggagagaggaaatacggtgagagaggagtggcggccgctgaggcaagccaccgccgtcctcgcccgcctcgggacgtcgccgaagtccaactgcctccacgctgagtgcgcaagcgctgctcttccagcccccaggacaggagcaagcgagcggcggccccgagtcgtcgtcgtgctccgcgtcgccaaccgccgcccgtcgcgccagccctcctctcagccgcgctcctcccctgccggccgccggcacgcccgccgcgccggcactcctcccctgccgagtgctgctcgagaggagaaagagaaagaaaaggaagggaaaggaggggaaagagagaggatgccgacgtggcatcgtgacatgtgggatatacatgggtttcatgacttggccgtcacgttgaataaaattggtgtcaaaaccaccaaagaatctattgtgaccggttttgatcagtcgaatgacgtgggatatctggttttgtggttggaggatgattttgtaactcgataacaagttgagcgaccttcggtgtactttttccccttgcgtttggtctatttttactaggcccaacttgagagaggcccactcagagtgaaggctagtctgggctgggcaaccgagtagacagtccggaataagtccactttccttccctcaactcatgcgcttggttgaatcacatccctcaactacaaaaccggatataacccatccctaaactccgaaaaccgttgcaaatcgactcctcgaacggttttggaggcggttttgtcctacgtgacagttgacttgctgagtcaacaagcgggtctcacatgtcagcagtctgagtgccccttgcaagtgccaatgataaaaaaataaaaaaaggtaggacccaccagtcaacctcctcctccttctcattctccctaccttatctctctctatctctctctctcgcaggcaacggctggcgagcaggcggagccgccggagtagaaggctacccgcgcgcggctgccgctggcgacctcctccctgttcccgcgcacggccgatgaccccctccacccacgcgcggccgtggccggcgacctcgtccccacgcctgcaccgaggcccgtgacagcggcggcggccggcgacctcgtccccgcgagcgtgccgcggccggctacccattcccccgagcgcgtcgttgctggtgagctcctaaccatgcccgcgcgaggcctccatcggcgacctcttccccgcacctatgccgaggccagcgacccctcacccatgcgcggtcgcggccagcgacctcctccccgcgcacgtgccgcagccggctatccctttccccgagcgcgccgctgccgataagctcctaaccatgctggcgatgatctcgtccccacggcggcgcccatcaagcggaggatgccggcggagcgatggcgacgacaggctgcgggcggagcagaggggcgggcggagcggcggcggtggaggtggccagaggaggaggaggtcgccggcgagcacggtagctgtggcaggtgcgacagcggttgacgacgacggtctactccactccgtcggcatgctccgtccaccgccgcttggcctgccccgctcttccctgccgcggtggggttccagactgtggcgaggagcgcggaagcgtggtcggggaggcccatggaggagagggaaaagctgccgccgcccgcggttcctctcctcccaccagctgccggcgaccgcgcgccgcttctgtcccttctgatgcttcccgcggttcctgttccaccggccgccgctcgtgtctcctctcccacccgtctccgccgctcctctcccgtcccggtgaggtcaacgggtgcggcgacatccttcttatctgcccgccctgctctgcccttctacttcctctctcgccgccgccgaagacgacgacggcgacgggttcgacaacgaccgcccgctgccctctcccggcggcaacccgccactgcccagctccgcccctctgctctggccaccgtcgctccgcccgccccgctcagcccctctgctccgctccgcccgtggcctgctgctccgtccctctgctctgctccgcgcttactcagcaccggtgagttcatactgcatagacacttacatgtgggtcccaccgtgctgagtcacgtcgccaaccgagtcaacgacgccacgtcggacgaaaccaccagccaaaccaccgaggggatttgccaaaccaccgagggaggggatttggtctggttttcaaagctgaaggagccgatataccagggacgtgatttaactagggacgagagttgagggaggtaaagtggacttatccctttcagtccaacgcagaacaaacatttcggcccaacgacaagagctcaagaagcatttcggcgaacggaaaatcatattccaaatttaattggcacatccgcacatgaaagcatctcacaacgaggtggtgcatttccctcgtcagccacagcatctgacagataagcagatcacttacctgcatcactgcatgtacattgacaatctgggcaaactgaataaaatgtactggtagtagctacagattacactgcatcttgagatcaatatctaaccagagaggttaatgacagaagttatgctgacaagattgcatactacttactgcagataattgaccaggtacaaaactatgtggttaaaggagtggacgtgaagaaccaaaattcagtagtgatggccagtcaagtagatgtagcagccttttctggccggtgcctgcatgcatatgcaattgacattgctgcctgagatagactgaaggtttcagagggctaatggattttgaggcataacaaattggactctgctttttatggtagccttcttctagatcatggaagctggttgctttgaaaattgtcggatggcggtgatccaacagagatgcagagtaacagaaatctactctgccgtagactgtataatctcccgtgtttgttgaactaactaccatatctcaaatctgaatgtataatctgccagtgtcaactgcgtgcttccatttcaacccgaggtgtaacatgtgcacacaaaagctcttctctgaattccgcaaataaactctgcttaatttgcagatgagttcgtagttgtcactgttaccgctatgaaccccgtgtggatggtgggggaaattgacaggcgtcgtcactcgtcagtgccgtgaagaagaattaaccaaaactcaatctgcatgcaagtgtccatggttgcctatttgttgctcttctagaagtagtggcacttgttgctcttgcttgccagttgccacctcgatcctctagtacaatgttactagcattggtgctttgcttacttttgaatcttttgtggcttcacaatggccgtcaagatcataaaaatagagggccgttttggattgaagccaaaacggtgccttaccaaaattttagtaatttaaatagtaaatatgttagtttggtttgaagccaaacccatacacaatttggccatattctagaatcttcttcaccatactactaaattttggctccatgttggtatcaaaccaaaagtaggctaattaactttaccctaccaccaaaatttacctagattttgtcacactaccaataaatagttagggtaccaataaatagttagggtagagaaccaaataggccaagaatccacaaaccacacaaaggaaatactcaaacacaaaaactgaagtatgacgagatgagctttgtggaagagaagatgaccagcaattctgtcattaaaagttcggccaaatcttagctggtccagatcaaagtagcatacatcagcagatcggtgtacacataatcacatataataatatacacggcgctgctaattacacatggaagcatcagtcatggtctcatggattcagatcgatattactacccttttattacatcatttctaggtcaaaataatgacaaacagaagcgagcacatctagatgacctgacactgttttactccgtcttggccttgtcagcgccgccggttgcagcggcatcacggcacatcatcttcttgaactcctcgaacccgacgcagccatcgccgtcgacgtcgacggaggcgatcatcctctcgcactcctcggcgctgcagccctcgccgatccggccgaggaccttgccgagctcggccgccgtgatgcggccgtcgccgtcgacgtcgtacacgtcgaacgcggcgcgcagctcggcctcgtgctcggcgtccccgcgcccgcggccgtggaacgccgcgaactcgccgaggtcgacgaagccgtcgcggtcggtgtcgagctcgttcatcatggcggccacctcgcggccgccggcggactcgctgggcggcggcgcgatggcgcgcgtcaccgcggccagctccgagggggagatcctgccgtccccgtccgcgtcgaagcgggtgaagaccctctcgatctccgcgtccgccggcgccaacgccgtcggcctctcaacctgctgctgctgcggcatcttcttctcggtggtgttcgacatggttgcaagacttgccgtaagcaaaagcttgagcttaattagctgagtgagcagtgatcagaagtgtggctgtggtgagctagagctcgcaacaatgcagaggggagctattaataggggtaggtgcacggcgcacgcgccattgacgcgcaccgacttttcatctctttggataaagaaatgcatagtcgtacaggagagagtctttttgtggcctttccctgctgcataggccggcgtggcaagcgcgtctgccacgagtcgccctcgtgaacatgacacgttgtcggctgatggaagtggtgcgaatctcgggagaattgatgcaaatttttcgaccttttgcaggcagtttcttcgaagggggtgcacatgtatggagagtacgaatcaccggccacgtcttccgtgtgaccgtgctgaagtatgtatactacggagtagtatagtcgggcaacagtttgctgtagctttcatggcctatcagtccagaagagctgtgtacttggtggatagactacacgtgtccacggagggaagaaaaatgagagatcatagtagtatatagctaactttgccatttcaactcaaaatgaaaagtaaactcattctctttttgaataagtccattttacctccctcatctcttgtccttcgtcgaataacatccctcaaccaaaaaaaccaggtataacgactcactcatctccgaaaaccagtgcaaatcgactcccaagacagtattgagttcagttttagcttaggtgccatctaagtggcattcaaagtaaaaaattaggtgggacccatgtggggctcacctatcacccttcccctcgctctttcatctcctcctctctcacaatctcatgccttcaatcggctcgagcagcggcggcgggtgtgggggaggagctcgccgggaggccacggccggccgggcgcaggggaggaggtcgccgccgggtggacgcgggggaggaggtcgccgggaggtcacggccggcggagcccgggggaggagctcgccgggaggccgcggccggccggatgcgggggaggaggtcgccgggaggccgcggccggccgggagcaggggaggaggtcgccgggtggtcgcggccggccggacgcgggggaggagctcggcgggtgaccgcgactggtcgggagtgcgggacgaggtcgccgagtggccacggccggccgggagcgggggaggaggtcgccgggtggtcgcggccggccggacgcgggggaggagctcgccgggtggccgcggctggtcgggagtgggggaggagctcgccgggaggccatggccggctgagcgccggggaggagctcgccgggtggtcgcggcgggccgagcgcgtgggaggagctcgtcggaggtcgcggcccgccgggcgcgggggaggagctcgccgggtggtcttggccagccggtcgcgaggggaggacctcgacgggtggttgcggccggttgggagcgagggaggacctctccgggagtaggagtagatgagtcgtgtcttcaagccctccgaggcccgcccccgaccgacgttcgtcgccaccggccggccgaatcagcctcttgcatgtgcggttgcgagaaagagattgaaaggaggaagaagataagaaaaggggctgacaagtaggccccaccatttttttattttagcatttgtcacttccatgtgggacccacttctattttggtgatatggccgccacatcagcatatttggaccaagtcaacctgccacatcagcataaaccgcttacaaaaccacccgaggagtcgatttacaccggttttcggagatgagggagtcgttataccttttgtgtggttgagggatgttattagacgaagggcaaaagatgagtgaggtaaaatggacttattccttctctttttatacgaagaagaaattctaaggtactccttcacaaatagtgccagcccagcaaaagtccaatccagctccgtgaattgaatccattatccatctcgtatagattatcagcccattgtgcaatcctaacaggcccatttaattttgaagcctggtccagtccacgccaccaacggacgcgccgtcgatcagctctagagatctcgcgccacacccagcacccgctgcttgccatatgccggtgacctccagaacaagcaggaaacctcatcactcacccactcctcgacccttcacgacgcatccaacccatcctcacttctcaactgattctcgtataaatccacccccctcgaacaccggatcatcggtcgccaaaaatcacacaaacctgcgtgcaaagccatcttgatccagcgagcaaaacaaaacaaacgttggaattaaaccgcgaaaccgagagcaacaaactaaccaagcagtaaccaacagcacaatgtcgctagtgcggagcggcaacgtgttggacccgatgtcggtggacttctgggcggacgccgacccgttcggcgccgtgcgctccctcgcggagcggtgccccgtgctcaccaacgtccgcgtcgactggaaggagacgccgacggcgcacgtcttcacggccgacctccccggcgtccggaaggatcaggccaaggtggaggtggaggacggcggcgtgctcgtcatcagcggcgagcgcgccagggaggaggacgtcgacgggaagaacgacgagcggtggcaccacgtggagcgcagcagcggcaagttccagaggcggttccgcctgccgcgcggcgcgcgggtggaccaggtgagcgcgtccatggacaatggggtgctcacggtcaccgtgcccaaggaggagaccaagaagccgcagctgaaggctatccccatctcgggctgatcatatcaccgtccgtgttcggctgtttgctgcgtgcatttggcatgatcacaaggatatgccaataataaactgtgtttcaagcaagggaaaataatataattgtcatatgtagcccgtacgtacgtgtcgctcgtgtgtatgcatgtgtgtactagtagtacgcactacgtgtgttacagtattgaactgtcttaatttgtcgttgatgatcagttcttcgtcagatatgcgatcatgtacctgtctaccgcggatatgggaataaatctgtattgctagtcgtacaagctagttgatcgattcatttcactagttaaagaaatggaggacatgcgtgtatgggtcaggggagcgtaatggtattgggactagctatccatcacacgacagatttttgagtctaaatcacacagattttagatagttagattaggctcatttaatcacttgattagaagagtctatgcatgtatcaacatatattaattatatatattgcatatattttatttattagatctttacatcgcaaaaaaaatatcaccaactcatctactaaaagttaaagtgtaattacactaactataatgtaattacagtgtaattatagtgtaattacacttacatgtcatatcaactaaatttacaaatgtaattttagttatataggactgtaattttatattttaaaggaaataacaaatacacatttacttacacattattttttactaaaattatagtacacttatatatcgtatcaactgaaattacgaatgtaattttagttatataggattgtattttttttcactaatcagcgaaatgaaaaaccacgtgtttagctaaatcgaatagggaggaggaagcggaataagtgagaaaacggttccggacacggcgcactaatcaaaaaattcgcacggaaacatgggcccacgcggcctcaactcccccttgcgccctaatcagcacaaatcgtggcgtagatcatacggtcgaaaaaacatcaaatacgaaggaaaaaatcacgcgacaaattaatatatagcaaattcataatttaaatatttcaattttagcatcacagcgttggcccgtaatgcatgcatgttaattttcctcacccatcatctgtgggcccatgtgcgaagggtcagctggcccatgaaaacacacagatctcaaagcatatcgaaccgtcaaaaattctagtgatatctcacgagaaatctgtcgacagacgtttagcaaaatcgaatggtattttgtttttctttctcaatttcgcttcggcccacgggccatggcgagagaaggctgatctcatacgaggtggtctccttgtgggaaggccccagagtggcttgcatgaagccttgggtggtcttcggaaaaagtacattgaagatctatctcaacttgtcatcgaattacaaaatcgtcccccaatcgtaaaactagatatatgacatctctcaacttacaaaatcgttcactttagatcttttggtggttttgactccggttttatccggcgtgacggctaagtcagcataggacccacgtaggccccacatgttaggaaagagagagggtgatggcatgccctcctaacatgtggggcccacgtgggttctacgctgagtcagccaccacgttagataaaaccggggtcaaaaccatcgaaggacataaagtgaacgattttgtaagttgagagatgtcatatatctggttttgcggttagggggacgattttgtaactcgatgacaagttgagagaccttcgttgaacttttttcgtaacggaattgtcagtaacgtgctaggtcgaaacctctcctccggtaatagcccaaatatagagaaaacaccaactaattaggttttaaggttagggtgggtttgggaggtgcttaggggaagacagggtttccccgaacttaattagagggatggttggagtgacggtggcccatcgacaggcaatgaaaaggcaacgacgacagcaccacttgaaccatgggcgaggagagccagttggtaggcgggggtcaagtagttgactagttaaaaggagaaggaagatgtcaacatatccgacgacgtatgttgttggagccgagaaaggcaagacggggctaggaatgtcgcggctagggtagggtggaggaggaagggaggggtgtaaggaagcttcggcaatggtagatcaggtgagggatcgggagaaggaaagagggcttgtggcagtggcggcgggagcgggagtgtaagaaagaagtgaatgatatatcgcacaaaacttaactcgatctttgccattcaacattttattcactttttttaagacaattgagaaaaaggtaatgaacataaacaatggtaaataagatttgagccgagtttgaatcagcctttttgtttggcatttcgaactactgaatgatgttttttttttaaaaaaaagttatatgtagaaatttctttttataaatcaaatatttttttcaagtttattatggttagcacttagtaattattaatgtgctattcccttattgtgtggtgcgaaaaagccccgccagtcagccttgtttaatgaagcctcggttctaaaagatactaaatctatgtactttgaatcatcgtcaaatgaaacgtacgaacgagtacttaaaaaggtggtcgaccaattgctaaaagcaagttcacaaacgaaaattatgaccttaacatcaggtacggccgtatccgcgtatatggccacttttaacgtctggtacggccgttttatttcctcgcactgaaccggtccggtgtttcaagtttcaacaccaccctgtcgatctacagtatactgtaagtgtgaagatattaacgactttcgataaaatttatggttaaacaacttttaataaaacttatagactgtgtttagttcacactaaagtttaaaagtttggttgaaattgaaacgatgtgactaagttgtgtgtatgaaaggtttaatgtgatagaaagttgaaagtttggaaaaaagactttagaactaaacatgaccatagttagaccctgtgtagataggactaaaacttttaagttcctatcacatcgaatgtttggacactaattataaatattaaaagtagactattaaaaaaacccatccataatcttgaactaattcacgagacgaatctatcgaacctaattaatccatgattaacctatgtgatgctacagtaaacattctctaattatggattaattaggcttaaaaaattgtctcgcaaattatctttcatttatgtaattagttttgtaagtagtttatatttaatactctaaattagtgtgtaaatacagagactaaagttaattccctgatccaaccaacaccttaaactgtttgttcataactataatccgagtacaatgctgactgtagacacatggaacgaaccaaatttctgaatcatccgtcactgactgctgcgtgccaccttctcactgggtggagccaccatccaccggtttactttcaccatgctagcctgatgccccctagtgccccgccgctccacaagtcaaaccgaaacgccaacgcgtctgttcgccgtactgcgcgccgacgacgttctcccctcggtatgttgatggatcaaagcaccaatgccacgttcgttagttgcggcccagtgtcgacgaagatcgtctatcagccatgcagatggcatctgttgccgcgcgcaattgtcatcgcaaatggctgtcaatcaaatctatcaactgaccactcgtcgtcttttctttttttttctttttttccgttctgaaactttcacattttcgtgcaatgaggtaataagattgatgctttgtccggaccgtgaggcgtcgaggttcaattttctactgatgatttccacgactagtatgccggcgccgaagctagagtgctagacatcattacaccaacctttttttttctctgatctggtactcacttgtggtgcaaaatctgataattttagcattgaagttgacatctaggagaggatattttgtggatttaaaggtaaagagaggctcttggctacttgagtgctaattatcctgtgtcatgttccgctgttcgctacttccagaaggagcagcactattgtcacgataatatatccacttgcccaagagcctaccaagcagcctcgccagattgatatgcttccaattgtctgaagtctgaatcttggccaaacaatctttttcaatcgttttaccgcaactctttccaaccaaagttacagtcaccgtattcaatagagttgttttctccgggcaaagcttctgaattatgtcatgactacatcattaagcgatggcaagtgatgtgacgaatttcttggataaggctccataaacctacatctcatctcttaagtgctaagaaaccaacataaagcgcaatgaaatggattgacatgtggtggtgataattattccttcgcgtggctgccaagtgacttgtatgaactaatccggtttttgctaagcactgcaaagaagtcgaatatggaagtacgtttcctactatcaaacttaaattcaggatgtcacatttgatctgtctggctaatggccaccaagcattcctgagggcaaaccccaaccagaggactgaaagcaaagtcttcacctgcaaaactctagagtgcattaattaaggaagaaattgaggtctcgacgtgctgtcgatcggtacccgtcagtgaggaatggtctattctgcacatattttcatcggagtttttttcgtggcccaaaacgtttccccggcacggggaatctgtgatctttgtaccgacttttgtgtccattacaaactttggtgaatcagggacgtactaaacgtacgtgccatctgatcaaagaatggacaattcggaccgggcacggtggaaaaacatggctgtctgaaacctaccgttttggctgaattattggctctgtctccctgtttctttcttggactctctagggccttctactacggctttgtttagttcaagctaaagtttaaaatttggttgatattgaagacgatgtgaccgaaaagttatatgtgtatgacaggttgatgtgatgaaaaaaaaagcaaagtttggatctaaacacaaactactactcagctgcttcctgagagggccaggaaggttcatgaatgaaaaacacatgctacttgccttacttgcagcttggaccagcgtcgtcttctttcttctacgaagtattctcttctgaaaattgttgtttgattcgcatcatctgagtgtactgagtccctccgattcaccgaacaagtcgcaatttgcacatatcagtcaaaactttgcagctgaacatatattttgcagcggtttagtacgtaaccgcaagagcaagctactgaaacggggagtttgaaaacgataaagcaagcaagtgacgcagatgattacaagacatttactgcttttctgcctaacacaaaattgatgatgcacctaccggtccggtaacaatacttttctgaaatgaaagctccggtaatactactactcaaacaagataagctcagagaccaatagccctagaaatcttctgcaatagtaacaagggagatgtgattgacgacgcaggattcagacgcgcacgtggtgaccggagcttgcacaagacgccggagagaaagtgtgaacgaattcgacatcacccccatcaaaacccttaactgacggagagcgacgccgcaacaccacatccatcacttgcctgcagatttgcatctcatactgtccggggacacgaggggggcacacctatcaaatgtagggtagtactaccttgcagctgagctacagtacagcggagatcgatatatcgcgacgtgtacggccacgtcacgaccgatcgattcatcgagagggctagatgacgcagaaatgtgaacaaaaaacttaattaaacgtcgtcttcgcgagggtccaaaaggcagtatttaggtgccgtacagtgactgcacgactgtgggggcctcgctgtttcgatcgtttcacacgctggagaagaagaaggaatggcgccgatcgccgccgtcgatcggtgggaggaaggtgaagccgtgcccgagctttcgtcgtctctcgttggaaagctactgttttgacccgttcacaccactacgcttccagctataggcagtatgtacggtgccacgcacggctctcgtcctttatataaaccaactacctcgccattgccaccaccagcagcagctcgccatccaagcatcaaagcttctaaactgaagcttaatctatatataaggagagttcattttgattttggtgaggaagaagtagtagaagtgaattagtgatatcgatcagagtgtgaagaagatgtctctggtgaagctgtttgatacgttggcgttcgacgcctggaacccgttcagcatctttgggacgacggtggcggcggacgcgtggctggcgagcgacacgtcggcgttcgccaacacgtacatcgagagccgggagacggcggaggcgtacgtgttccgggcggacctgccggcgggggtgaagaaggaggaggtgcgggtggaggtggacgaggggaacgtgctggtgatcaccggcgagcgcagcgtccggcgggaggagaagggccagcggtcgcaccacatcgagcgcagctgcgccaccttcttcggcaggttccacctccccgacgacgccgtcgtcgacctcgtcagggcgtccatggacggcggcatgctcaccgtcaccgtgcccaaggtggtcactgacaagcagcccgccatcgccgccgccgcacccgtccccgccgtcgtcgcacccgctgtcgaggcgaaggcaatcgaagccagcccgtagtgatgcgatgaacacacacacacacacacagacagtcagtcaatccaacgatccgtatgtatacgttgtcgtcgatgataagttcaaagtgcttgcgagtaaggtgcttgctgtacttttggtttaattacctttggtgtgaaatgctttctcgatgtaagacaagaaagctagtagcaaaatcatactatttgcttgatgcaatacatgttccatcttagttcccttacgtattttgtgtgttcccatatgaacattatcaatcattcttttttttttttctgaacgcgtaaaaaaattacacgtcaacatattaaaagaaaagagtatacagcacaatcaatcacactggtttatatcagggaaaaagagaaaaagcaaaagaagaagcttcagcttcttcttatcaatcaggctgcgtggtgatcgatcagtagtcccaggtccccattcttttcgtcttacacggtattattttttcagaaagttttttaaatgaactttctatactcgaatatttgggaaattttcatgtgccttcgataatattctaagctcagtttgatccacgtcggctgtaaagactaaaggaacgtgcccgtgggccgtggctgaataacagtccatgttaggctgttactacgaccactaatctactgggggtcagcaattcggaacagatacatcacgattcacgagccccccaaaaaaatctgaagctgcaccagacagactgtttgatgaaaagcactagaggtagttgggtcgggtcccgtgaggacttgaggttgatgaatggcctcgcaacaagtagcacgacaattgacaggctaaggtctggaattaatgggtgaggtagcgacgcacagttgcagacagcagaccatttacaccaccaactaggaagagagaagcacggattgccggggtagccagcgttgctcccacgaaatctatctatcgcacgaaacggattccagtggcggcagagacgttttgccgatcgtggggtcaatcaatcaatccgaacaagttgggaacgagttgaaacacacaagatgggaagaggagagagagccatagaggggatcgtgggttgaccgactggatgccggcgtactctccgtggtggcgcaccaactttttgcacgccttgccggctgtgctctggctgcaggcgcacggggagggggactcgtcatctggcacgtcggggaatcatttgggctgaaactttgatgggctgaattttgggccttattctggcgtagtattgggttgggatcgcttcgcttaaggatggttacgttataaccgggctgaagatttttcgaaattgctaatcggcgcagttgcgctagataaataactagcgcgcgtttccgttttggcccatcattagccaggcctaaggcccaaccacacttttgacttttttgtttttcttcctgaaagcaccgacgcatgcatgtgctagtatagataggaattaccgcgaaggggcagttgggcaagtgagacaaatcaatctacagcttaattaacgctataattcttcattattagttctaatttttattaggtgccgtgattaacatgagcactcatatctgaaaactttcaacccattttttaaaactttcaactcgttctatcaaaaaaaaaactttcaactcaaatttgaaaatttcaactctaaattttgaaaatttcaacctaaattttgaaactttcaactcaaattttcgaaaactttcaattaaaaattcaaaactttcatctaaaattttaaaactttcaactcaaattttaaaaactttcaaatcaattatttgaaactttcaacataaatttgaaaactttcaattcaaattttcaaaaactttcaactaaaaattaaaaactttcatccgaattttcaaaactttcaaatccaaaattgaaaactttcaactccaatttttttttaaaaaaatcaattcctattctagaactttcaagtccaaaattcaaaacttttagtttcaaatttcaaaagtttcaactccgaatctaaaatttaaatcttcatgttagctagtactgtatttattagagttaatcatgcgattaactctaatcacattattagtatcagtaggaggggagcacttacatgggttgaacgtagcaaaagggaaacaactcctagtcagctccacgcgctcgcgacttgatcttctggcgcaagcgcgcgctaggagcccccaagattttttgctgggccgatgatttggaaaacaaacaggatgacgtacggagcacacacacgtctaaaaaatttagcattgtcaaactttgggtttattttggcgataaaccaagcataccccataatgaaacggaagtgagggcatattcactttgatgccatttttaaccttatcaaattttggtaaagttgccaaaaaatatagctatatttagtttgctgccaaattttagtaactatataaaaatcctaccaaaattttgataagttatcaaaactaaggttttttggtatcaaagtgaacaggccttaaataaaacatgcacgtctcagcgaagggaacggaagtgaatgacacttgtgcaaatcggccggacactttatttactcattcattcagacgccatgggacaattccaaggaccgaaccaatgttgtgctccggtctaaccagaatacattacattggcggaggccacgacacaactgccacacagacacgagactcgccacacatggacctgacacgaccggactcgagcacagcacgacgtatatagcttctctccttctcagccagagatctcaatggccttcacctcgggcttcttgacctcagccttgggcacggtgacggtgagcacgccgttctccatgctggccttcacctggtccaccttggcgttctccggcagcctgaaccgccgcatgaactgcccgctgctgcgctccacgcggtgccacttgtcgttcttgtcctccttctccttgctgcgctgcccgctgatcaccagcacgttgccctcctccacctccaccttcacctcctccttcttgacgccggggaggtcggccttgaagacgtgcgactccggcgtctccttccagtcgacgcgggcgttggcgaaagcggcggtgtcgcggtcggaggtcgccgggacgagggagcggaagacgccgtcgaaggggtcccagaagtcagcgaaggggtcgaacacgttgctgcgcctcacgagcgacattgttggtttgtcgtggatcgctagctgcttaggtttctttgtatgaagtggattggaggaagtttggaacgagtgtttgtttggagctcgatcaaatgcttcagtcttggctcgatggatggaggttggggaatgaggcaggatatttataggttcacaactaatctgtcctgaaatctctggacttctctggttcttgctcgtttcgctttacagcacactcgatctgcttcgcttccgtcgctccagtactccatcagcctctacaaagcggggctcaccttaatttgctctagagtattcatttttcccccacatatcttgcttctttgatgtaggttactttgattgcgatcaaatcttatcgtgtactccctcagtctcaaaacaaaagcagccatgaatttcagtgttcaactttaatcgtccatcttatttgaatttttttttatgattagtatttatactgttattagattataaaacatgaatagtactttatgcgtgacttttgttttttagttttttaaaaaatattttaaataagacgaacgattaaatttgtacacggaaactcattgttgcatttattctgtgatggaggggatagcgagtatggaatgattgattgagaacgagaaactacgagaaccaattgcccgctagtgtgggccccaggcagatgggcagtactgatcctgaaccgtttggaaatatgtcgtgaaactatggagtccttttggcataccaaattacaccagttttgaagtattacttcactgtacatcgtagagtgagtactagatcattccagtgggtttcgggaatgcttcaattcactgctttcactgggagcagtgagtctcttgcgaaacatatttttaacggcaacttgtgaaagaaaaacacatttgagtttgaattcacaaccacgttattttacaatgcaggtcatgcccatgactgaaaggtaaaaatcactgccaaagcattgcttcgttggtaagttttttttagtgaattacactttttgggtcacgtctattgcactttggatcaccccgatttttttctctacccatgttcatcctataccgcggcaaagacataggtggatgatttcgccagcgtgtcagagttgacatcctccaggtcgtttacatgttaaagaagaggttttgggtggttcaaagtacaacggacgtaaatttagctagtccaaagtgataagactgaactagtgatgatccaatataaaactacaacagtaacaggtggtccaaagtgtaattcactctaaattttatatgtactacctttcttattagggttgtttttggtttggtgccatgaattatattggtagggccaatgtaattgatgcatttttcttccttttcctaacttctattttttttttgaaacacaatacaatgcagacgtctacaacacgtacacactgacccgtatgaacatacacgcgaacaccctactctatgagcaccttcaaaagactggccctacataaagtcaccgtagacatttacgggtatatcgtctaccactgaaagaataattagccataaatgtgagcacccgtatcaaatctagaatttgaactcgagttccatcacaagaaacctaacctaacctgttatgctacgcttatttcacatctcttataaatttacaaaaattggttgctaaatattcatgcattggtcagaagtgataaaggccatattttttttatccaacaatgtttataccgatactaaaatttgaatttgaggttatatcgctgtagttcttttttctaacatcgatatttaagtcatgaagaacatatatgtatataacgatactaaaatttgaatttgaggttttatcattgtagttctgttctaacatcgatatttaagtcatgaagaacatatacatagtttaaccataaattatttaatcgctaatatatcgtttgatgaattataagtaaatgtaaacgggtaaacatttaccgcgtatctactaaacgtttttttaaaaggagggcaaaagctttgcctcgtatattgatagagatggagaaaatacagggcgatagaattatgtacagggctagtctaaaaaagaactaagcccgcaaaaggtgatggttaagtgatatctcccaagattccgaactcttgaagcttataggctcctgctttgacccatgcccgaccttcctcttttatcttggcgaggatggatgccagtggcgatgcagagtttcgaaaaattcttgcatttcgctcacaccatatttcccaggagaccaagatcaccagagtacgcaggggaatgcgggggttgttgagagaatctaccacaaggttccaccattgttctaccgagtcgcaatcgctccatttgatcatttggaggttggtttgagtccacctttgtatttctgtccagacccgctttgtaactctacagtgtgccagcaggtggactgctgactcgtcaattatgcagcacaacgggcaaatcttctggttttgccatcctcttttctcaagtctgtcaactgtccagagcctattttgggtggcgagccaggagaagaatttgcattttggaggggcccacgctttccagatagtttgattgaaggcagacctcgtggcccccaggaattggagcctgtaggcagactttgctgagtattgaccattggctgtcaaatcccagtggatgctatcttggtcttcagtcagggggttcattcttctgatcatagtccataggcggacggactgctgaacgtgatccgcctcagtgatgcggaggatgtcgatgtctctgacccagttgctttcctgcagggcatcatggacatatctgttctttcgttttgaggccacatagatgtctgggtgattttctaaggagtttggttctctagccacttggagtcccaaaagcgagcagttctaccgttgccgattgttatggttgttgcggccgaaaaaagctccctatcttcctgactgcacggaaccgccgttcccacccaaggcttctctggggccgtccattcataccatagccacctaagccgcaaggcggaggcgaagcgctgaaggtccattattcctagtcctcccaggtctttgggcctgcagactcttttccagttgaccttgtatttccccctagaaatgttttcccctcctgcccagagaaatttccttcttattttatcaatgtcctctaaggttccatccggaagcttcagggaggttaagtggtaaatgggctgcgctgtgagaactgttttggttaaacagatccttgcggccgctgacatcattttcccttgccagggggccaggcacgattgacacttgtctagcagcggttggagatggactttcttcagccttcctaccaccagtggtagtccgagatatttcatggggaaatttgttagccctgccaagaagatgctcgtgatggtgctgagatcgatggtgctgcatcggattgggatctactaaacgtttcaaaatgtactaaacgataaggtgtcaaaactgatctcttaaaagttttatggttgaagttgcattctaggtataatatgatgttgttttttgtaacttaaaccttatataaatcgtgagttttattaaatttacttaaaaatatagtgacctgaaacttatcgactcttatcacattccatttcttcggctgaagtttcaaatcagaccaccgcacacctaggagtataactgttgtcaaaagctagtataacacagtatatataacatcggaattcaaaaacgtttgcatgatgtttgcaacctgaaaagctctttatttattcctcaacgagcaagaactaagaaggcgattacacaagtactcacaaaggaatacatgaaaccggccgactcagccactcggactcccaacgggtacgacacaccagcagcagaccatacttgcacgaccaaacaaacacacactgaaatactgaattactgacaccaaacatgacttcttccctcaccgatcacatcttcaggagcttaaccggagatctcaatggccttcacctcaggcttcttgacctcggccttgggcacggtgacagtgagcacgccgttctccagtccggccttcacctggtccaccttggcgttctccggcagcctgaaccgccgcatgaactgcccgctgctgcgctccacgcggtgccacttgtcgttcttgtcctccttctccttgctgcgctggccgctgatcaccagcacgttgccttcctccacctccaccttcacctcctccttcttgacgccggggaggtcggccttgaagacgtgcgactccggcgtctccttccagtcgatgcgggcgttggcgaaggcggcggtgtcgttgtcggaggtggccgggacgacggagcggaacacgctgtcgaaggggtcccagaggtcgagggagaatgggtcgaacacgttgctgcgcctcaccagcgacatggttgctctatctttcgctttctgatgcgaagttgtgggctactgaaatggaacggaagaagcgattgcaaagagggcgatttgggagtttgggacgtatgcaagtcttgtttgttgtgtgttcctcggtgggtttcagcacaagagcggtgcacatatttataggatttgtccgggagctgcgcaatggacgttcttgaggcgtctcgagtcatctacttttgtttcggtgctcctgatttgatctgctcccttctagaaaaggctttgcttcccagtccagactagtctccacactcccaagtgctggtctggatgaaatcaatgattgcctacttagatttgatgtgtactgtattaaactggagtatttagaaagaccagccggatttaatttttgttccagatttgtccagtgttaatcacatatacttaatcaggtagctgcaagacgagatgcttctgcacaacgacgaatgattaatcagcgacccactgcttgccaacctatttttttttaaacacttgccaacctattcattcagcatgataaatacggacgtttaaaggattttgtatcacaccccgttactacaagcctataacacatttgcaaacagcatatttgccaaaaaagaataatttattaataaaacttgtatatacgtgtttttagtgatcttaaagcaaagactgaaaaatgaattttgatcaaaacccccaaaatcaacttcaaatttaaagttgaaattttaaattttgattgataaatataagtataagtaaaaagataagtaaacagatattcaaccgtgaatcgcgtaataagttactccgtagtataaaatttattcctcaaaagaaaggataaaattatggctctggcataaaacaattagagcaagtttaatagtatagcccactactaacttaaaatcatctatagccaatgtaatagtcaattcatacaatagttgcttactgtactattaatacctggtcccacctatcatacatacattacgtattgaagtccgtgctgcagctgactacagatctgtagcccgctgctcttctctatctttttttatctctttaaaatatgtttatagctgacttaagcttgctattatacctgctcttaagggcaaaaccatcttttcaccccataataacgttaggggtgggcaactgggcatacatttggttcggtcttgggtcatgatcaaaatttgaggatactaaaagaaacgcaatcaacaataaatcttgttttaggacatatttcaaaagtgaacaatcacaacaacaaattatatataacaccaagtaaccaatatagtggttttaattttttttttcaagcatgatacttccttcgtctcatacatatataccatcccgtactatttttttttgggacgaaaaaatatttatctgagttttagctaatgttaattcggttaagagactcatgattaaattgaccgtattaaattcagttagtaagaagggttagaaaacgataggcaaataaacgataaatagcaatagatcaatcacataagacataagatttaatgtggaaaatcctctcaaagcaagagagaaaaagccacgggtgccaggcagcaaatatcttcactataacgggttgaggttacaacgccgaacggcggcttacaagaagtatatatgaaggtgaaacactaaagtgataaggatccgtccgaagctagcctttatacatgtggaaatgaatccttgagacgaattccttttttagcataaatgaatccttcaacctaaacacaataaagaaaaatactttcggtgccaaataacctcttgggctaaatcactataccaactaagtttgagcaaaaagcaatagaaaactagctttgtcatcatttccgcttcgttccggctgaagcctccgacgacgggcctccgcttcgctccgttggaagctagactttatacgtgtgcaaatgaatttagatcacaactcaacaagaaagagaccggaaatttcggtctcatttctgttagttcggttggttttaatttattttgtccacccctaactaacgttaaatcgacgaaaacctactaaaacaacaaataaatgataaaaacagttcgaatgagaggcattacagccttacaggagagtgaattttacaagggtaaatgtctagctcggttaactttagaggataaataaataattttcttaaaaaggaaaaaagagcacatactaattaatgaaaatcataaaacaaggagctccaggctccagtaagcgggagactagtctagaaaagagtgggtcctgctggacagagacaagggaaataagctgatctggaaagaaaagagaacatcagagagtggagatcactcgagatgcttcaagaccaagttctgaagaacctataaatacgcccaccttgcatcgcatctccgcattcaaggcagagctagtagtggtcacatcgccaattcacagtcgaatcaagcaaaccatccaaatcacacccaactcttcttcttcccatcctccagagatccaagcagcttagccatgtcgctggtgaggcgcagcaacgtgttcgaccccttctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttccggctgccggagaacgccaaggtggaccaggtgaaggccggcatggagaacggcgtgctcaccgtcaccgtgcccaaggccgaggtcaagaagcccgaggtgaaggccattgagatctctggctaaaatggtgaaaacgggagtttgtcaaggtcaaggcgtgtcatgcatgttcactctgaactgtttgcggtgtttcactcgggtttgatggtttttactagtcctatgaactgtgtattcttttgtactctgttgtgagcgcgtttgcacgaagcaataaataaaaataaaatcagcttgtttgtatattgatcatgcatgtgtgctcatgtcgatcgccgcagccacgcaatgcgtgtgcacagctgcacaggtcgaataattagagtgtacacgttgccggcgataactagctaaactccagtggtgcggttatcttctctgcttgcggttttattgatcgttgttctagtgcccttgaagcggaactgcttgcttgtaaggagggtattaatatggcgctccaatggaccttactccccattattgttgtggcggattgcttggtggctgtctctatgatcaggatgcaaaggaggaggcgccaggggcggagccaggattttagatcgatggaggatgcaaaggaggcgtcaaccaggggcagagccaggatattagatcgatggtgtcactatcaatgataacaacttaagtaaaataaaattagtgctaattgataaagtaaaatagaattttcttttcaaaaataattcgacttgtattcatgccaactatctaattggtgaaattaaattataaaagactaaattaaaattgctagatatacatgtgcaagtgaataataatattctttctaggttaataattttgccgttttggataagaacattgtctcataaaacaactctgaccactaactgtgagttttaggctatcaaacaactttgaccacgagtcaaatattgtgagttttgggctatcaatagttaattaagctgctagctactgtctggctgtccatgctcacataggatggtgtcacaaagcaagttaatttggtgtcactcattgcaaagtaaaaggaataatgaagacaagacacaagccattggtgtcatgtgacaccaatggttgtacactggctccgcccctggcgtcagcgttggctcatcttgtcagagacatcgatactctgttgagaggaagaagggagatcatactgaagaaaattcatcgttctcagaattctgtcagtcatgttttagcaaataaagcccgtactgaatatctcactaagttctaggctgatgatagttgtaatcttattttgcaacttgtttgttctgattctgagtaatatatctccctttccccgcaaaaaaaaaaaactagctaaacgctgatgggttcgaaaaataattctccaactcccaccgggtaaagaaaaccgttagatggaagcctgtggctaggcttcaaggttcttcacgtagcgtacggcggtacgggccagggtccatggccgcggcccgtagagccacgtcaatttaaatcttagccgcacaatcgtctccatccagcggttgtatttgtctgattggggttcggagaattctttgccgaacccctacgagccactgtttcccaattacgggataacactaccgatcggtgtgactacatgtactactccctctctactctatccacaatacatgtatgaatctctaatatatttttttctcctaaactaattatctctaaaatattttttctcctataattatctgatctacgattcaattacattattttaattgttgattttttctgtccgattttcttgaggactctcgatttggagttcccttcaagtttaccggctgcctggcaaatgttccacctttccccgcaatcttggaccatttttttttgttttgtagctcatatatttgaggctggagttggtagggagagctcagagctcccacgaaagcccatgaaaatgggcatttgtcttgcatgttagcctgttaaggcgactcgggttcggaaaagaattccccgaaccccacttggtccaaagcaaccgttggatggaggcgcgtttgcggctacgattcaagctgacgccgtagggtctatggaccgtgggcgaggcccagttacgtgagcccagtttccgtttaggccaaataatgtcagcccaacgaaacgagggctggccattccaatggtatcgtttgtgtcactgaaacgaacctggatttggtctaaacgaaatcatcaggtgaaactggcattttgtgctagctgctgcctaatagctcagtcaaggtccagccgaaagcagttggagcatgcaggcaaatccaaacagacatgacccagatttcctgccatccttggcagttctcgtgctaaaagcaaagctagccagcatagcttttggttgtatagcacattgccaaggtgccaaggtgctacgtcacatcattttgaaaattttaaattcaatctaagaatatctcgagagtatcaaaagctcccaatgatcaattggatttgtcaaagaccgagcagcagatcgcttcactgtacttcgtttcctttttctacgaatctgtgccgcgaaaaattttaaaatttagcttccttttactttaaaactatccgtagattttttttaaaaaaaatattttttagatttatttctagagatgctttcataatttcaacgataagtgaaaaacagagtagcagggttgcaattttgcttcacagcaaagacactggacatgttcaagtatgctgttatgcaccgacatcgttgatgattacagaacagtgatagaagcatcaatagctagtatagtcacatactgcagcaagcaacgaacaaagaaagaaaccgagcaaca

SEQ ID NO: 64643 - DNA, 1547 bp, Oryza sativa
attgattcaattccaacggatttaaccggaatgtcatttgtggtttgtccatgctcactccgggatggcgacgagcaccggccgccacggtctcctcatcatcagccgccgccggagcccgccgaacatgaaccgccgccggcactgcacggccgcaccatcacggccgccgcccgacgacgtcgtcaccatgccgtgcgccggccgagccatcactgggtgatgcagccccggtggtggtagcacgaccaccggcgcctgaccatctttcttggcgcacagcgacgcgttccggcaggtcacggcggcgtcgtcgatggcgccgtcgtcgtcggcgtcgtccgacaccaggagctcctccaaagagcttctgctggtcaagaggaggctgctcttctcgccgtcgtcctcctccccggcagccgcataatccggcctgtaactcttgcggcggcagcagagaaggcggcgcacgagcacccagaagctcttcacccttggcctgtagagcgtcgtcctggccatctatcctccagcctccaggtcgctcctgctgccgatctcagctaggacagtacagttatatactactcctagcagctagctagtagtactagtattctctctcacttaatttttcagctggttggtagccctgagatactgttgctcacttggagatgatctgggattctggagctaatcctcgaattgtgctttaccgtctttaaaatttgccatatggaattcttttattattcctatgtcatctgtccgtgctagacctcaacttcaggaataatgttatcacgccacccctgaatgtatagcttcacactttcttagacacctttcttatgccaaggtgaaatctgtaaaatcagtcatgaaatatactgtattctacgtgacgatttcatagtttaggagtggcttgtgagagccgcaatacgcagcaggctgccatatggaggctacgagaggaagacgcgggagttgtctgctgatccagcgtccaaaaagaaagaaagaaaaatgcgcgggagagtacgtcgcatcagcatcaccgtcaggcgctaactgcccgggcgctaaaagacgcgcgaaatttggtgcgatactgttcgaatcatcgggggagtctccccctctgcttattacaccagtgtatgcatgtcatcttcggatcccagtgagatttggacgaaacaaaagcatcgatttatgcgttggggggtgatggggtgatttgacgcgttcattcgagcaagtcgctctgtgactttgttcccatgtgacatgggaatggtgtgtcgtcttaatgaaagaacttgtctgataatgttgaagtggggaccatggaagatgtgcttagtactattatcattatctacatggataaaatcactgatatttagagatagagataattgtacaatatcatagtccactatacgtgaacaaaatcgaaaaaggcaagctcgcaagttagcgaaatagtgaaaactttatcctgtaattaaggcccaccaatacctcttctccca

SEQ ID NO: 64644 - DNA, 17248 bp, Oryza sativa
gaaagttttagatttgtattgaaggtctttgacatctggctaacttcgtctatgatttgccggcctagtgaaaaggccataatgttaacagcacctggcccacttaatcgaaggcgttgtaatgggcctagaagtaagtccatccagcccacggattacagcaagcgcttcaaagcgccgccgcgtcgtctccacgcctcgggcctagggcacgcgccgactcgccgccggggagaccgggcggccggcgaatcccccaccccaaaacggaggcgaaatttagcacgggctgtgcgcggtcgagcgtccccggactcatcggcgtggagagacgaggacgccgcgcgcggcgcggcaggttagatttggatccgcgcctgccgggggatcagacgagaatcggttgcatctgccactgcattcttgcagccaggtacgctttgcccgcaattccaaatgtttgtgttgcaaattcgtacatgcagttcataggaaaaaggggaggaatgcttgcaaaattgcaacctctagttagggtaacaatgggatgtgttctccctgataccactcgctaacctgaaatcatgaacacactgaacactagattacacgagattgtttgaaccctgtatttctcctaccgcattcaccaattgtctgaatttctgccaagctcatagtcaaacacttgtagtattaattagtccatcaaccaagaggggacaacttagttatccttatttcatcagaatcaatacaaagtttctcatcatccgctagagtttgatgctaccgagtggttagtagattggctatgaaatctatggattactgagtcaggcgaatactgtaggctgtccttcagcagatgcgaatcttcctttggagacgcattcttgttcatcttttccgctggacattccccgttcttgatacaattcaggacctccactacctccttaattggtggcctgctctctctgtccatctgcaagcactgaaaggccagctcggccaccagatctaccatcctctttgtttcactgtcagtctcatagccgatctctggatcaaccaactgatcaacttcatggttctgaattctgttgagagccatgttagccaagttaatgtcactgtggctcctggacatgtccacagctggttttgaggaaattagctctatcaacacaacaccaaagctatacacatcactcttatcggttagcttgtagcactggtggtacactgggtcaacataccctggtgtgccctgtggaacagttgatacatgggtgacttcaagcgggaacaggcgcgatagtccaaagtccgcaactttgacatggaagttgttgtccagcaatatgttgttggtcttgacatcacggtgtatgatttcaactgcatgaaggtatgccagtgcctcagccgtttctatcgcaattgtcattcttacaggccatgtgaggcctcgttctcctgcacggggtccatgtagatggtctgcaactgtcccatttgggatgtactcatagaccaagagaaggtcacggctagaacgagacgtgcagccatataggataacaaggttctggtgcagtaggcgggacaaaatgtctacctcatttaggaattgctctactcgtctgtagttgttcttgtaaaggcgcttcactgcaactactctcccatcccggagctttcctgaatggcagaaaggaagaattgtaactgctaagttaataggggaagttatctattatggaacaaagttcaacggagcccctgtcgcatgcaattaggcatgctaatgaggaagtgattagatgagaaatctattaacaacaagggagttgtgcaaacatattctcctacctttgtaaacagttccaaaaccaccatcaccaagttccctcgaggcactaaatccagcagtagcctcttcaagttcctcgtaagtgaatatatggggagaaccacccaactcaaggtctttgctgtatgattgcattgaagatgaactatgcatgagatctttcaaatctcgggtttgtttcctcttcttgcgtttgtgccaagcaaaaatgaatatagatacaatcaataatattccgccgcttgatccacatgctgcaataacagagacagagcactatcaatatgtgagaaccaaggatctgaagcatatcttcataattacattttgaatggttggggaagtccaagaaacaagaatgaattatactcacctattcctattatgtgactcttgcttcttgaacctgcagaagaacagacttttaataccttgcacaaatatgccatgaacaaatagaatgatcattcataatcacattgttagggtatcattgctcccctaaccccctgttgaaacgaaggacagtgcttatacaacttttcagcctaattcaacagaaatacagatgcaatttatgctttccacatgtttggaacacactaattaaggattagaaaatgaaagggtatttgctgtcaatcagatgagggatttcttcgtcagtcagcaatcagcagaagaaaaattggaacatggtattggtatgatatctttatcagatagtgtagttgaatacttcaaactacacgtaacacgtttgactaggattccataagctgccaaatgccaatgttcccatcagtgaaataattgtttgatgagaaactaacaaccaaaacagcaggaacttgaagcaaacactcataattcaaaacaaaaatatcaatatccactttgcattttatattcttatgaacattgctgtgacaatgctgtgtttaatttctttcctcgatagcaaaactagatgtcacgcgcattattataataagagtttatctagtggacattaggccacagtagcatggaaatcttcctgtataacgaaatgatgtgtcattcttttctatatatataaagaaaactatcaactagatgaacacactttggatgcattgaatcggttaggatggcctaggctgcatgttcacagaactatgttaaaatttttattctaattgataattgactggacaaatttaccgtgctcttccgattttctgaactctctacacttgtcagggtgcatcccgtcggggcaattgcaggcgaactccaggtcgtcgctgtacgtgcaattcccgccgcttacttgacatttgggacaatcccctgaaaccaccgcccactctagtagaaacccactcctcatgctggcaatatagccggccatactcccattgtgacgctgaacgatcggcacaaccgtgaagttacagcccggtggaatcccatcctcgtgtaaatggtggtcgctgacgagccggacggaggagttttggtcatcacaaggcaggctatggaagccgggaggagcagccgccgccggaagtgacttgttacacgagaggaagcgcagctctgcgttggcttcgctgatgacgaacggcgcctgccagatgccatcggagatgttgaacggcggcgccgggcagccggtggcgagcgggagattctcgtccaccacatggacggtgtggtttccggtgaagatatcaacaacgcgatacgcctcgtagatggtgtgcgtgaggtatgcgccggtggcgttgcacttgagctggaagggcggcgacccgcacggcggccggccgggctcctccagccagaacgggtaggagatggtcagcttgccgcatggcgtgggcaagcagccaggactagacgagctcgccggtgccggcaactcgaggaaggaagctaccagcagtagcagtatgagcggaggcatatctggtggacttgggtacgcaaatcaactacggaatgcagtggtgaaatggattatatgagagagaagaaggggacgagagatcgagggatgggatatgaggcgtggggcaaaaggacggtggcgaagcggttttgaccggtcaaagtctacggattgaacatactgctacattgctactactctctctgctgctacagcttcttgacgaagtactccgtactattttctccgtttcatcactatagtatttttcacgtttatattgatgttaataaatctagataggtatatatgtctagattaattaacatcaatattaacgtaagaaacgctaaaatgatttacatcgtgaaacgaagggagtatagtttttgcatatatttctctgatttcgatatccaaaggtcggagatggattagcgatgacgactgccttatcaaccaataaacaagtcactgattgattaacggattcgataaagttgacaccataaattttacgcatttcctcctcccgaaagtgatgattaaatggataatttcgcgaacgaacttaccagatgacggcgtctcttgccatgtcaagaggaagccgtcgcggatgagctgctcatagctcctcgcgtccgtgcccagcaccggcacgacggtagcattgcagccttccatgtaaaacgccgggtagtcgcccgaatcactgtaattccctcctacgcgagcaaacgtcttgttgccgcacctcgtctccacgaggtcgtcgtctccgtcccgcggcacaagcgccttattgcaactgtacaggaagaggttgagattggtggtgctgatggagaacgggaggccgaccttggaggaggtgttggtcctcggaacatggcaggagtattctttgctgacgccggagaagacaatgaagtcaccgagcttgtggatgtcagagacgagcaatgaattgttgccgtagaagatgtcgaggatctggatccgatatctgggcttgtagtagccgaggtatggagtgtcgttgtggcagataacctggaatccaagccagccgcatttgctctccgttgcctgctccggcacgacggcgaacggcgacgagatggtcaccttgccacatacagtactggccgcgcagccttcttgtggacgattgtctgccgccgtattcgctgcttgactcgcccaggcgaggcaggcgaacaagaggaacaaggaaggagagggcatcgaaaacgaagaggatgaattggtgatgtgttgttgatgaggattgaggaagacatgagagaattaatactgctacttcttcttctagtacgatacatttaactttgggaattctctgtagtggccgaaaaaattgactggataatggctgtctacggcctcatcgtcttgccgtatcggttccaattccaacagatgtgcatggtcttctcagtcatgtaccagaacaggatcgaagattggaaggaatggcaccggagtgagatggaatgcgaaaggacggtcatggtccactgctttgatcactttaattctagtttaattcttgctcatccctgttgcccagccgccacgattgggcaagatgacgaccctatcagccaatcgacagattccctgtcctacacgctgatgagcgagaaccgtattctactagtactcgcttggagatcggaagtatcaggatatacagtggattttctatacgaacttgatcctaatagtttcagggagggtgaacttaccagaagatgtcactggcggtggcaggtcccatgttatgaggaagcctccacccacgagctccacatacctgctggcgttcgccttgccatcaggcggttccagcaccggcaagaagacggtgctgtttctgctgcagccttccaaatagtacttgtcgtagtcgccctccccgtggaaacgccctcccaggcgagcaaacgtgttgttaccgcatctcgtctccacgagccccagttgttgctgctgctccgccggcggcgcctcggtgcagttgtagaagacgaggttgtgattggaagggctgattgtaaacgtgatgggcagcttggcgaaggtgttaaacactgggatactgcagccggtggagttattcaggcgagctagcttatggacatcaaagacgagcatagtacggtccccatatgatatgttgatgatatcaaacccgctgtctgtagagcttcgaagagttgcgacgccggtggagttgttgcaatatacctggtaatccagaggaccacacggcttatccgcctggccctggatgatccagaacggagaggagatattcaggtcgccgcatttctggctgcccaggcagcctcctcctccttcctcctcggctcccctcgccgccgcggcgagcatcagcgctagcgaccaggccgagacgacgacaaagaagaagctcggggacatcgagacagaaagaggaggagggggataggggatttctgaaggagatggaagtttgtgggggagatggaagtaagaaactttgcacacgggaactattcctctgtgtcgaaatgtttgacctgatacacgaacgatcgtcgtccacgcgtgcgagtttccggggtgccctatgggcagctagctgttataaccgccctgatgtgactggaccagtttgtccggactcatcgtcgtgtactcctattaaccctcttccagctagctagtgcacgctgctgtccaccattgttttctacctgttgtataacaggctactacgccctttgttccacacctactcttgccggtaagcagagactagtccactttccaaccggtcaacgcttacctgtacggatgtaactaaaactaaaaaaaaactcctacagaatacttcatgtgtttaataaaaacctacctaatttgacatatcctaatattatgagaacttgtagatacatttttctgaacctaataatataggacagaaggagtactttctgataaaaacgtgttaatatctagtatcttctctctaaccaaaaacctaatgcagattgaacacatatgtgctgcgttgctagttcctaccactaaccagtactccctccgttttagattataagttgttttgatttttggtcagtcaaactgtctcatgtttaactatgtttatagataaatataataaagtaatactcaattcatatagtttcaaatttaaaacagttaatactcaattcatataagctaatgactcatcttgtttgttgtatcttcttaattttctcatttcatcactcaaacacaatctaaggattattaagtggattgttgtacagattatctacttgattgtagttataaattaaacatttaataaatgaacttaaaacaagtgtgcaatacaatagaatatttttttgagaaaatatattttaggagcgtagagcacaaaattcatttcaacaatttggaaagtaattttgaaaaaaaagtaagcctaaaaattatgtaggtatctatcaactcctagaatcagaatctttgcaggaaaggcattagcatttggtaccatattttgccgaaatctatgtcattatcagcaaagctcacaatgctcttttatgtaaaagcacttggatagactcatagaccggaattagcttagtggtggcaatctctagtactatcgttaatgggggcaccaaggtagtatattgttttgcattttctatatattttttatttttatataagctttcattccccattgtattaaaatttcaatacaaactacactgattaaagttcataatttcatatttctagcactaccgcatttcctgttttgaatttttcatatattttttgagggaacagtttttcatatctgtttattgcattttaaagttttctttttggaaatagtagcgtttaaaagttgagaagggcagtgtgtactccttccagtttcaaaattattgatgttttgaacatgatctcacataccaagaagtgatttactccatattacagtatcaatttactattttaccatattaaatatagtattgtactcatggtaatcactacactgctgccgttggtttgaattaatcacctgtatcggtgcgagctaaaggtccaattccctagcttttttacttggtttttacttccaagcatgtagggcaaagcggtccaatataacatgctaagatagaagcattaacaattcgcaatcaccatttacaaggttaaaacatcaagatttttgtaccggagggagcagtaactaaggttaagaagccaatagatcgcaccattatgatgtcttatatgttgagctttccattgtgtttccaattatgtctgcgtatatgttgggctccaaaaatttgagaaacgtccagggtcttccggctagctccacaagatggtgaacgagacgatctgggttcaaagtatcaacccttctaattatttgatattaggtctttccttaatattcgcttctttcggctccaaaaattcatggcccgccacttctaacaactccgattgaccgctttcgaaagatataaagcgtaacttatcccgttagccttatcagttcaaagaaagcccctggtagcggctggtgcgccgtgcacgatgccaaatttagcccgtgcccatctgtccccactattttggtacttctacgcagaatgccacttggtgatcatgtactaatgatttacattgtcacctactatgagcattagtttatggaccagctcaacacactcgaagcttcaggcaactactgctaacgtcttatttgtcctaataatgaaccagttcactaatgagaatggtgaattttcgggggaaaaagaagagggggaagcagaaggatcagaaggatctctgccctgggaagttgggagacagagacaaaggaaaggacggaattcatgcgtttacccaagaatcaatcacgctgggtggtcaatggaagaaccagtgactagccgcccatgtcaactcctgcctgcagcctgcttgataagtcgtcgtcaacgtcaccaccgaggcaaaccctcccaaaatttaccaccatctctgcagctgactagccagccgcccatgtaactacccgagaccgcgagcgagcgagaggttgagtaaaatccaaggacattgacgtgggccagtaattcaactccaaatccacatgggacctacgagagattgcaactttgggatcggagtacatggctaccgatcgcaacgcgccaatttggccgtccagttaaccgtacaccgagccaaaatcttcaactagctaacacatgcgtcagattgggcgataggcaagtgtggtactcaccggggcatgtcgagcggcgcagcttgccgtcggagcagaggcacgcgaacgccgccgcggaatcgttgatgtaccggcactgaccgccgctcccgttacaggcgtcgcagtcgccgaacccgttcttctgccactccaacacgaaccccttcttgaactgcgggctgtagtttgtccccgccgtcaagttcgccggcgagtccggccacagcaccggcaggtacgagtacgtgcagttcccggctttgatcgccggtggattatcacggtcgtagatcccgccgaggtacgcgtagataggcttactgcagctggagatggtggcgttcacaaggccgtcgatctccggtggctccgtgccgttgcagctgtagaggaagcagatggcccggttgctgctgctgatcgtgaacgggctgagggctaggctggacgatatgttgaagtcggtgcggcacacgccgtcgccgccgtcggcgacccttttgtgtgccgcgacgaatgagctgctgttgtagtcgatgctgaggacgaggatttgcgagcccctcaacgacgccacgccgccgttacaccacacctcgaaagccggatggccacaggaggccagagctgacgacggcgacgactggttggactggttgaagttggggccgcctagccagaatgggtacctgacggtgaggttgccgcatgtcgccggctcgcactcggcgcgcgcgcggtggcacaggaggagcaaggaggccaagagtggcaagcacaacaaggtcgggtgcatcttgccgctcgtggagctagctgctacacaatggaggccggattggagagcagcagaatgctggaaagggaggggaaggtctaatgctcgagaaatgctattgccattgccttgtttttcttgactagtctttccgatttgttagactttttttttatcagcagaaataatggggaagtcagcatcgtctctgacttgtgaggagggagacaaggacagttttaatcttctaatcgcgatgtaaataaactagtggtgcaggtcaattgtcgacagcgttatgtcattcatgccgtatgaatcactagtgactattccttctttttctccggggtaagtgaaaacttggtgatgggtcactcatgtcgtagtgactagatggaattatctgagcaccgacttggaaatcaatttagaccttacaacttgcaaactactcgtgtgctaattaaacttcagtattttaaagaaacggatgaacaactctgagggcttcagctgaaaaatatttgcacctaacatagcgtgttatatatctgtttgaatacgactggaattccccgaaaaaagaagaatacgactagatttaccaggggatgaaagataagttagtaggttagtaattttagaccaaccgtttctcctgattttgacttttgcagggagtaaaaaggccgtgatggtaagtaactctgattaacggacattggtttggatcaacggtcaagatcggctggtggaatcacctgtcacgattctgtcctcttgtgtgggttggttctaccggcctacaagtaacctaccactaaaaaagagttttcgaggaatatattatctgaatccatcactaacacgtcgattatttttagttccttttgaatttatactaatgacacgtgtgtgcgtactattggcactccccagttgacaatgctagtcaaactgattcggtatgttttatcaacggttgagctgaaatggtcaaactgatcatagtctactcatttcggctgctacgagcagatgatttttcggctgcatgcgcggcaaaagaaatgcagaggtttcaacgagtcgcgggacaaatcactcaccgcatgtcgccggctgcaggcggccgccggggcaggagcacccgaaccccatggcgccggcgtcgtagcggcactccccgccgctggcgttgcacgccgcgcagtcgaccggcaccgacgtccactcgagcagaaatccgcgcctcacgagccccgcgtagtcacgcgccgatctcagctccgaccatggcagcacgggcaccaccgagtactggcaacccaccgtgtccaccgcccgcgcggggccgccgggatcgtacatccgattcagggacaggaaccactcgccgccgccgctgaaaccggtgcagttcaccgggagcgaccccgtcggcggcgtccgcgagcagttcgcggagaagaggaggcccgcgttggcgcggctgacggcgagcagcgagagcgcgaggctgctggacatgttgaaccgggtggcgcggcaggcggagctctcgaccaggttggcatggaaggccacgacggagctgttgccgtagtggatggcgaggacgcggaggtaggagccgttcaggctgggcggcggcgacgcggtcgcgccggtggggtcgtcgtcgtcgtcgcaggtgacggcgaaggtagggtggccgcagtaggcaggctgccggccgcgcagccagaacgggtacttgatggtcaggttgccgcatgccgccggcgcgcagctctcgccgaccagctgcgcgtgcgtcgcggtggcgaatacagccaggagcaccagtactagcgaggtgttttgaaacattttcttttacggtgtatgtgtatcgatacccaaaaagaattctaaatcccccgcgtcgctctcgcgcgagcggcttggggggcgaaaccctagccgcccatgccgccactccccctcctctttcttcaccccgccgccgaaggcggcggcgaggccttccactgtagcaaccctttccttggcgcgaggaggacagagttgggctgacgatgtctaccaccacggccggaggcgacgacggcggggcagctcggggtggcggcggatccggcacttctttggccaaatctggccgccccacgtccggatcgggagcgcgcgacggccagggctcgccggcggcgcgcggtcggccgcggggcgtcgcgggcaagcgcggggtggcggcgcggcgcggcctggtgacggcggcggatccggtggtggtcggatctggccgccctacccccggcgcgacggccggggctcagaggcggcgcgcgtgtcgcggctcggcgcgggcggccgtgggacaccatggtccagcacggggcggcggccgggggtcggcgcggcggcagcagccctcacggagggcggggccaactgcatccagcggcggcctgggcggatggacggcggcggcgaccctcccggagggtgcggccagatcgtggcccgtggtcggcgcggcgcggcatgggcggtcggacggcggcggtctggccttctggtgcagcggtggtggcgttggggtgggcatggcggctcgtaggcactgaggcagggcgtgaagggagtgatggcagtgctaagggagctggcggcagtgggtcgtcttcctcgctgccggcctgcaccctcgcccttcctgaagctcatccccttctctgtggggagtttctatgttggattgaggcggcagccggttagcgaggggagctcagaccgccaacgcgacgccgtccaattccgggttctccttcggccaaagctggcaaggaggctggcgggtggcgggacggaggaggtctgggccagttcccagggtagcggcagctctatgcagcaagtgtggtggtcggccggtggaggggcgccggcgcggtgtggtggaggcctcgtgctgatctgcttgtgaggtggttcctgagttgatgggcgacgaacctcaagcaaggttgaaaggtttccgggtgaaagcctcgcctgatgattcatcgggctggcagcggctacgcttttgggcgtcgtaacctccttgagggcgctggcaaggatacctttctcccttggcgagttttctctaggtgaaaaccacatctccttagatgggcgatggcggcatccttgatgtcgtgacctccttgggggcatcgcttttagagtctcgtctttgtggtgttgtcgttggcccggcggcgatcggccacgcatagcgggggtcgtctcggtgctaggtttttctctcagtgggttgtgcttgtgtgattagcatgtggctttggttgtgcatttcgatgcaccttcgacctcgacagtctctgtcgagttttttcttgtaactttatttcttcttaatatacttggatggcctccttcggccttcccggcgatacccaaaaagaggtataaatgtttatttatgggattttatcatcttaaggttggagtctcaatcaagttgaatgcagggatgaatatgatcgatgaggtagcggtacaagaaaagtgccgatttttctgacatctgacactttctaccatgttccatttacacactgcgtggtcactggttagcaggcagctgttaattagaatctaattttgatcctttttattttcaacaaaatgattttgatcaattcagccagcatcttttacaagcattgctcagctgacattgatgcttgccgaccaaggggaatgtataaaaaaatgcagagagtattcagaggtctaattaattaaactaatggaggtggcgactggcgacggctttggcaggagcaaaatgggtaattgtgggaggatccgtagagtttttcccttttcttttttttttagctctatagggtttcttatgaagtcttaaaaaattaaactcgaaacatttgtttaggagtatcatgatgtattctatcaacaacataactgctacatatgcgtaccataataagtgcatttctagcatttagaaatcaaaatatctggaagaaaattgacctttatgttcatcattaaggctgagttctttccccaaatttcccaactcaactccttcgtgttccacatgtatgcttttcaaactgataaatggcgtgtttttttaaaaaaaagttgcttaaatcatattgttctatttttgaaaaaaataactagttaatacttaattaatcacgtgctaatggaccgcaccattttccgtatgctggaaatgtgttcccaacacacaacaacgaaaacaacctaaataggggagtgattgggagttgagggtgtttggggttaaaataggaagaaatccgaacaagatgtgattgataagacaacaaataatctagaacactattttatgagacgtttgaattctaaaaatcaatgttttaaatagcgggctaaggtatttagcggttaacttctcaaatagctatagcgggctaaatggagctataacggctaaattgtacatgagagcaaatagctagaacccttctcaaacagctatagcgggaaatagcggccgtttagcgggagattaaaaccctgaaaaatgcacttattatggagcgaaggcggtacaaaattaatatactagtgtgaaagcactttttgaagtattattgtacttgtaaaatacttactaaacatcttatgatttgaacaactgctgaaaaaggtggagtttttatatataattgttggatagagaaaacattttgattgtgttaatttgtagtccgtctagtttgtagggatattattggttggtaaaattaaattggtcggatacatattataaaatgttaatgatatgtaaaataaaatatagaaccacatgtgtgataatattcttactttagcccgcgcccaaccacatgaagttcggggcactaataaaacaaccatagtgatgttctttatatgtggactatagacacatgttaagttcttttcaaattcatttgcaaaaaaatcaggtaccaaaatgtttctatgcaaaaattttccatttataaagttctatatgaataaaaaaatatgtataaacttttcatgtacatttctttataggccgaaacattgctcgttggaccgaaagcaatatatttgtgttggtgacaactgacacacactgctgtgcatgcattagacctatccgatgaatatattacactccagaattttagcaccaaactaagctataccatatttatggatgtgtgtattataaaatgttaacaatacttcaactaaataaaatattgagacatatttaatttgtagtcatttttgtgtcaagatttattcttgtcctaaccaaaggtttggtgctggtatatatagaaaccatggtgatagttaatttttatgggctaaagtgtgtcaatgatttaggctacttaacccctaggagtgttagacaagaatagcaatcttggtcattgactcaacgttgccacatgaactccctcaatggtaaaaaatgccatcagtcctactgacattttttctcgataaaaaaagtatagctgataaaatcatttggctaatgagtactctaacgtccctccagaattttagcatctcaaattgagttctaccacgttgatggatgacataaaggtgaacactataataatgcgaattaaatttagaaatatactgttcattcattttatttttagaaatattcggaattcaaaactttttacaaaaatataccgtcgatctcgcacaaccgttgcgcgaaagtgacgtggacgtgacatcataggcggtatcgcgctgggaaaaagcgagaccgcgcggtctcgcgaaatggaagagcgagaccgtccggtctcgcttaaccaatcagcgatacaagatttcaaaatggttaattagtgattaattaccatgattaatggttaattaattattaattaatcgctaattattattagttaaataattaattaggtcattagtcactaacctaatgtagtttaggatggtgtcgctctctgcttgagcgagaccgctcgtccttaccgcgctcttgcgccgtcaccgcgcgagaccgcacggtctcgcgccctagcagcacgagtccgcggggtctcacgctttctccgcgcgataccgtcctcaacgtcacctctgcgtcattttcgctcaacggtagagcgagatcgatggtatatttctacaataaaatttacatcccgaatatttttaaaaataaattaaataaatagtatatttttaaatttaattcataataatgcttccccattgactgtagaattgcacgtggttattattcacttattcagaaaacagagttaggttccgagaacaaggatagcttttcctgaacactaaccaatgcatcaccaccgataatattgattgagctaagtgtaccaactgtgattgagaagagagatagagaaaaatgagaagataagtaaaactacgaggtaaactattaatacataattaattaaatatgcttattttaaacttgaaaaatctattaatatgttttttaaaacaacttttctatataaagctttttttaaaaaacacaacgtctaatagttcgggaaacttgtgcgtgaaaaacgatgctctttctttctctctgtacatcatttgttgagttgtgatccaaattcatttgcacttaataaagaccaaactgacccattgggttgtgcacctggggacgcctaggggtgcgggggcggagtccccgcggtacgaatcgtcatcccttttagggttccacttcatatatatacctcttgtaagctgccgtgcagcgctgtaacctcaccccgatatagtgaagatattttgttggctggcgtccgtggtttttttctcaccccgatatagtgaagggttttccacgttaaatctcgtgtcttctgtgattgatatattattttttatcgtttatttgcatatcgttttctaacatgattcgctggccaagtcgatgttttgttcgttttggatagcctatgtaactgtagatggtcagctaattgggttggtaaatcatgcccgtgaacaaccatttttctcccaacaagggtacgatttgtcgatatgatcatctatcattccatctcgttagggctagcgaatcgaaatcaccgcaaaacagaaacgaagggaatgctgatgaaaaaaaaaacggaacgg

SEQ ID NO: 64645 - DNA, 10378 bp, Oryza sativa
ctcgagcaatcttcgcaatcgtccggccccgccgcggccgtgtagtcgagaagaaatccacccttgatgagccgctcgtagttcttcgccaccgcaccgtcgtaccccagcaccgggatcattgacaccgtgcagttccccggcagttgtctgaaatcgtcatcaggcttgtacttccccgcaagccaggcatacgagttggacgattcatttttcgcacaactcacgggcgcccaagagattggaagctgccgtcgactctggctgcagttgtagaggaagacgagctcccggtttatggggctaatcttgaactgcgtgaggccgaggtcggaggaggcgttgacaaaactctcgatgacgcactggccgtccgtcagctgctcgttggtgaccatgaaggagctgttgtggtagaagatgcgctggatttggtacgtccagatgccgttcttgagggaagcatttctatggtcgcacgtgacctgaaaagttcggtagccacactccggcggatgcttgccggcgagccagaatggatagccgatggtaaggttcccgcacctcgccggctcgcagaacggcgatgtggtgttggtcgtgtttatggcatcaacggtggagctagctattgggagagtgatcagcagtagcatggctaaacagatcatggcagttgcaggagcacgaaacggatgcatgctgcagtggaagcgatcgatcacgcagcagatttgggcgagacgaagaaggcgaggaaatgatgatgcatgcatcggggaagaagataacggattggtcaggcaggcagcgcgaaacatgttgcttgccgaatgtgttgaccattcctcagtctccttgttggaccattcttctccggtagctgatgctgcttattggtcactgatgtggacatcagcgagtgccgcccagtggcacagtggcagctcaccaacatgtggggtcctcgctaaatcgggcccaccttccagtgaccgcagaggattaggactacccacggtggagacctattcgattcagacttggttttggaaaattcgggggtaacccatccgacgcgagaaaaataacggtccttcaattcgttctaactgaaacgatgatgactgagcagtagcagactagcagtctcacgtcgctggagaaaatatggtctcaagaactctcagctggattattctacgtgttactacgtagtatgtgcgtgtggatttttgttacgcattctgaacagtgtccttttttttttctttgagagagtatgagaccgcgtagtagtacgtacttggctgctaagtttctgcacatccgcgttgtgatttgggttgagcgcactactccacgagagaagcgcacatcggtagaaacgacggtacgacgcgtactatttttcttcttccaaccaatccagtccgtccagaataagttttaccgatccatgtcggcttatccaaattaggttatggttaattgtacctggtcgcctgatcgcgtcactttacgcgtgaaatttcgtaataaaggttgggcgacagaggcgtatactacgtcacgggatttatcattattgggctgggaaaaaccctggcctttcttgggccggcccaaaacatcacgaaacggaacaaacaatgtatacgtgtactcgagtgggcgtacctggagatttcgtatcagcccgcgcggtgattgtcacggtccggaagcacgcgaaggtccagggctcgtgcgccgcgcgccggcggtggccgcaccagccgccggccttctcgcagtcgccgcactcgccgtcctccagtggcctccagccgagctcgaaccccatgttgagcgccggcacgacggcggcgtcgagcgggctgctgtaattccctccgaggagggaccgcctgagcaccggcatgccgacgacgtcctggcacagcgccgcgtacccgtacggcgtgcggtcgtcgccgtcgcggaagacgtaggagtggtggcggccgtcgccctcgaggcaggcgacgaggtgggccggcatgcccatgaaggagcagtggatgaagaaggtgaggttggcgtccctgtccgtcagcgacagcggcgaccccgccgggagggacaggttgcggccgacgagcgggcaggtgttcgaccgggagaacaccccgaggtcgaacagggacaccgtcctgtcgccgtacaggatgtgcgtcacggcgtactcccccgacgggagcgccagcaccggcgtgtcgcggcggcactccaggcgcaggctcgggtacccgcagtagtaggcgccgccgccgctcgtgttgtcgtcgatccagaacgggtaccggatgtcgacggcgtggccgcaccggtacgacgggcacgacggcgtggtggcgttcgggatgatctctgcggcttcatgggtggtgatgaggttgcttaggaacagcaagagccaaagaggagagcttgatgttggcattgttgcattctgcgagattgcacactctgctgcacgactttggtgagaatcttcagttggtgaaaccacgcacaattgcacatttcaattttgcgtgagttatccttacgtgaatgacggttcatgcaagatgtgtgaaccgtgaaggttgttactagttacagaattctgtcaggggcatgcacaaaaaacttgttttgtgactgaatatgttacacgtaggcaaattttaacttctctaacagatcatcaaactgcttttctgaatgtgccaaagtagccaaaccactggccaacaagttaactcagttacagccaaagacacataaacctctatgtcttttttcttttcatgggaaacctctctttctctgacaaacaatagcacacaactctgaatatttacggtgtctgcagtcagtagccagtattttctgaacatcttgtcaagtctcagctgctgttattggaagtggtggatgggctaatccactggtacatgacgcagtccggagagccgtctcggctcttcttgaccagcccggcgtcgtccttgacgtagcctaccttgtccatccgctgagcttctctcagcgcgtccaacacctcaccgatcggcggcctcacgtcctgctccggctgcaagcaccggaacgccacctcggcgacgagatcgaccgtcctcctcgtctcgccgtccgacgcgtacccgagctgcgggtccaccagctgctccatctcgtagctctggatcatgtgcacggccatgttggccaggttgacgtcgccgccgcgccggttcatgtccaccgccggcttggaggagatgagctcgacgagcaccacgccgaagctgtacacgtcgctcttgtccgtcagctggtagcactggtggtacatcgggtcgaggtaccccggcgtgccctgcggcgccgtggacacgtgcgtggcgtccgccgggaacagccgggagaggccgaagtcggccaccttcacgtggaacccttcgtcgaggaggatgttgttcgtcttcacgtcgcggtgcaccacctgcggctccaccgtgtggaggtactccagcgcgctggccgtctcgacggcgatgccgagccgcgtcggccagtcgagggaggacgaccgcgccgccgcgccgccgtgcaggtggtcggcgagcgtgccgttggggacgaactcgtagacgaggagcaggtcgcggctgttggtctgcgacgtgcagccgaagagcgtgacgaggtttgggtggcgcagccgcgacaggatgcccacctcgttctggaattgctccacgctcttgtagctgttcttgtacagccgcttcaccgccaccgtgtccccattccggagtatccctgtaacaagacatgtcaatgttttactctcaactgatcaagtccgacatggacaatgggacactggctttgtgtatgatcttgtacctttgtacactgtgccgaagccgccgacgccgagctcccgggcgtcgctgaagccgtcggtagcctcgtcgagctcctcgtaggtgaagatgtgggtatatgccaagccggcgaggctgaattctttcgtgagtgatggcaatggcgtccctccatggatgagaccttcaaaggatgcagatcttttcctcttcctccgggtatacaacacagtggagccaacgccaagtataccgagacatacaacagccgctgcggttcctggttgtgacagtggttgaatcacaagaacagatcaggagatgtcatatactccctctttttcaaaatgtttgacaccgttgactttttagtacgtgtttgactatttgtcttattcaaaaaatttaagtaattatttgttcttttcaaatcatttgattcattgttaaatatactttcatgtacacatatagttttacatatttcacaaattttttgaataaaacgaacggtcaaacatgtgctaaaaagtcaacggtgtcaaacattttgaaacggagggattaccatactagcctatcttggtaaatgtttaattgaaatcagcattacctgcggcaatcttgattcctcgattaaccttgcctgcatgtaaagagcgcagaggaggagaattagcatattatgagagggaacaaataaagggggctatagcttggtttgctaccctactaaaatttatactttataaaaaaaattgaggttgcacacaaattgtttcttataggacattattggctttatcttgtaccttttcaactctacccgccaaagttttggtagtggacatcaaaccaaacagaccataaaatttgcccatgacgaagaaaccagaaatgacaaattagtaaccagatggtgtatcttatcactaactaaaaatattgactatttaaagcttgtatttatagtgccactttagtaaagctttatcgcaacatttagtttttttaattataattttgtattagtttatctggatattttctttttgtgctcgtctagattagagtttgcttgttttgtactttaaaattcgtagaaaaagctctattttactcccctaactatttcattggttcacttaacccacaaaactatttttaactcattttaccccttaaactattaatagcatttctctttatacgagttgtactttaatctgaaattttatagagccatagataacaccattatcaaagtttcaaaaatactttcaaaaaaaaatcatgactatctgtttaaaatttaaaacctcgatgtttaaatcaagcctagtgctttaaatatatgtatacaatgataaaagaaattctaaaaaatgttgggagataggttatgatatatctatcagtccttccaaatttcattgcaaaatacaatttatttggagagaaacagagaagagaaataccattagagagcaagatgatctgttttcaataatttggggtgtaaaacagtggctgagccatgttaaaactgtggggtcagctgaccccacaggtatttgcaagatatatattgataatatgaaaaatagtgaaaagtacatgaaacaatgaaaatttgtatagattgaccccccacattgttatatatttatgcattttgacccccactgggttgagaacctagctccgccattggtgtaaaatgagtcaaaaaaataatttagagggttaagtgaactaatgaaataatccgtagggagtaaaatggacccttttcattttattttgagctataacaatttttgttttacccctaaagaagtaaacatgtgagcagatagatctaatggtttaaaaaaatgattatagatgggcccaaaagattggttaggtaataattagcataatctatcttatgatatggattaaccgaactaatgaaagcataaagtttcacagtaacaacagtatgaacattacaggactaacacacatcattttcttcttttaaacaaagaagacttctaggtcgtcctagtccctttcacctttcccctggatttcatttgttccttgccgggtcttagttcatgtgccagcccctttcagctgattaatttactctattccctaacatcaaaggcatcatttatcgacaaatgtaactcttatagatgcatgcatatgctacaatccgatgtggatgacatgacacatcgcacattttgatgaactgaagtagtacttggcagttgacacaaggtttgcacagacatatatgaaaacgatatgctgtcacaactgactgctcaacttgatagagcgactaactgctaccctctgcctttttgttgattccactgctaacgtttgttttgaacagtgcagtaggtgctataggagaacgaaagaaagaggttcaatgaaacagtttgccatcaaagatgaaaccgaagcaattcaagggaagtttcagtcaaaaacaaaacgaaaggaagttaaaagaaatcaaatacacgaattgaccatttcaaatgatgaaagtgcattgttatattatagtcaaggggaagtgccattcatagtttcagaccagaggtggcgtcttaatgttagcagcctttgaatttctattatctctactctttatgaaaaacgaatagccagcaatctcttagctctaagaaataatgaccaacaaaatttgcagactcgcagtttcctaagcttgtttggaattcttatacgaactttttccctcaaggtttgcatacaaaaagcacaacctaagtgataagtaggaacatgtatctcaatgcgtgtaatatgcataatgtattcattctcacgccaatgcaaaagtatttcttcaaaaaaattttttgcaaaggtagcaaacgctccttacctgatggatggcttgacgttgtgttggtacgggttgaattggagcagagcaacccgtcggggcagaagcactggaacgaaagctgttcgaacctgcactccccgcctctccttctgcacccatcgcagtcttgatctcccattaccgacctcatccattccaagacgaacccatctttgatcaattgctcgtagtgtccactcaccggcttcattccatcatagtacccacgcaccggcacgctgacagagttgcagttccctcgaaccccggacggtggtgtgctgttccacttgtcggagatgtaagctcccatcgtccggtttccacatggccgttgcagctgcccaacgtgttcaggaatcgagcagtcatagatgaatgcgagatacttgttggtgttgctgatgatgaacgggtagggactgaggctggatgtcacgttgaaatccgggacggggcagtcggcgtcgccggcgaaggtggtctctacggccgccaccagcgagttattctcgtagaaaatactgtccacgcgaaacaggtggtccctgaacgtcctgctgaggaacgcgcggccggttcggttgtcgcaggtgaggtccaacaccgggtagccgcaggacaccggctgcacgccgctgagcgagaaggggtaactgatggtcaggttcccgcatctcgccggcgtgcagcttgtgttgccactggtgctggtctcgttgtggccaattgctgccgcggcatgcagcaaggaggcgagggggagcagtagcaaagcaggatgcatcgcatcggaggagagaaagaagatatcaacgagacaacaaggaaggagagggtggttaaggttgccggcagattcttgtttgcatccgtgcaagcggagggtggagtggactttggagagatgaagagagcgaaccaccgctgctgctgcttcggtcacaactcgcggccatatactttgaccgtgaattcattcgctccctgtttttgttcgcacctaagctagctctctccatcctctgtggtgagtttgcctgaaacgataggtaaaggtagaagttaatggaccatattatcattgaccgacccttagaacatggctcgacaaattctagccaggcactccaagctccaagagaaagtccgacgcaagttccacggcatcaattattggtcttctggtttccatttcagcattcaacacacaggctgtatatgtgaccactttttgaatggatgagtatttgaatatgattgatgaaaattctatgctgctaccagtaaattagacctaaaagttttcgatcatatccttttgctggcccttttgctaaagcaaggtactgcttcgaaactaatcattgtaaaaactgaagatgctcacaaggcacaactattgtgttctcatcaaactagtctggagactttggtgtcgtcggcgtcaacagagaaaaatgatgcaccggaatttctctttctgcagataaaatggctatctgaaactgaaaaaggttcagaggctgaaaactatgtacgcgaagcttacgtcggaggatgcagtctccatcacttcttccgtagctacgacggcgccatggcatcgaagtccttgtccatccattcgcatggctccatccgctccagcgaaaaatctcttcgccgtgatctctgcaagcgtgcattatcctaactgctacatggaaataatacaatagtgttggatcgactttttgtttacctgtggaaaatcgagcttcgttacagagaaaactggcatttaggaagtaacttgcatatgaggtcaccttccggctctggctttctttcatgaaaggtatacgcgttgacctgctaggcagtgtagtaaattaaataaatacctgtattttcttattgagctcttacaggagagtgacacgtaagaaggcctacataagctaaaaaaggaagtacacttgttaattacataaatatttgccaagcaaataggataaaaactatgcagcaatagggcacactacggttgcaagtctggaaaggaagacagattgccactgaaaatacaggcaagtagtgtcacagagtattgagttggccaccaaccatttcagctaaaagattgttattgatgaaaggtggaaacggaaaatatttcaacatagcaaaaggttcatctttgaacttggtagactcttaccattaaactacatctagagcaggcttgaattgttagaaaacgacaggtaaacaacaaagctttttcaagaactaaacatgcagatttttatggtacagaaccattataaggaaaaaaaaaaggtgcaccaactattctagtgtggattacatgaagtatgctatatataaaggtctaaaacaactagaagcacagtaggacagtaaattcaggattccgaagatgtggcaacactagtatctgtatcttaggcaagaacagtctcacatgacgtctcactgtatgaaaaccttgctcagctattcccgtgttagaaacaaacatgttaacgacgtatttgtcatcaaatgctagagtccaatgcgcatgcggcaagacaagtccaaacagcatcacataaattgctaaccttaactttcaagcagaaccaattcactttcttgtctcagatttttacaagaagcgtcaattgcacagaagaaaaaaagaatccaacattttgcaatgcataccaagttgctcctgttgccaatcttggcctctttgcagctactaccaggcgctgccaatggcgccaccgtggacccaagctgcccaccggcgacatgcgggaacctgactatcacctacccattctggctgggcagccagaaccagtcgtcttgcggcccaccgtcgttccagctcacgtgcaatgacagagcatcaggtcccttcctaagaaactcctacatcaaggtcctcggcttcgattatggccgccgctccctcgtggccgtgcacgccctcctcgctgccgatgctgcgtgcaccgtcatgttcaacgtgtcctccgccttcgcgatcactgacaggttcagtatcagccagagcaaccgggagctctatgtgctgtccaggtgcagagagagactgccaccgccagacgctgtcccggtgaccaactgcagagccaacagtagtggcatgtacgcctaccttgggggaagctatggcacaggccagacaccggtgaacaatggtggttgcgagctttcagtgttcctggtgcttgggtccagcaacgccgccgacatgacagcggcaaattacagacagcttatagcgggcgggtttctgttggagtgggaacctgttggcgactgcaacgcctgcacagcgagcggcgggaggtgccggtacgatgccagcacatcggcgttcgcatgcctttgctcggatggtggcatgagaccatcgatttgcggtgagctaagcatgcagaaatgatagtcttgtgaagctgcatatattcagatttctgcttttctttcagagctagct

SEQ ID NO: 64646 - DNA, 2529 bp, Oryza sativa
aattgtgatcggcatcgcacgaggactggagtatctgcaccagggctgcaacacccgcatcatccatttcgatatcaagcctcgcaacatccttcttgatcatgagttttgtccaaaaattgcagattttggattagccaagctatgccacctcaacgagagcatcctttcgatggcggaagcgagaggaaccattggttttattgctccagaagtattctccagaggattcggagttgtgtcaaccaaatcagatgtctatagctacgggatgctgcttttggaaatagtcaaagtaagaaaaaacataaaaggaattgcagataatttcagtgaaacatttttcccacattgggtttatgacagtctggtgagtgagatgcaatgttgtgaaacggcatatggaaccgaagagattgcaagaaagatgaccatagttggactgtggtgcatacaaatgacacctgaaactcgtccttcgatgagcagggtcatagagatgttggaaaggagtatcagtgaactagaaatgccgcccaaaccattcctctgctcccccatccactcaacgaatgtttcgtcttataaatcagtcaattttacgatgtctgcatcatcatgatatgttgatatgctgcattatgctactatatttgtagttcttgttttttagctgagcacttgtaattattttcattgttagtaccatattaacatcaatgtatatatacattctatttgaaaatctaaggatgtaagtacggattcacggttatgaatcatgactagcacataaaggcgttatactgaagaattatcagagttcagatacttcactatctcgacatcgtcagatacaattggccaaacgaacttcacatgcaatttctataaggaactaattttacaaaatgtttagcagtcaatgcaactatcttagaggacaaaaaaaaaaacaaagaagagtttgcttaaaaaaggaacagggaattcatggcatgataaagatgcagaacttactggtagtgggctaatctgcaaagccgtcggaggaacacgcgctttcatcagcacccctgcctgcctgcctgggtggatgccaatgctcgtccagttcccccgccccgccggccacggcagttcccttgcccaaggcacgaccgcatcgccgccaccccagtgcggttgacttgaccagtttccgccgcgcactccgatggcatagcgctggaatccgctcaggattggtcctgccggttgccgcactaccaccgccgagccgtcacggcggcggccggcggccggggctgtggcggcggctcgaggggagtggagcgagagagagagagagagagttgaggccccgaagagtagcatgacatgatacgggcccatgggccgtggataacctgtaatgacgggcccaaacaccaaactgagatggaagagaagacgctatgcagagattttttttctagttttagacatttttaattttaaaaaaactctctaaaaagaataattaactatttgccactagacccacatgtcatatacacatgagagcccacatatcatagacagcgagtgacaaataatcaattgccacagccccccccccccaaaaaaaaaagttgattctaaatttgaagcaccacgccagtctaattggcggcgtcagaaaaaactgtcacgccacatgatgccgttaacatattttaaaaatagagagaatccattatataccactgactttatcatacgtctacgatttgccactgactttatcatgttctacaatatgccatcgacttttgcttaacttctacaatttaccatcgccgtccggttagtctccgttagtattgtacaaatttgtcgaaatgaccaaaatacccctgggagaaaaggtttcaaaatttggataaaaattatgaaatatcatatttcaagtttttggtcaaattttggatgtttacaatcttatgtttataatataatattttgataattttatccaaattttggaagtttttgtcataggggtattttggtcatttcgacaaatttgtacagtactaacggtggctaaccggacggtgatggtaaatcgtagaagttaagcaaaagtcgatggcatattgtagaacgtgacaaagtcagtggcaaatcgtagacgtgcgacaaagtcagtggcatataataaattatctcttaaaaataagtcttgggaggggtccgttttaaaaataaaaataaaaatattaataaaataataaaaatccttgtgcagaagacttgaacgagtgcagtgtaaaaaaaaagtcaaaaaattactatgggtatgtttagtgctttagatgtaaaggctttgaagtatacggacacatttaaaatattaaacgtagactaataataaaacaaattacatttaaaatattaaacgtagactaataataaaacaaattacagattccgcctgtaaactgtgagacgaatttattaagcttgcatgcctgcaggtcgact

SEQ ID NO: 64647 - DNA, 1407 bp, Oryza sativa
gggagggtggggaaagggaatgacgtgaagagaaatgaagaatggtagagattgacatgtgggacccactattaaaattggagaaggtaatagagagatcgttggagtgaaatgcaaatttgactctccaactctttggcaaactggccaaataggtatttagaaagttgtatttagagatgttgttggatatgctcttattaattcttatctaccctaggcctcaactcctcctggctgagccgcctcacattcgatgcctgcagcttggcacgaggcaaggcccccgacccaccaaggatgtgttcggaggagggggttaggaacccctcctctctggcacgcaaaacgaagttcgttttatcgcatgattaattaagtatttattattatttttttaaaaaaattaatatgattttttaaaataacttagatatagaaaatttttgcataaattataccgtttaacggtttgaaaagcgtgcgcgtggaaaacgagatagttgcgttgggaaaatggggggaagaacacaacccaaggaggcatggactacagggctagccgtgttgattggaaaattagggcttccataggatggcctattcagtcaaagaaaaagccaatgtttgaattttcaaacacaatttttatattgatttgagatattttcaacatagtttctttttcagcattggcttttaagtcaccgagaacacatatataaaattttacctataaatacatttttattctctaataagccgttttggcttgttacgaaaaaagccaaacgatgagaccctgggccgttggtttgtgccccggagccctgatcacgcgaaagtggtggatggccggatcgaaaagttttgggggatttttatcccgttactctgcacttctgcagatcatcagaagcgcccggagagctgggtcctgtgctctgaattatccaaggggcaaaaaaaaaaaggcaaaacgaatgaaaagaaaatgattcagatactcaaggggacaggatttttgttccacgttagattaaaatcgcaaaatcattggcgagaacgtgttgctggacccatcaagatggaacattgttgattggcgagctggcacgcatgctaggtagatagctagttcatgggtcccatgacaccgttgatgcgccatgggcttgaactggcttttgtgtattttgcaaggcttgcacagcgccaaaccaagcttcctcctatcatagcatcaagttgaacaaagttgttcctcgcaaaaaaaaaagttgaacaaagttgttaaagatctttttgccagcttcaagccttcaaacatggggtttgctacagtgtaaatatcacttttaaatcctaaagactaaagaggatcacatgaagtggaccgatgaattt

SEQ ID NO: 64648 - DNA, 713 bp, Oryza sativa
atggcgaacatcttcaaaaacattgttcacgtaagagtcaaccccaagactgttgatccacatccgaaaggacctttcttctctcgataatagaacatcatcacgtgatgcagtctgattgagagtaacttgtctggtgtcactagttagaccattcctgtgcatcatggaacaatagcattcaagtgataagcagatgaccaattcattggcagctagctaagaaacttttaaagtgaatatactgcaacatggggaaaataccttagctagctttatgataaaaaaaagaaaagttaatgcctttggagaaacaagaaacatactacttaccgatgctggaatatttgtgccacaaatgcaagattcaaattggcagaaccctcagtgatatccttaggagtcaagtatcttttgcaatccaacttctctgcttgttcaagtaccaatttagccctctcactaggatcctttgtctctaatgtggtttcaggggaatgctctggagcaagagcttttagaaggtaagcatatgcttcaccatcctgtacagaactaacgtatgtgaacattggagattgaagtaatattaattaaatgaatgtagtttgattcacttttcccacatacgcatttagaaaggggatttacagcataagagtgagtcataaataattttcaaagccatctgttgcttagtcaatgaaacccaa

SEQ ID NO: 64649 - DNA, 5226 bp, Oryza sativa
agtcacagatttgttcgtcttttggtcttttggtctatttggttcagctttctttgagcttgtgaaagaaaaacgtgagcacacgagtcacatcacacgcccccatctttcagtcctttcatgtccttggctccccgcatctttcagccatttcctttcgtcctagcctcctggcatatcgtcctaggctgacttgctcggccgccgcccgtacagcccaaatactcggccagtcggcctggcaaatgaaatatgcttgcttgttgaattgaaattgcgcttgagttgtatgcgtggtgaaaaattctctcactatgcttacgcctatcttgtcaggaggcaggcacgtaactttgcttagtttcgcttgtcgcagtctgcttattagtgtcatactcgctccattcctaatcgatcttcatatatgatttgtgcatcaataccaagacaatcatgtggagcacttaatcagcatcaaaaacatacattagcgtttcgtatccgtgaatgtaacgccatcaattttacatgccgtgtggctggccaatcagttgtgagcgtattaaatcgatgcatgcagcggctcctaatcagttctacatgccgtatagcctaaccaatcagatgcatgtagtgttcgttaggaagtgtcattaacgtccttcccgggattttcatctcctccccaccgtaatgcgacaatcaaaatggaattattattttttttgcaatacgatgatcaaaagggaacggagggagtacttgcttattagtgtcatactgtacatgacctcctatccccaacaaccgtctccgcgtattaccgttgtatgctactcttttctaatatattgacgtgcaaaatttctgcacattcgtggaaaaaaaacacacgtccttgatgataagagcaagttcaatagtatagccaactactggctccaattcatctatagccaatctaatacatattcatacaatagttacatactacactatcaataactggtcccacctgtcatacacacattatgtattggagtccgtattacagctggctataaatctgtagcccgctacacttctctctcctcatttatcttcttaaaatatatttgtagctagcttatagcctgctattgtatctgctctaacagaggccagaatgttcgggcctgatccccacgaggccaatgtgtgtcaacatgctgtagctgaaagcctgaaatcaacaatgccttgcacgcgttgttgaccaacctggacgcgtgcgccgcttgtgcaacagtgcaagtcagtttcggactcaccgcgcgccatgcggttgttgactgttgtgaatgggggtagaaatcgcccgcgtagcagccgcgcgaagccacggcgagctagcgcgcgcggccgcggccgcggaacccgccgtgcgtgtgcgcttcgccggatggtagcgttcatgcgcgtgaaaccgctgaccttgggttccatcacccacgcgaccttggccggccgtacactggctgcgcacgcatcacttcccgtccgcgattggaaaaagtacgcaccaaaggtccctcaacttgtcaacgagttataaaattgtgtcctaaccacaaaactagatatacgacatcccttaacttacaaaaccgtcaactttagatccttctatgggtttgatcccggttttatccgatatggtagctgagccagcatggaacccacgtggaccccacatgtcggtgtgtccatgtcagcacctactctctttcccctcttcactttctatgtttctccttccttcctccctctcgctctctgctttcacacaggcatggcactagggttggcgcccacggtggcgcgcgcggctaaagggtggtgcggctggcgacggtggctcccggggatcttagcttccccaggtggcgacacacgggctcagagcggcacgagctcgccggcctccccgcacccctcgtgtgggtcagctggaggggcgaggcaggaaagggcggccggcgacgggttgggcgcaggccggcgccgcagtgatgggcacagagtggaaacaggcaccgtggtagccgttggtgagcttcttagaggcaacagacaagcaatggaggatctggaggacctcgacggtcgaacccgaagccatgaaaggcctgcaccaagatcgattcaacggcgccgccatcaagttgctgtcgtctgtgatggcggtgcactgttacggcgtgtggtggaggcggaggagactacaccgccgcacgcgtttgcaccgtgtgcctgctcgagtttgccgacggcgacgagctccgcactgctaccgctctgcgcgcactcgttccacatggactgcgtagatgtttggctccgtgcgcacgcctcatgctcgctctaccgcaacgccatcgcactcccatccccggtgtgcgccgcctgcgcgtgtgctagagcctcgatgacctcctcttcttccaccccgtcccgcaaccactccacctccatgcccaccgccgcggcgcctgcctgctcccgacccgccgtcgccgccgcgttgccccttctctagtgttgccgatgtcgcgccaccgcaccgcccgtcgccagctgccctttcccacatcaccccaccgcctggcccgtatgaggagaaaactgggaaagagagagagagaaggaagggagagaagagaggaaagagatgatgatgacgtggtcaccctgacgtatggggcccacatgggtactatactaagtcagctgtcacgtcagacaaaactagagtcaaaactatcgagggttctagtttgcactggttttataagttgagggatgcgttgtatccgattttacggttggaggacgattttgtaactcgatgacaaattgagggaacttcggtgcacttttttcgtccgcgattcgcaatctcccatgggccaaaggtagtgggtcgtgatgggagcgttgggctataatccctacctggctgttctctcgtgtgggcttaccatcgcataaggccggcttgtttcctttggtttgcgttgtcaatggtagccggcccagttattgcccggttggccggttatcgacgacgacgaatagcgtaaaagtcaagccataattcgatagattttgatgaaatttctgtgaaatttgttgataaccaatccgttatcgtgataagtgtggtgttatcgcggtagtagcaacataattccttctctcttttcgcgtgctcaccgttcctcggtgggatagcccctgaagtcatgaacacgtcggcgcagcccagcagcagaaagttcatctaagtggactctggttactattgaaatctttttttcttataaaaaaaactacaaatacagacgcttataagttataacacgttcacactcacctcatgatgacacatacgtacacccgcatctcaggcatagcttgagattaacgaaatcagcacgaacatctcactatcgatggtatgtcacttaccactaaaataataattagtcgtaaatgcgagtacttatattttcatcacaaagaaatatatttagttaagttatgtttacttcgcgctactgaaatctcatctagatatttttacgagcatcgtatcgtagtaacggagtggagcactcaacgtttggctcagggccgtgcacaggggtgtgcggcccgtgcgaccgtacagggcctgcaaatttctagggcctcaaaaaatcagcccaaccaaagaaggcacatgtatttgtatgaggctagagcgccagaaccccgttcgagtccgcgcgtatctccgcgtggcgacttcgcgtgcgtggcgcttcgtattctcaacttcgagccccgaggccccacaacgttttgtattctctttcgttttcgtatctgtgacttattcaatttgtctcgagtctcgacgtctcgtctcctccgagcaccaggccgccagccggctcatccaatttcacattttcattcaactagcgaatagcaacttagcaagcaaccaacaagcaaggcactaggcagcaagccagcaacatcaacaaacattctccgttttcagtttgacagtttctaattatacaaaacaagagttaaaaaatatactattcttgatatatcacatttgttttgcagtatatatattattttagctatatttggtacttgatttaggcctcacttagagccttgtacagggtctacaaatttgacagcacggccctggttcggctggatcatgactcatgagaactccggctcacctatttcaaaaccagaaaaacaaaccggcggtccgcgtttgatctaggctgtgtttagatccaaagtttgtatccaaacttccaacttttttcatcacatcaacctatcataaacacacaaactttcaatcacatcgtttcaattttcaaccaaacttccaacttcacagtgaactaaacacagccataatcgcattccaccattcctattcgcgaccagaccacctggaccatgcgtagcgtagctccctgccatcctgccactgttgagtaccttgcagcaggcaagcagccaatctggcaatgcctctgtctgagcacatccatccgattcaacctcgactacttgtttcgcatggatccagatttttacttgtttggcatggatggatccagaatttttacttctagccgacgacgacgagacgggtcgagatcgatctcgtggtactacagtaattttgaggccgggaggcgctgtgctgccgatcaaaccaaaaaaaagaaaaaaaaacggagtcaaaccaggcaaccaacccggcaagcgcggcgtctctcgcccgtgtgtgcgtgtctcgggcgtgatgcgagccgcgttgtgatgcgggtggttggcgagatcccaaacaagggaacgcacgacgcggtcgctgcgcgcggctgcgcctgcgtgccgaggcgacagaccgaccgaccgaccgatcgatcgaggcaagcacgcacgcacgcacgcgagcaaaacgacaggcgggcgtgcgagcgagcggagcgccagcgacgacgacgacgacgacaacccctaccgcgatcactcgtatcggccgccattgggtaccatctccgctctcagcctcaactactcaaaaggcatcatccaatgtacagtcctgtgcctactgctagtctgaactctgaaccatgagcgttcgtgaat

SEQ ID NO: 64650 - DNA, 2898 bp, Oryza sativa
accacaggaaaaacgatacagagatcaatcgaccaacgcgagcgacgactcatcatccaaaacgcgagaggttattcacatttcacagcgccctctgcaacaatgtcgccgcaaaggaaaaaaaagaaaaagctaaggcagcaaaagaaatcaagaaagcttaagctaacaccaaaacgatcgagaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggcgaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaattctaccactccctcagttctcagatgcataaggttcacaaaaccgtttgctgaccgaaaatcgctcagtgttggttttgtcagttttggcgaaaattgtttgaaaagagatggaattcagataaattgtcaaaattttaagattcaaattgatactccaacagtcaacagagtggtttgtcaactcaagccagctcaaaaccacgaaatgtcgtgaaaaccaagtggttttcgtcggttctatgaacctcaaacgtggaactggtgctcttcgttgcatgatgaggcagcatcgccaatgtgaaaagagaactgaaatattcatggttgatcactttcagcattctccaacggaacaaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgtaaacaatgaacagggattcttgggaaaccagatctctccacaatattatgttatatacagctcatgaatggtccagagcagcagcagattacaaacgatgccagtacattttgacaggtccgggaaacaaagtgaagacattgaaatcaaagtatactaagagtacaagaaatgcccaactagtgacctatgtatagttttttccctgtcgtatgtatagagcaaaattaaatgaacaaacggcaactctatctatctgtatctgtatctatcatgctacctcaaaagtaggcttggaacagaagcaggaaaaaaatcacttctggcagcaaacgttggacaccatgacggtactagttccaccataataaaaccgctatcaggacagaagaacagcccgtgtaatcatcatcatcctgccacaccatttccattttctgctggcggggcatttgaaatagcatcatatgtggtcaaattggacatactatcagatagcgaattcacctcttctccctcagatgcagctgttattgaagcagcgtcctccgaagcaatatcagaagctgcatccgaagccatactagatggctctgattgttctgacgtttcagattgtgactgtggttgcttctgtagactccaatacatgatgctagccgtaagcgttaggatcatcttctgatttacctgaaacagaaacataagagtacgattagtcaacagataataaccatcatttttcaagataaaagagaagaggatcacagacaacaaataatgtagacagtaaagcatttagcccagatgctagataaattgctgaaggtaaagcatttaattccatctgtgatggtaaaagttgcacgctcaatttcatgcttattagcatcccttacctcaatgatgtcctctggcagcagaaacacggaacatccgattttccttgcaacactaatggtatatgtagcatttagcttcttttcctcatctgcagaattgaaaggaaatagtgaatcagccaatgctacggttttccaaaaggatacatatataaacagtcagaaattatcatcaaatagtaattcaaacgtgcatatgaacagaccatcttccccctttgtaacaactttccagttgacaaccctcggttgtactgcactaagaagttcaaggaaaaaccgtccatttgataagctcttgtcctgagagaagataagaaaatttattaactggagttatctaacaacaaattaaaactaattaaacagaaattaataacaccttgaagctttccatttgagatgttcttcctgatgctttcactttgc

SEQ ID NO: 64651 - DNA, 9632 bp, Oryza sativa
tggggtgtcttcttgagattcagatcagccaaaagttgaatctgatgataagtgcaaaagatctttatatgatgaggcaggagtttaaccatagtatgtcaaacatcaaaatgcaaaactcagtgcaacatttacctttatgatttgagatatcaatccaagaattaaatgaggctgcaaaaaagaagcatgttaaccacaacttaacttttagtgaatttcttgaattaaatagaagaagtcacaaagggaaggcggctgaaaacatctgacacatggacaagcatatcaaagaataacacatacagcaaatgagcaaggaaatatgaggtggaaccaattagcaggttatacagcgaaggataaaatggtatgcagcaaattagtggtgacaatgactaattgacagcatactttgtacccaaactacctagcacctacagggcattaaagtatttcaatgtagtcctgaatgaaaattagtggtaaaaataatttgcatagactacaatgcaccatgaattactaaaaagaatttaaagtagggaatgcgttgcatacccttccctccaccaaatcttgtgtaccaatgtttacaactgtacatccaatggccttggcagagttgaggcacagggtgtgattttcattcctctcccatgggttaagaactcttttcttatttattgctctctcatcaatggtcccaggtacagctaaattgatcaatttactgagcaaatgatccataaatgagcaaatatcagctatgactcaagggcagtttctgttcaacgagtaaatggatatgcaccctttggttagctgtaaagaccatctctcaccatagcagaacaccgtccctgacaagatcgaacagctggttgtcggtaggctcgattggtaaatacttcttcagaaacgggtcttcacgaaggtaggtgttgatgtgcgccacataagacgacttctccgcctggttgagattgtgcagcaatgtagtggtactggacttgaggaaagatgacgcggtcttgccaccgccgccaccaccacctccgccttctttggcgctcacccttgactgcagattcaggtattcctacaaacacaccacacataatcccattccaatcaaatcaacaatgcaatgacgctctattcctctcgtcagtaccaacaggaattcagaaaataaccgagttgtacccgtaggaatgactcgaactcaatctcctggtcggcgtcagggtaagactgggacaagtgggcggcgatctcctcctcggagatcacctcattgagccccctcagcttcttcatcagtcccgggaggttcttcgtcgtggcatgtcctccggagtctctcttcagagatagaaactgccaccccgacaaaaaaaaaaaacccatcaattccaccccgaatgagaggcgaactgcggcttcctatacaacgaactgaagaaaccggggataattttaggtcaccttggccttgagcgatcggagctccacctgcgtgaactggccctgcagcgacgggtcggagaccacgacgccgacgaaccccgacatctcccccctcctccccgacctcccctatcgactgcaacaagatctcagatcaaaacggccgcaaccaaacccccctcgaaaaacaaagaaaaaaaaaacaggaacgtggagatcgtccgcgccctcgcgcacgccgcgtggatgggcgcgtggcggcgcggcgaggcgacggggggaaggggggggggacgagggtaggggtaccttccgaatttctcgcgacgattcgtcgtcgtcgacgctcgccggaagtgctttccttgcggtggggggaaaagagaagaagggttggcaatggcgtcgtggctcctcccagatttcgtgggggcgggagaggggaggggaagtggtggagacgaggacaggaggtcaggtgggtcggtttcgtttgtttgttttgtttgtttattcgctggtatgtctccgattttaggtttcctcagggttaagaattagcacattcgttgtttttttttcaaagaaaaagaaaaggaaaaggaaatagcacctgggctctacgaggggctataatgaaagaaataacacagatatggagttttttttttaaaaaaaacattttattgtttgttttctttgggcttaccacatcttaaacgattggaaccaaggtctaacttatttggactttaaagggttgtgcaaaatagatgatacgtaatagaagacattgaatgctttacattggaagaggtttcgattgcgagactttaacaatatgagtgtccgttttacatattatcggtgtatttttcttttctcaaaattgaacaaaaatgcacataggtcgagttcctaaataggaggatttttttaaaaactttttacatatatagttatcattataagatgctatttcaaatccattctttttaatcttgtaataatagttaaattattgtttgtatgttccattacattgaactcaaaagaacacacctatctccctagaaagtaggagcaatggagcaccagctatatgaatacaaattaaagatccttttgtgaatacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacacctcttacctgtacaacacatacccccccccccccccccccaatccgtgctcccgccgaacgtgaacccgtcacgcagacacgcgtgcgcgtaccttgggcacacgtactgcacacagcgcgcatttatccgcaaagctatcgaaatattcaggtctccaggatgattcaatgcagagaagagctcattctctaaaccgaagtactagtaatccagtattgaattaatcaggttgtgtttagattggcccaaagtttagagtttggttgaaattggagacgatgtgactgaaaagttataaaaagttacgtgtgtatgaaaggtttgatgtgatgaaaagttagaagttttaaaaaaaactttgaaactaaacacatccgaagtatggcattttctggccgaacggttcgacaacgtgatgcatcgaatcgaagaccctgggaagcatcgacgagttcgtacggagccgagctgacaccggagctcctccactgtcctgcactgtcgttccagcttcctggttaatgccgttttccgaaagcgccagatcgccaggcttgcagcgcgccaacacacaataactcaacaaggacggctaaattccacgcacgttatttccatcggcatccaaagcgatagcacgacaaacacagcgcgccgcggggggaaagctggacgaatccttcgccagtgcgcacatcggttgcttgttatttggcgcggatccgatcgccggcgatgtgacggcgtacgggggaaaaaaaaaaggaaaacacggagttgagaccgatcacgcatgcccaggaaaacggcgaaatccaccgctgttgatagagagacgtccccgatggttttgcttgcgaattctctcgtctctcgccccggtcacatgcgaccgacgagacgacggggtctgaacgtgctcaccgctttccaagcgtgaaagttttactctggtcacgtgatgacgtgaagccgccagatcctgttgcttttgcttgcctcgggctcctctcggacgtggtcgccgaggagcagggccgactatatcttctgaatttgacccaccagcttgggccgcgaagtctacctatccaaaacatgggccacgcgcgctgcgcgaaaaggggggaaggtgacgggccaatccagcattgccggctggatcgtcctctgcgcgggccggaaaagtggcccacacgaacggtaggtttggttggaacgttgggtgggctgcctgaaatcaccgctccagcctgctttctggcccgcttactcgagttgctaacttgtgttgctattaattcctctttaatcaggtgaacggaaggaacccacatgtttgcaactttgcatcccttagccaatcgctgcaactatatgtaagtaaagctttgaccacatgcatcttgcgtgatgaatccgccgaggagttggagtggggacccatgataaatagtccagctactgcttgcttgcttgcaccctaaattatacgggaatcctcagacctctgatccgcgaagttacccactctaatatacaaggcataacactggtaaaacaagtttagacaattatacatggagaggaagtatcggtgatgttcgtggtggagggtgcatgactaccacccactatttaagtcttggtctctggttgccacgaatattatatactcacagctatgtttttaatgggattttagtataggaattctcattggtttctgtctttgagtatgtattagggagtatatttattgatttgtgtatgtatagtgatgtctatggcctatgggtatatgtctttcgtgtaattgcagagagaagcacacagaatgggaaatttgtaagggaagcgtcagatacagtcccagtgtttacaagaaatgcagctgcgttgctctgaactcaaacaggcagttcgatcgaaacaggaccctgacagagtgacagaagctcaaacacgcacactgacataacacatagcataacatcaacttgaactgacaaagcgtacgtctaacacggcgttaacacagcaaacaaccgggacagacagggcaacaatatacaaaagaaccctagggtgaatcaaaccaaaaaaaaaaatgagtggataagacgcaaacgagacgaaaaaaaaaatgtccacttctgctcccaacggtgacgacagtaacacacagcatgaatgccggccggccggcgcctcacccttctactcggcgaccaccaccggaaaaacggctcagctgatcattagctcaacgccggccactctcggcgtatgtcgaaggtgtagttgatctccaggtaacatttccggtcgtcgtcgaggaactgcaagaataaattaacaacacattgctgagcgactgaaccttgcaggtttcctgaagcagctgatatctgacaaagaaaattcgcgtcatgcgtaccttcgtcctggccgagtaggatcccctcgcaaacatgccggacggcgtggtctcctccggcgtcacgtacgtgtacggctccggctgggggctgaacgtgccgagcatctccttgtggctgtcaactgcacgccccaacgggaggaaccaaaaccatgagtgcgtttgcacaaattcaaacgcgctaaatccatcggattttataaaattttagtagtaattaattgttcatctattggagacctaattaaatgtttttcgtgtttgggtatacctttgatgccggtcttccagacggcattggtgtagcggaggccggagacgatgttgttgctgacggagaaggtgaacttgagcttgtagagggagccctccttgagggtgaaccagacgcccttggcgttgggctccaccggcagcggcaggaagatgtccggccggccgggcgagaggatggccaggctcatgatcttcacgtcaggctccaacgtctctgcaccgataaaatcaagcgtgacaggttcagacttcagacctcattattgggtcagttctttttgggacattattgcatcctaatggccaggacgtgtaggccaaatgattggccgtagttttgagtttaaaattctaatggaagacaagcagatgccgaatgaatgatcatcctaaaaccgaccgtgaagcagctagccatcatcctcggattatttggttaaacaaccacaaccatatgaatcatggtttattcaacactagtctaaaaagcatagacaaaaagccaaggttcgctagaattatgcgatgcaaaaatgtgtctttttaggccactattcaaaatccatttgatcttaaaagcaccaacaccctagcatataaactaacaacagaaatgcactgttccccagtattaagatcagaaggcattgtcaatgtcatgatcagatgaaagcattagttcaagcttcaattaggagcccggaccagattcattatcagacaagccgaacatgcacggcaaagtacaggagttattaacaggaccatctaaccggtgcattgaaaacgccggacccgtccagccaagcccaacatatttcactttttcttttgctgttctaccgtattttctacgtacaaatcacaaatgtacggagtagaatgcaacacggagctcacgggggcggtgcatgcatggatgaatactatagacgatggatgaatctagtcgtggcccatagaacgggggctaagcacggacaggtacacaggtgcattatcacgggaccatctttgacaagggcacaaggcggtgctcaggctcacatgcaacgctgttgcatgtgccggccggcgccattaaacgagatcgcgaggacgacgagacgacgcagctaaaaacgtttagtagaaatggatttggttcgaggaatttttacctcctacggagttcaaatccacgctgccgagcagctgctccttccaccgcctcaggctctcgtcgtcctgcaattaagcaagaacacgcagaaacgcatgaagaattggatgcgttgtataaaatggcgggtgcttgcaagaattcgagcaatggcgggaatgagtagtggtaccttgtctttctcgagctggtccttgatgctgacacgcgggccgaggtcgatggccttgggggccttctcctcgtcatcctcctcctcctcgttgctctccttgcggcaatgcggcgcctcgccgcactgcttcccgttcatcgtcgcggcgtcgccgccgtgctccacgccgccgttcttgcccaccaccgccacccgctccttcgtcgcctcctccgtcggcggggccgcgatgcccttggaacaggagatggcatccaccgccgacgacatcgcctccgcacgcacgcacgcacgcacgcagcccgcgtcaacccaagaacagaatgagccgaaccacgggaggagacaatgaggaggaggaaggagcgtggcaaggcaaagcaaacgggagcacagataccaaagaagcaaagcaaggacgctcgccgaggcggattccgggttcgggacaaggggaaagtagcggggcgcaaggctccaaaacgagggcgcggcgcgacgcgcgcgcacgcacgcgagacggctagcgcgagacgaggcgtggcgggggcagatggttggatccagcaatggcagcccgggggcagagagaggataagggggttttaattccctcagctcggctctgtccgctctcatcaccagaggcgagatgcgaagcgagggagtggactagtggcgacgacgtgagcgtcacgacctgcgcgcagcggcagtggtacaactgtagcgcgttagttaaggcgatgccagtatgccaccaccaatttctcttcttttctttgcatatatgctttgcacagatgatgtctggatgatcattggggttggtccagtaattaatccatttttttaaaaagtggtattaactatcctgtctggctgtctgtctcaattcttcagtggcaaactggcaaagcagctagcgttcgaagtcaaaatggagatccacatctactgagccatggatgtgagaatggtctgggtttactacctgcttctgctttctgtgtgttactgatcgggtaggtgaagatctgagtgggtacctgcccagccagtccgtttttgtcccaggtgatgtcggcttgtcccgttgaatcgggcccgtccatcacggcccaatcatagatctgcgcgcagggcaactccattcatttccacatttcaatgcggcgaggcgcagtgatgtagtgatgccaactcattttcagtaccatatggctggagtcattgcaatttgcacacaccgtccaccaggcaaactttgccaatttgccggtatttcagccatctaaccagcccagataaacagggccctgtcgggggcctaaactactcgtcaggcttttcgtcacctgaagaaacgtcgcaatggaggtgtgatcacagcatttgtttattttaacctataagtggattcgcgggtaacccacttgcactcttggctcttgcagacctcaagttgctagtttcgtttatgtgcagagtatctcaattgctctaagcatactgaagtggctacagtggtgaacatttgttcgtagcagaaagaaagctggattctgttactgaattccttcataggcgagtaacaatctccccgttacatatggacctgagttagggaggtggatctccctgaaagagcagatagctgagagctaactggagaagaagtatagtgttacaaatcatgacaaactgaggaaagagaacttctggctggcctatctctagctcacaacaccagtttgtctgccattttgttcaccgatcacggtatccacctaatttggactcctgtccctgcaaaacttgctgaaaatggtagagtggccggaggctccagtgtcctcgattgcttgcatgatatccttcctctcctgcaaaaccttgacaacagtagtgtaatctgacaagtaaatggcattgttcaattgcaagttgcaaagtgctgcatataacatgtccaaagatgagagccataagctctgctgtgaaagaagaatctgactgcgaactgtccttcgataactaaagtagagtgaggtatagagttgtctatgaagaccccagtccgcatcaacataactaacatcttgttcctgcaggaatggaatattggaatatgtttgacagatttcaaaattcatcttattatatttttattgaaccttgaatacataagaaattaacaaaaaaattatatgttcctgcaattcataaattttatgtgacctcaagcagcaatttagtgcatggaagtatattatgtgaaatctcaaaaacagccaaggacagaaatagagttcaatgattcagttgctgaaatacgactggtaatttagtttgatggacctgatattcaggggtgctggattgaacttcgttagtaacaaccactatagtcaatgagcggcacctcagcacaaaatcatcttggattccagttcagaaaaaaaaaacattgttacactattgcaactgcaaatgtggaacaaagttgttgccaagaaggtaaaaaaatatctaccacacaattaattaaataacaaaacatttactagcataattagaacaaaagacaagaacaggaatttgttgaatgaaatggaggttccctaacgaatctggtctactgtgcacacccc

SEQ ID NO: 64652 - DNA, 3225 bp, Oryza sativa
actcaataatctttcgatatttcaccgagggtaatgtatggtaggaaaatcgccagacataacagagccggccagactcaactcaaactcaaccctatgatggtaaactgtttgcgattaacgcctccgcctatgacaatgtttggagataaacgcttccaccaaaaaacgaatgtcggggagtgttctcccctacaagaattattattgttttcaatgttaaaaaggcaaaattcaccagatcccgttagtgcaggaccaggaataaacacttgttcgtcatcattttctgccagtttaggcaccgcccgagccgtacttctttccaaagaagaggatctgcagctggtcatagcctgagagcacaccagcaccagcaatggcacgtaggatgttggcaccagcacccttgaacagtgacttggcaccctcgttcttcaggatctgggagaaagcatccatggagctcttgtacttgacagcctctccagaggtcatcatcatccttctgcggacggtatcaatggggtaagaggcaagacctgcaccgttggtgatcagccacccaagggcaaagcttgcaaagaaattgtcctgcaaaccaatgaagatgttaaagaatagttccatagatgggcaaaaaacaactaatattgagacagaaataagaacaaacctggagagacccagtgagtacaactggcttcagagaatcatacattccaaagtacagaccacggtagacaatgattccaacacatgagatgttaaatccacggtacaacccagcaatgccatctgacttgagagtcttgcggtaaacatccacaaggccattgaactgcctttcacctcctcccttggcagccttcgcatcattggccaaccttgtcctagcatagtcaagggagtacacaaaaaacagagatgaagcaccagcagcaccaccagaggcaaggttgccaccaaaccacttccagtaaccatccttgtctttcttgaagttgaacagcctcttgaagtaatccttgaaagcaaagttcaaagcctaggagacaaaatcaaaagtcatcagaataagaaaagaactatagtgcaatagcaacaaagcaaacagaatgtaaacacacctgaactcttctttcttaataaattttgattgattcaaacttcttaataagtgataaacatgtaaggtaaatagaatcactacacaggctactgaacatcaaaacgtagtgctttgttcaggtgttttacatagatgttccaaagtgtaatatacaaaacataaatttggctaccatcatgaaaattgcaggttacctgggtggggaagtaacggatcacattggcagtgtttcctctccacaatgaagcaaaaccctcatccttgatagtgcgtccgaagcagtccccaatacccttgtatggctctgagagcctaccagccttgatcatttcatcctggttctggataagcagcttcacacgctcaatcggagcagcagcagtctttgaaactgcggctgacactccacccatgaggaaatcaatcatgaagtttttgccacctttctcagctggagcattagcaaaaattggagaggacgacatcattgggacgttgatgccaccattgacaaggccctgggtcatgtagctccttgtggtaaagcgcctgtcataggatgagacagatgggcagatgttgcgagcccgtacaccttcagaaaagctggagccaaggtggaactggccaccgaacttctgaaggacagtcggttgattagcctgctcagccatcaccaactagcaacaatgtcctgcatcataaaaggcaacagtactggtttagaaatccaggatcacaggcaaaatatttcactcaaaatatttgtagttcagatatttcactcaaaagaaatcatagcatacgaacagacagtgcagaagaaagatttattgttgagatatttcattcattagaagaaatcatggtgtacaaacagaggtagtgcttaagaaactaaacggaaagagctaataaactgatatttaccaagaacaaaagcccaaaaaactatatataagcatgtaattacacaattgtacagtctctacaaaaatgcatccagaatgtattaaaaattgcagtggaactcctgatgacaaacagtataaggtgttctacacagtagtgcacatcaccatcacgacgcaccatgagaactttaaataggtcgcagaaaaggatggtccctgtccaagcagggccgttcctttttgtgcagagcaaaaggaatcgcaattccagagcacattattaaattctaccaacaggtaatgagaagtataaaactagcatgcatgaaacacaggattatactagtaaatctgtacaagtttataaacaaggatggatcgttactgtaatacggtcacggtcagatcaaatcgagaaacagagtcatgtttggaggggttgtgtgcgttcagatcacgcatctgaggcacatgagacgaccagatctagtcgacgtcagtgaaaataaagaaaaccagtaaaaaaacgcaacccttttggctgccccaccatccccacctgaccaatgaccttccgatctacagattcggagccaacccgaacatccaaagattctacgaacgaaacgaaacccaaacccacatgatccgcgcacaggggagccataaccctacaaaccacacaatacatgcacaaaataaagcagaaatagaacagatctaagcaaccgaccacccagtcaacagatgaacaggagatcctcccataccagaggaaggaggcgtcgatctgaacctggaaaagcccaagggctcctaccactcgaacaccaacaggcgtaacaagtctacttggaagaaacaagcagatctgcgcgagccacagccagatccacggatctatatatacatcaccgtctccaccgagcacaacccaaaaaaggaggagaggagggaggaggagaggcaaacgacgggagcagctcacccttcggaggcggaggcgggggccgatggcttgctttctccttccttccccaagcgcggcggcggaagagggagagagaggagagagcgagcgtcgtgggggcgagggtttcttggagcggctgcgtgcctttttatctccgcctcccgtggagagagagagagggaggaaatgccgtgctgctattccac

SEQ ID NO: 64653 - DNA, 4454 bp, Oryza sativa
ggggcttgggggcgttgaagcgagggtgtgaatggtgggacacggaacatgggatggtgcggtgcgaaacgtgcaagttggttgcaatgtgcgggtcgcctttctggatggtcagctaggctgttgcgatttgttgcccaataatgctagtttgtttatgcacggaaggaggaataattttctttcgatttcgagttccggccgtccattcttcgattcaaagggcaattaacatgtgcatgaacggtgattgttatatgataatcaagtgttggctaatgctaggttgagaacatcaactttgatgatccatcgggagattggaaaatggattgagtagtaattgaatggatgtataagttgagaatggtcttcaaaataatttaatttcgtgccactgagttaactctgtcttaacaaattaccgccgactttatctccctttataatataccactaactttgctatttttttaataagatgtcattgggtcgatacttctaaacaatttattaagggcatgtttggtaaagctccaactctcagatcctaactccaaactctaactccagctggagctacctcttgtaagagccgaagatgatgtaaaagtgtttgcctcatttggtcagctcctaaaattctgaaagagaggatagggaggagatggacaataccacccttgtgattcttgccgtttacttcatgaaggattaatatgctgtttttccttagtaatataaatgtttaacaacttgtagcatcattatcatcaaaagatagagcaaaagaccacaaaataacatatagtaatatggtctatcatcgtgcagtatgaccagctagatcatcatgaatgctttatgttatctcatcctgaaagtattggcctctctcttgcaagatatcaaaccaaatcgcaatatgtgcagctgccacatgcagaatcacaacacagataatcacttggaaaacatgactgatgaactgaatttacaacaatttttgataaaggttcagacaattttcaataaaggtccagacaattttcaatgactttccaagagattcatagtaatctattcacaaaccagcagaatacacagagcagaaaaaacacaaaggtgcactagctgtcattagctaacagataaaactgaaggcaggcgtgaaatcttgatagattgcagttcaccagctgctaacctgcaaaatgaaatgctataacctgtcgttgcagtgcagataccttccacacagatctggaaaccttgcacaccaccgtcgttgccgtgctctgaccccgccgctgtcgccgtgctgcgtatacaaggtaaaatgcatccatcgatgaataagttcaaggccttgcttgcaagcaagggtccaggtcagctccaagcaaaaaaaccaacaatagtattagtctctcagtcataccgacatctcataacccactgaagttttgtgctgctactttacatccaactgaacctttgcgaaacatctcggtatcacatatctgaaaaactaacaagtgaaagcaaggacaacagtgatgacggcaaaaaaaaagggacttctggtagttcaatcttgaatccttcgtaggggtgccctctaaccaaatcttgatttgaaaatctcacttgtgacttgtctttccattgaggtcagcaaaacaccccatgaatcaattaaggacaatctataaaaagatattgtatagcttcaaatctatcacagaattgaaagtcatagcttcctttcctccaaccccattttttggaccatcttttgttagtatgctgtgtttttaatagccacatggacacttccactttcaggggtgccttagggcctctagattcttttgtgtgggaagttcaggccctgtttagatccttcaaaatggcaaaagttttgccattttgtagcactttttgccaatttggatctaaacactagtagcaaaagttggcaatttggcatttagcatttgctagtccatagtagcaaattgtgccaaaaagtgctttgggaccactccctctctctttctctctctcactttagtgctagaaatggcaaaactttaacatgcatctaaacaccaactagtacttttgcaatgccaaaacttttgtcatcaaaacttttgcaaattgccattccaaatggatctaaacaggccctcagtccatgtattctcatggcatcatagaaagatttcatagtgaattccctattctttttctcccaattgctcagccaggggtatgcccccaatccaattatcctcctataaaaggacattctttccactgctaggttttatactaaagaattataaaccaagtgtgtatataaccatttgctgatttgctcaattccaaccaagtgtgtatataattgtaaacacaaggtacaacactaaacaaaaaaaaagttactatatagttcatcactgctctgaaatttcacacatcccaatcgctcattgcatttttaccattcatcactagacaagtcttcagatctgaaacttccccatttgctcattgcatgataacaactactcaaccaaatctgaagggaagaggtgagggaaatttctagggtttgggagaaaataccgtgccgctatttggggtcgtcgtgcgccgtctccatccaccttgtgctaccgtgcttgccctcagccaccgtgcgcccccgtgttccccattagccgccatgcgccgccgtgctcgccctcagccgttgtgcgccgggatgggaaggaggggagcgacagtgaaaggggaagcccatgcgccggctatttccagccggtgcgtcgttaccgccggccgcttcctcctccaccgtgcgccgtctgctgcttcgcctcctcgctcccgcgagctggaggtcggggaagacggggtgaagcggtacgggagagagggatggggggtagggcgatggcatttgcgggtaatttcatcgaaaatatatgggcaattctataacgcggttggagttggagttcaggagcgaccaaaatgccgctccaacccgccagttcaatttctcagagcgattccatgcgctccgctccagctttgaacatatttggaccgtttggttggactccagctccaggtaagttgaatctgggagctgagccctgccaaacaggccctaaatgcccttcgagatgtagaagggttgatagttgattgatcgactagaagatcgataaaatatgaaagctttcacatgcctttctaataaaatatagaagtgtgttgcacatttcaaggttttcaatttacactgacatttttcgaaaatattgtttatgttttatgctaatataagtatcttttgttgatgttcttttatgtaaaccatctttcacgtgctatgcaatacacaattatttttcatatgcatctatctttggttcctacatatattgtataaaaaggctatgtaaaaactttcgcattttttggaacttatagtgggtttataaattgtcaacccttctatgatttgaaggatatttgaagtttttttttaagtattcacccccaatgcatattgtagaaaaaactgacagagtcatggtatataatagagagaggcaaaatcgatgacaaatcattgaattagagtaaactcgatgatatagaataggctctcttatgatctttggccagacaagttgtaggttttccatgactaatggcatcacagctcttaatctagataagttatttctattcaataaagtatagactggacgtcatgcttgtcatagatttagaaaaatcgtaacaccatacaggttgaactttgttgttgagttttacctgtcccatgcatgatccctaaattattctgatgcccaaataatattcagcgaccgtcgccctccggctccaagtctcccaacacaagcaaatgtgattacaggatgaaggaagacattatttgcatgaaacgttagccgcgatgactaggaaggatgggccttatttagatgagctgcaatctttcacgtctgaaggattggattccggcctatcccaatttggcccaacaaaattggatatttttgttaggaataagttcaccggaagtccctcaacttaacatcgagatttatttgacgtcccttaaccacaaaactagaaattctccacccctaaactatacggaaccattcacttaaggtccctaggcagtatgtggggcccacatgacatcctagtcagcaaaaaaaataataaaaaaagtacgtggggcccacatgtcagctgcacattccttcccttctcttttcttctcctcctcctcctcctttctcttctcttctcttctcttcttccgtgagggaggccgacggttggcaagcggagcggcgatgggagggtggcaggcgagcgcggcgatgggtggc

SEQ ID NO: 64654 - DNA, 1837 bp, Oryza sativa
cattatcctcacagccccggcgcactcgcccgcagcgggccagccaccgctccgcgcgccggccgccggcctccctcactgaagaagaagagaggagaggagaggagagaaaagaggcgacgtcggggcgggcgcccgtgaaggtggagaagagggagagggcctcccaggggcggccgtggcaagagtgcgcggagaggatggcagtgtaggacgagtaggcaagggagggagagagggtcgacagggagagtgcgccgctcgccggcggcggggcccgaggtcgagcacccggcgcgttcgaacatctccgccgccgagctcgccatcgtgtcgaccgccacctctcctcctctcccgccgccatcgcggaccgcctctctctccctctcccgctgccgtcgtccccgctccgccgctggccacctctctctccccctatgtcgccgcgcccgctcgagagaacccggagagaagataagagaaaaaggaaaaaaaaaaaagagaaatgtgggacccacaccattgtctcacttacatgtaggccccacatattaatattaattatttttgctgactaggatgccacgtcagcgaaaccacccatgtatactgcctagggactttgagtgaatggttttttgtggttaatggatccaaaaaaatcttattgttaagttgagggacctccggtgaacttattccttttcgtcaactgttttcatgatttcgatctctcgcttgatttccacccgtctcctacctgctgccgtagattgtatcgcggagataacgttctgtttgtattgaacctttcctttttcaagcgagttattagaaacttcattaaaaacttttaactgtatccgcatgtccttcgcagattgcatctgaaacaaatccatatcagggtccttttttactctatacaggcacaccaaggtccttgtaacttcattttagcagtggtttttactatttcgcttgtctttgtaacattgcaatctgcaaaagcaacctcctgttaagccggatgatcgtcataatgagtattatgcagaggaggaataactgggaactaatttgggtcaagtgggcgtgtgtgcgtgtcttctgagttgtacgcgttcaacaagattaatttggagacaagatatgagaggtgattaaatccatttcactagtgtgcaatgagcaccctcttctctttataaattctgtaacggttgattttaacaataaaataaacttctacggttctacatctgctttcactgcaaacatctagtcatacaaaggaatattttgagccgcaatattaaaaaaatagggataaatataacaaaacacaaaattctgacatgaatataaatgtaaaataaatgattgcaaaatattaaaaaaacacatgaatgaatgtttaattgaaccgtagaaaaacacatgaatctaaaaatttcccacaagattagagctcttactaagttttcttcaaaaaatatataaaatgaaccattccatataaattctatagtatctgaaaagtttcaatcagtgaatcaaataggcacataaaaaaaagtcctatatgattttaatgctatgaaattcatgcatagaatcctttaattagcccttatacatcagtacttacaaccttgtcatcatgatgtacttcctccgtcccaaaaaaaaaacttaacctattaagggatgtaagttttttttggatggagagagtaactcgcaactctcttgccttgtggagtactccctccgtcccataatataagggattttgaatttttgcttgcaacgtttgatcactcgtcttatt

SEQ ID NO: 64655 - DNA, 6538 bp, Oryza sativa
aacgttgcaagtaaaaattcaaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaaggccttatgttttgaaaataaaataatcaaactttataacttttgtttctaaaatacgaagaccatacgtaaaattagttttgtataaattagttttaagaagtacttcaacatccataaaatcatatatctattgttatttttatttatactatagtagaaaataaaggctattgattttttatatttatactgtagtagaaaataaaaagttacagttgttcttttaaggccgtttcgttatcaaccggagggagtagcacacatccaagcccaccgaaaaacgccccacgcagaaaccgggccctataaggttattgcaggcttgcagttatgacaattgacaagaacgatcactaaatcctgggctacaagagccttcggtgtgcgctgaaaaggtcagattaacactgaagcttcgcccaggttaatcgtgctcgaagttgcacaatgacgaggtgaaaggggccaaaacttcttttcccggttcgctggttttttaagtgccggcgggcgatgggaggtggacgactgtgctgtgtgcagagtagtatagagaaaattgattagcgtacaaaattgacccattgcatagttgtacaaaatcataaaagagaacagggtcgatgttgcaggaaagatctgaaatgtaaatgaacagagatagaggaaattagtgacgaatgagacgaagacacatcatccatctttattcatagaatccacagcaacaagagagatacaaacacacacagaccaatgtatgatacaaatgaataagaaataaacacaacatgcctcactcggaaacgcacccaacccaaccactgctactagtactactctatagccggaaacgactcgaaacgagccgtgtccaaatcggagatcatcaacgaaccaattccatccatcaccacctcgcgcgcctgcctagtgcatgatcccacccgcgacgaggatggacagcacggcagagcacgccacggccagcgccgccgacgccgcgccccccgcggccgcgcccgtgaccggcgccggcgccggtggcacgcccccgtccacctgcgccgacgccaccgacgcgaacatcacggccaccgccgcggccacggcgaccaacacggcgcctctagatgccatcgcaggaatgaccgagcacggcaagcgacgcagaagcacctggcagggagagagagagagatagagagagcggtgaaacggtagcggcatgggtagtggggtatatatcgaggtggcgcgcgatgacgcgatcggaggctgccgccccgggcgcgcggggcgcttggcgccgtaggcgcgacgcgtggtgggcctctccgcgacacgttgggctcgagggtggcgcaggtggcgcgacgcgaggcggtctcggcgcgggcacgcgactccccaccccaccactcgtcgggtctgacgactgacgcccacaacccaaccgaccggaggccctctgattggcgaggccccaaccgcaacgagtcccctgcacgactcgacgaccccggctaaaaccgacaccataccattcatcagccgccatgctacgccaagcacaaacacgtattaatcccggctaaaatttacagcaatactagtcgacgaacgatacgtttgtagtactatataccacttgtaatttgcgatgactagcagtagaatggtaatttaacgtcgagtacgaggcgtgtctcccacgcttttttgctcgggggtcaagggtcgttgtcgtacatgtacacgtacgttcgtgcgccacgcagtgacacacaccacaccatgacgcacacaaaaaaaaattaaaagctgtgcacatgatgtgtagggagacgtacaagcccggctacgggcgatgcacagggccacctgccgtatcgatcgatcgatcgatcgcacggtgtctacctccaaagtcgtcgcgcgcggatgcgtacgctgacgctttactgccacgattcctctcgttggctcgtagcgcgtgcgtccgcaacgaacgttccaacgagcagccgagccgactagtaaaaaacgtagcgtagtgtgtgttggggtcaatcacggtacatgcgcccctgtcccgcagaagatgtcacgtatttttttcgcgatagagacaggaggcgatcgaccggacgtgtgaggttgtgaccgtgaaatgtgcctagcacctgcatccatttcatcggtccttccttcgcaagagctgtacgctacattggctacaaagagaagataaaaaaaaaagtgttggtacacctaaaagtccattcagtttcgtgctgagttttctgaactgggtctgaataatgcaagagccgcaaaaaagaaaaaaaaactcgaagtgtctgaactgaacgtgcggcggaagccggtcggcgccgtcgtcgaatcgatcgatcggtcgcacggcggaagttgccagggcgaaagggagggctcagctgcaggtagagagcacgtccgtctcagtagtcggctcgcgattctcagcttgtggccgtggatgcgctccatcgattcgatcttgtaacacgatggcatgtctcgatcgacaatactggaacgatctttaggggatttttatcactcgggtatatatgcatatcatcgccaagccggccggtagatcaggagttagtaattggacttaagacattctgaatctgttctgtccctcgttttgccgtgatcgccagcgtcgatggatgggtcgttgatttttgcgtacacttgtcggtagcacaagacttcagccgaggtaaacagttaagatcgtctacagaattacagataacttgtcgccattgcaagttagcttgaaaagtagttgattcgtacaaatacacaccaaaccagcaagacgacagtgcgaataaccaggacaatacacgagtttctggtactgcccttgttacacgaaaaatattatttctggtagtgtacttataatgtttcactatatatagatctaatgttgcaatgaattaaaatattattttttaacaaatcacccatatattttggaaaccctctattaagataatttggtttattttttgttccacaaaaaatgtttcacctagtgtactcacaatatttctctatgtataaatctaatattgcagtaaactaaaatattctattgcaacaaaaaaaaaactcacatattttggaaactccctattaagagaattcgtttcattttttgttccaccaaaaaatgtttcacctagtgtacttataatgtttcactatatatggatcaaatgttgcagtgaactgaaacattctttagctatttgctgaaacattgttttatataaggtgaaacaatacccgatttaagcaagtgaaacattttcgatctacttagtgaaacaattccgatatacctggtggaatatcgtgcaatatttaaaaataattcaataataagctaatttttttcatcggaatatatccatgtgtagtcttattttgaagatttaattgcaacaaatttaatggtgtaatcggatcatgatttggataagtaatttaagagaaaaatcaatttaaaatagttttacacgtaaatcggataatgacgttagcaccgattttaacctcctcccatcatgcgcccgagccggagtcacgtcctactcctacttcagtgtgattgtgtgaaccaaatacgttgtataacggagaagaggcaacataactgaaccggagacaacgtctactatattgatactaaccagaaagttaaggtttatactgtccataaaaatttacttaccggactatactactcattctaaatactttagcatatattaagttttttttaaaaaaaaactataatactaatgatagtatattgttaggagggtacaaggacacatacaaaggtttctatttgctatctctcagttaccagcaaaacaaaatcgttgacgtggaaaagagaggagaggagatagatgtagttgttttccatgacatcggccaaacaacaactttggcgagcaaaaacaacgaaaaatcaagtgttctacatcgtggtatttaacaagaggcggccttggatcccatgggtgattggatttttggcaaggaatggattggtgtcgcataaaatcgacatcgatgcaagctaccatttaggagttgcacatatttggggaaagagggaggagtaaatccactatttatttatttatttatttattggggggagagggatttgaatggaaggtgatagatgagtgataagtattttgagagacactttaaatgagaaaatgggcatttggtcacgttccaaaaatggtttcgatggaatgccatcccgaaaacacgtttcgctaaaatgccaatatggagcgcgtgatcacagccactttgttattttctccatttttgtcattttcaattccattttcgttggaatatggcttgatgagaccaaattgccccctgctcaccgagaccagcggtcctttcctctaggtcatccacccaggcctcgtcgccggcggcggcggcgaccacgccgtcctcaatgcgcaggagcaggtcttgctccatgtcgtccaacctcttgacatcgtccatgtcctcgacgagcaggagtaggtgctccggcaccgcgttttcaagagtctggacctccttgacgccgcgttcctctccagcctctacggagacgcgaccgggagcgtgtcggtcctcgtccccaccacggccagcctcatggaggcgctggggagcgcgtccagcaggcgcatgcgtactctgccttatctcggacatcatcggcctacgcgagccgccgctcgtgccggattccttgctgggctagaggcgactgggtggatcaccgtgcgcgcgccggcatacgtcacgtgctgggcagggccgcgctacacggaggcgttggtggcctccccggacgccgccgcgctcgacaccgttgtgttcacctccaccgccgaggtggaagtcctgctcagggggctagacgctgcgtggttcttgacgctctcgcctcgatgaggagctccgccgcgagcaagtcgccgctcatgtcgatcccctttcagccggtgagcggcaatttggtctcatcaagctgcattccagcaaaaaaaatggaattgaaaatgaccaaaaaggagaaaatggcaaagtggttgtggtcaggcgttccatgttggcattttagcgaaacgcgttttcggaatggcattccaacgaaaccgttttttgaacgtggccaaatgtccatttttctcattttaaatactagaaaaataactatttttaagaggaaggtactccatccgtttcacaatgtaagtcattctagcatttcccacattcatattaatgttaatgaatctagacatatatatctatttagattcattaatattaatatgaatatgaaaaatattagaatgacttacattttggaaaggagcaagtagtacataactaatacaagattagtagattacacctcaatttgctagtttgctcacgagaggtcctgtcttcccgactgaactgtgaactcccagcacttcgaaattaacaatagacttgatttcaaatctgaacaaacgatgattagtgaccgggaggcagctgttggccgctgtcccggtgtcccctacattcattcacgcgcggccgtgcggcaccatgaatgcatgagaccatatgggcggagagtcgggttgatcgagctccgccccagggatcctcgcggatgattgatgattcttccaccgccgccgaagggtcacaggactcacaggtgctgtcgactgtcgtgctgatccgacggcttccagtaggattacccatacagaggaccacatgaatatgaattcgtgcaaacgaatccctaattcgaatcgctatcaatcgtacgcaaatagaacccctaggatcgggtaattcggtacaagcgggagcggtcctaacttatgcatttaaatctccgatatttatgcaaatcagtctcttccataccgattcgtcgcccttcttagacagaccctaacgtttcggtcggcagcatctcgccgccacgcatggatcgagctgcttcaacctgactgtggcggtgtgccccgccgatcgaccaataaccgcaaccattacctttctgtgttaaaataatctacaactaaattagatataacttgatactacgaaccataccgatattcg

SEQ ID NO: 64656 - DNA, 2082 bp, Oryza sativa
  unsure (1)..(2082): unsure at all n locations
aaaaagttgaacaaagttgttaaagatctttttgccagcttcaagccttcaaacatggggtttgctacagtgtaaatatcacttttaaatcctaaagactaaagaggatcacatgaagtggaccgatgaattttcaaacacnnnnnnnnnnnnnnnnnnnnaccagccttttaacacttcatttctctaatctaataaaaatctccgcaacacctcctgataacgaacgaactcgctatcgcttttagtttgagtaggggccggaaaacacaaaggaaacggtgaatagtgcactgcaaatcacgcccaaattgcccaagttattggtcgccgaagactcggccaagtgaatgactcgtggaaaaaatctcgttctagaacaacacatgcgcgcgttagctgcaaagcctgcaacttaatcaaccgtgaccagttcaaagttcagagatgagaggtaaaccaaaccaaagcacacacacaacgtggacgcctctggctgcacgaaacgggagagatcaccgcgcgaagccgcccgttcaccatgcacacatgcaggcacgtacgcgagcctccacatggcggccactcgcatccccgaattagccccccactaatcccgctataaattgtccccgtccccgcggctcatctccctcctcaggcaaagcgcagcagcagcagcagcagcagtagccatctcttcttcctctcgcctccgtttccgccgtcgcctgctcggttccagctgagaccgtgcgcgcgcgcgagggagcaacctcgagaggaaggggatggagatgaagaagatcgcctgcgccgtcctcgtcgtcgccgcctcggccgccaccgtggcgttcgccgccgaggccccggctcctgcgcccaccagcgccgctcccgcggccgtcgcgccggccatcggcgcggcgctcggcgccaccgtggtctcgttcttcgcctactacctgcagtgagcccagccggaggaggaagagaggaagaggaggagatggatgcatggccatggctactaaaccgatccaaacacgcgcgataatgtgggtgctttgatttgtgccaactttgatgcctcgtcttctttcttctctttttataatgggttgtatttttgatgcaccggtttgatttcggtgctttgatttctcatatttcgtccaccctatttgaagggaatggatattgtactattattcaccatttgtttggattaaattaagatattggaattactggctacgcattttcgtttgatttcaccatcattcggttacacacgttctgacgttcatcttctaggagacgcgcatcaatcatgactggcatgttaatttggcaatggcattgccgtattggcattcgtattattgcctgtatctgaataaaatcgagttcatttcgtacttcagtaattggattactgaaaggtatatataactgctaaatttcttttcagtttttccataacgcagtagattaattattgccataacactcagaaacaaacaattaagcaggaccaaatggaacagcctggaagggaatgattttcagaaggccagtgacatcaaattgcgctgtaatcatgccaatataaatcattctagttccttcgaacagaatgtaattttagtccgctttgcagttggcaaaagacttacaaattccgttaaaacatacataagggatatgtggtggcttaatatcacccgagacaactaaattccacaagtatgttcctcctctttttttttttttttgtcgaactgacagatcaaaataggccccagttcattagatcaagaaaatcacaaaaatcttactaagcattattgctagctctcctgaaacaatgcctaagtaaataaaactctgaacaaaagttgtaaagggggcacacgatctgcacaagtacagaactgagcggccaaaaataagcattggcaattcagattcaactactccagcagcggaaaggaaataaaacacaggatactctgttgccaaagacaaggagaaacatctcactacaacattgacatcagaccatcagtccactttgcc

SEQ ID NO: 64657 - DNA, 6957 bp, Oryza sativa
acaggaatgtcgcaaactcgcaactcatcaaggaaacagaagattaatctagaggatacaattcatcttgaaataatgcagagtacagattacagaagagcagacaactaaagcaaagagccacacttcatcataggcaggtgccaaggtcacccatcccccagcatgtagctggtaccttggccttgcaaggtcaagaacattataaccaataacataaggattttcccacccttgtgcaagaggaaaatgataatggtggcataggcttgatctcagcccaaggaggatacctaaactaaagatgatgtactacatggaatgctaacagtctgacataaccaaagatgaaacgagacctgaaagtttaggaactgggaagctgaaggtgatcaatgtgtatcctcctttcagccaaaatgccaatttatagtaatagaaaggcaccaataatggcaatggttatctacttgttcagaaagagctattttaactaggccaactgttaagagcttaccaattagcagataatattgccggtgaatctttgtcacatccaaaaggaaagtgacactttgtcacatccaaaaggaaagtgacaggctattccactgcaccctacagaattctatttatcagaggaaggctaacctagctgatagaggatgtctgacgcatattctgtatacagcattaccagtttgccacttagaccaaacctacaagttaagcacagtgcagcgtactgtatatatttattaataatgataaactccatgccttcatcagttttgctctacagaaatgatcagtatatatgatgccttcccatcaatagaactactactccagattatttctagtttatcatggaaatcttgtcagaaaattatcaaacttctcaggtatcaggatacctgtaaaaatctcatccaggactgtagtctgcgatatcttactttcccctagcaggatttgcaaggcctatatggccataccatttgttgaatatattgctacaaaagcatatttttatttaagggataagaatcaaacttttagattgtataaattatgcaaagctaaacctcattgtattcataaggcaagtctggacagtgggaaagttccaattatacagctcacggtttattaaaagcaacaaccttttaaaataaaaaccaaccttttaggtcatgtcaacattgctaaagactaccttcaagttagtgctgcagatagggagaacttattaaaaacttattgataattcaagttctacctacaacagtacttacaaggtctcataaagaaagtatctgcatacatttccatcactaatcaagacatcactaatcatcttgcaaagaaacaaaatcagctcagtgagggggtgattggattatatttaatcccaatactgtttgctatttggaaataggagagagattcagtatgcaagctacaaaaatagatatgacaatgtgaccaataagatgtaaaataggagaacctatctaatctttatagaaaaacagttgtccaaatagaaaacaaacaaattaatttactatcatttggacattgaataacaaaccattttaaatttacacaaatagaaacgtgtcaatacatagagcaatgctgagaatttcagtagacgaaatcacatcaattcaaagccatttattgataaattcttgtgacttttgaaaatatattgatctcttgtgaaactcaatgtaaacttcaacagctcacaaatcaacctaaaaagactcaaattactgataaaaatgagctgtgaactgaaaacataaacagacaaagagctttccaaatgcattctcacctcactaggtaccaatagctgtctagtgcaagatgataacttgacaaaacatgatggtttcaaaacacagttcagccataaacgagtcagcaggcaaatggtatctagtaaaatgtttttacaagctcactgctcaccacaggcacagcaaccatgctaagttgctaacaagtaacacagagctggtttgtcaaaaatccacaggaaataagaagatgccagaagcacttcgatacaacataaagtcactgcacttagcaacatttaaaaccttttgcggtttagctctgcaaggtattttgtaacattgctttgacttccattaacatagtggtcataggaagagtaatctctacatttgcaggtaaaagtcgagacagtaacattacgatttccttgatagtgtaagcatacacaaaaaaaaattactctagcaatgatcgacatccaaaagcacccaaatttcatagttcagactctcatgcctaccaccagtgcacttttattatccgaacaatgaaactaaccatccttcctagagagtttcaccgcatcaagatcgtagctactgacccgacagacaccccgagagcgcacgagatggcgaccacccgcgttcggagcagcatgaggttcacattcttcgtggcctggaggcacagcgtgagcacctgcagccgcccgttggcctccatcttctggaagaaggcgatgggcttgatggcgcggcgcagcaccagggcggccgtgaaggggaacgcgaacgccaccaccccctgcacggccgcggccgaccccacgccgacgggcgccgcgcccgatgcgatccacgcgcccgcggcgaggtgcgccccgccgaggagcgcgagggagccgctgatccgctgcacggcggcgcggagcgcgtcgagctccctccgcgtctcgtccgcgagcggcgaggtgtcgcgctccaccgtgggcccctcgatctcctggtgcttcatcgactccggggacaccggagcggggccgccgccgccatcgggttgcgagggagcggagaagtggcggtgcgggtggaggaagaggaggggatgcggcttagggagaagcctggccgtctcggcggcggggctcaggaggcggcgggagaggtgggagatcgccatgggagagcaactctgctgcggagtgtgcggcggcgcaagagaagtcgtctcctcctccggtcaagccgaaggcgtaatcctataatccgctttccacataatgtcacggtctccaatctttccgttttccaggaccggaagcgggttaacataggatcctgcggctggacacgtggcggagcaagggaaaaacgctagggagacgggggacggagcacatgccggccacaccgttcagcggctgccgcctggttcggatttgccttcctttccaaaccagagagcggtttacagaaaaccgcctttctcttcttccgtcttcttccctttccatttctcccttttcctacctcgcctcgccgcccgcaccgagcaaactcaaaccctcgccgcaagaaagaaaaacaaatcgagagaaaaaaccctcgctgctcgccgccccaagcgaagccagccatggtggtgtacacgcaggagcacgtgtaccggcacccgtgggaccgcgtcacggcggcggcgtggcggaagttcaccgacccggcgtcgcgcacggcgctctcccacgtcgccgacgtccacaccctccaccgccgcgtcgacccggaggcggggcggctgcaggctgcgcgctccatcacggtgcgctccccgccgctccccttcatcctccgccgcctcctccccgccgcggcgtcgtccccgtccggcgcggcgctctgccactgcgtcgagacctcgctcgtcgacgcgccgcgccgcgccatggacgtcgtcgtccgcaacgtctccctccgcggcctcatcgaggtcgaggagcggtccacctaccggccgcacccggagcggcccgaggagtggacgcagttcaggcaggagaccacgatccggtgccgaccgctctcggccctcgccgccgtcgcggagaaggtcgagacccgctgcgccgagagattcctgcagaacagcgccaaggggagggaggtcgtcgagcggatctgccggtatctcgaggccgaggccgccggtgctgcatcctccgccatctgagttggcctggtttgcgcctcctcacttggccttccttgatctgatcggatcgaaggattcgctcgatctgtgctgcgtgcgcgcggcgggacctcgcctcttggccaggtcccttgcagttttccatttttttttatgaaatgatgagctgaatcctgaatggaataaagcttctggacatatacttaatttcttcttgaccgtggaaccatgttaaccccaatttgtgcctgttcttgttaagcatattcagatatgctatgacatttctagttgttattgtgctgatttgacgaattcgttaactctgatctctgatgttttcatggatttacgaatgtgttaattcttgaggggacaatttgattcacatataggatactgaagttcgtatgttctatcatttttgtttgctgataagaaaaccaactgggtgctgtgggaatgtgttaactggtagatactggattagctttcttcttggacaattcttgcaagcgtaggttgattggtactttgtgactgttgttgtctaattggctcctctatttgactattcctcctctattatgatgttgattccaggaaaattataatcttgtgcattggtcacattttctgttgtttaatctattgatggataagtagctgcattgactcatttttgctctaccacttgagactgattgagttaagaaatgaggtgagctaataaccgtacctctaacgtgtttggtgataacaataattgtactgttgtttcagccttctttgttgatgtcctgagcaagttactgtatctaggttgataagctgtactgcctgagttagttctatcttattggcttctgagaaagtttcttctttacctggatgtttgagttttataagtgattggctggggaattaacatttagtttattagttattataacattttcagagggaacacattggaaatatatagatcaatacaagttcggattcacagtttgaaacccatgtcatgtgttaggattgctgccatcttgtgctcataggtatctacatcttatcctacggatccagctttcttcagagttttgttccattttgcttgatttgagacatgcttgaaatgtttatttcaacatcttcccgacatagttttgtatggaataatgaggcgatgggccactgctagttcagaattactagctttcatttgttcctcttcagcatttttctttactctggtacaggcataagccctctcacaagacaccattcttcctcttggcttcattgttactgtgttgttgctcatcagttatcaccatatttgactgtattatgtgttgtttgaactgtgatatgagatctaaactgttttccagtattgtttttcttctgtattccagtgttgtttggtagttccatgattgtttgtcattaaatctatgaagaattaattattttgttgtttataaacaaaaagaatccagtgaaaattgctggtgtttgttttgtttgaaagttttaatgtatatagttttcagcacaacctgtttcaatactcctgaagtcctgagaaccgaaacatattctgcagaaatgctgatgaaaaacagtgaagtttatgaatgctgatatttttgtactcccccaatggcatcagctactagcctacgagcagcctctgctgcaaattcttgtagacctcagtgcatcggcctctgttgcaaaataacacctacgagaattggtgctgcagctgcatgtatatctgtgttggactgttggttgggtccagctctctaagcgtcacaattctgaatttcggatggttgtgttgcacaggagttgctgcgtttactgaattgctcttacgccctagaacttcaaggtgaaaagttttggcgtgtcacatcggatatacggatacacatttgaagtattaaacttggccttgaaactctagatgtgaaaagttttgttacacacatttgaagtattagacgtagtctaataacaaaataaattacaaaatccgtctgtaaaccgcgagacgaatttattaagcctaattaatccgttattaccaaatgtttactatagcacgacattatcgaatcatggcgcaattaggcttaaaagatccgtctcgcaatttgcacgcaatttatgtaattagtttttttatctatatttaatactccatacatatgtccaaacattcaatatgacagggtaaaaagtttttgtgtgggaactaacatggcctcagtcgtgttctctgcaaaatgaacagttacttgtgttctctccaatctgaacaccaatccaagcaaagctcgtctcaactcgagccttcacaaaatcagaaacaagctgcaaagttcgaaatataagaataaaatggaaaaagggaaatcaccatctaaacgggcttcttctagttaaatgggccgtttttattctggtacagttaggcccagtacgcgagcggagccctaactccgcgccgctataaaagcgtgaccccgtcgcgtgcgactagggtttatctcctctcgccgcagcctccctcggagccagacaaaggagagaagcgcgaaggcggcggcggcggcggcgcaaggcgaagatgtcggagaagaagcgcggcgccggcacccgcaaggacgaggtggtgacccgcgagtacaccatcaacctccacaagcgtctccacggatggtatcgcctcactctctcgctccctccctccctctcctccatttccctgagctttgttgcgcttgcagtagatccacgagctagatgttggtttcacgaggtgttagggatctagcgctttgctggtgcggagggttgctgcctgcgagcactttgtgggctcgtgaatggctatacacgggggatcca

SEQ ID NO: 64658 - DNA, 2654 bp, Oryza sativa
tcatcgttacacgtgctgcctttatatgctatcatgtgttccatttgggcaaaacattggaaacaagattacattatgaaaacactgttatgtatagttattggcagtgtgtattatagcagttcatctgttaatctgttatgtttgccctgtcattggttctgctaatcaattctggtcattcatcttatgtggttcatactttttagcactgcataactaattgttgttgcacatattttctttataaagcagccaacttcacagttcatattacatttgaccttttagataaatgcagattcttgtttagaagttttgcaatcttgaaaagtcttgatttgttgaaataaacgttataatgaaataattctttctgataaacagcaccttcaagaagaaggcgccgaatgccatcaaggagatcaggaagtttgcacagaaggccatgggcacaacggatatacgcatcgacgtgaagcttaacaaggccatctggaccaatggtatccggagtgtcccaaggcgagtccgtgttagaatctctcgcaagagaaacgatgaggaggacgccaaggaggagctctactctctggtcacagttgctgagatccctgcagagggtctcaagggtttgggaaccaaggttgttgaggatgaggagtaaacttttcattgttatctgtcagttagcgcttagtgcatatttccatgattccagtcactatgctgagagcaaatttggaagtcttgctttagcgttttgttatctactgttgatgattcaagactgcattttcttaagcgcttggaattttgacatgtttgtcaaccttttgggatatatactccatgctatcgtgctgtgaacaaggatcactcttaagcttaaaaaaatgtctgttagatgctggtattgattttttgcttgaatttgctcacatccttttctgctaccatcggcttcattggttcacatcatttgttgagaggatagtttgttgtgaaggtcgtaacggttcagctattgtaatgcgtccgccatccagtgatctgatttgctgagttctattcgtgcgtatgctatttttcttgacggtaagggttcagctatgctaatgcgtccgccatccagagatctgatttgctgagtttctatgcgtacgtgtgctatttttcttgacggtgagtgaaccgtcgagacgggccaccaagttccttgtcgcgcctataatgttagggcgcctcacttttaacggagaatatatgaaggaacttcatgaaaaactcatctaagcaaaagtaggaacatgttattgtaatttcattctcaaagcttagcttcttttgaaataaattatatagctccaagggcagttctcaatggtacaagctgttgtgcccggctaaaaaatacaagttgttgtcaaaaaaatcaaagtgcatcctaagacatgatccccgtcggcaggaagaaaattctggacggatatgtggtgtaccagattttgcggcaggaagaaaattctggacggatatgtggtgtaccagattttgctatgctcattagcagcaacttacctgcgacaataggaggaactatgagatctcagagttacacttcagatagtgagatcaaacaccgagtaataaattatgggtagggcataaaatgaataacagatcagagctttccaaatttgaataaataaagggtaacatggaagtatatgttgtgatagcactgttcaaaatgaaacattggagaaagcagatttgacccttattgcaactctgttaagacattttttttcccaaaacagaccagaagaacttggtgtaaattagcaataatgcatggtaatgatagaccgcatactacatttcacagacaatggcacttggaaggcaaaccaacagattccataaaatgaaatttaagtatggtagacattcacagcatgtaacaaaaaaaaatctcacggccctttgtgtatatataacatggaattcaatcaccttctacgtatgtggaatgctaaaataatgacgttaaaatttctgacaaatttaagatgtgattcagactaaagtagagaacagcaattgcctagctagctcccaaggctgttacatgaaaataaaagggatttcctaaaactatatctatcagtcccaaatcatgccagtgatcaaagtatcttgaaactaatggtcataaactaatgcaatcatgctgtcttcaaagaatactactgtaggagtaaaactgataattatcctgcagttttgcaagtattgctattaccctagaaatatcagacaataaaggaatgaacttcatcagatatacaaatcttagggtaatgcatttgaatatttacattgtgagtcaactggatgaattgttagagcaaaaacacatggaagtatttatcagcaaattactgtacgctgtggagagcattgttgtcgttttcttaatatttggaacagtgttaagtgttaattatagcatatcaacgtaggcaaaacaactaggtgtgttactaagcatgggtctgcatcttattagacgcctagacggttagctcatctggtacgaatgtagtagaagggctcagtcatcacagtaaatcattgatcctaccaaa

SEQ ID NO: 64659 - DNA, 5360 bp, Oryza sativa
acgcgcgtagctcgggcgtgcagtcgaggatgaccttgtagcatccggcctccttggcgatctccacgaggcgacgcacgacgcggagcccgagcccgcggccgcgcgcggcggcgtcgaccacgacgtcctccacgtgccccaccttcccgccgccgcgcaggaacttgcgctccacgaagaggcaccccgtggcgaggatccgactctccggggcggcggggtcctcggccacgaggatgacgtggtcgtcgccgagggccgcgaggtcggcgaagcacgcggcgaactcggacgcggtgaggtccgggcaggcggagagctgcgagaggagggccacgaatcccttctcgtggtctgtcgcctccaggcgacggatttggacggaacagccggtctccgcgacggcggcggcggtggagggttccggcgaggtggatgccatttgagatcgggagcttcttgggctttggccttcgcaactcacaagtgacagtccgtactagaacgggccatgcgggctggtggattccactgaaacaaacttgctagttctaacatgttcacacaatattcagggcccaattgaatcacatgaataaaaaaacagaataatagggaaaattagaattttggcatgaatacaagtttaaggattaaggacccctttcaaacatatgattgaaaaaaataaatgaatagaaaaaaaatagaggaatatgataagaattcacgtgtaaaatagaggaatataaaatcatagaaaatgtatatgaatatgtgtttgaatggggtataaaaaaacacaagaatatttttacttaagaacttggcccactttccatttctaataactaacacaaattatatccattaattgcttgttctcctgcagtgaagaaagagattaggagcttgattgcctcgagcctacgcaaagcaagtgaaaaatgagctcagactggatggaaagtttcatgtgtttctcccatagaatcagcaatgaaggaatatttccttcagttttcctatgacctattcctacaaatcaaaggctgctacagtgaatgaatccataggaactcacatcttctgtttttccttcgttgctcctttgtttcaaaagagctctaaaacagatgattgtaaaatacaggaaaacgtaggaataaccgttttattaggccgcaagaaaaacaccagaatttgagaagagataaaagactcaaaggatttttttttccatgagattctacctcatgataaaaatgtcctctaaaatttgcatgggaataggcatttcataggaattttataggattttataggattcattcctttgatttaaaaggctatataggaaaaattcctgtaggaatgaaatcctctaaaattcctatgaatttcctttgaatcaaggggggtctcatactttttcacagctgtggctttctctcaggattagaatcttctacaaatggtttagatttacgcttgtattttaagaagctgtagttatagaatacaggaaatgaactataactacgaaatgaaaaacctaactttttaagatttttataggctagctaccaataagttatttcttgaatcctaagttttctaaataggacaaaccattactccccttgatacaatgtttggtcgggttaatatttagatctctgtgaaagattacgatttagattagcgttgtaactttttgtttttcgccgggccgcgttgtaactttgataagtgcagaaaacatttacttctgcagactgataagtcataataccttgtgccatgagcccatgatatacgattatatgtggaattccagtaaaagagtccaagttaatttctagaatggttaaatgatttgttacagtagcttgaaaagaagatacaggtcaaaagattttgcatgttcaaggaaaaagggggtgaaatgatctagatattgcatacccctccgtagttggctacatcacatgtcccattcgttcattcagtcaactgaaaataaagttaggattatacgagacatacacctactccaatacaacaaaataccgaagactaattaatacatggtcctccacaataattagcagcatttctcttaacctctgcttgatgcaactgtggtgcacttttagttcgttcaacggagcattattattggtcaatagtgaatggatcgatatgcgaaacttgaacggcaatttacatcgtttctggatatgttttctagcttgtacgaagtggtcactggacaaatttacaactatctgcatgtttcattttcatgacatcaaactgatttccgtttccctaaaccatatattcatatcactactcactgattacagattagagaggttaataattgtatattcctattcgcccccagacgacgttactgcatgacagcacgctacaaccattttcttttcgtctgttcggcagtgacgtcaacgaatccacgtggacctgtaaatgaaccattttgattctgaactgttctgagaagaagattagattcaatactgcgatatcccaatgagaacgtcagccatgatagtgaggacttgacgaatgggaatctctgaacacaaagtgcatcgcccaagtctaaactggaatatacaagtcaatagaagatggttggcaatggagaacagaaacttttcctagagctgctgggatatactatacaaaccatgaacatatcagatgccatgaacatgaaagggtatctctattatcatgtaatagggtggtactattgtattcactaattagctcggctagctgctgaagattcggtttgtgtttttgttgataaacatgttataaatgcatgcgctctcaaggcgcggaatagtgaatacacaccttattcttgtaagtatttttaaaagattacacttatcactaaattaaagttataaatatgagcatatatatttagtttaccgaataaactgttttcatcgtcaaaaacctaaccagttaagctacgagtctactcccacttcgtctgcttgtgttttggtagagaaacgggggttcagaaacggtttcgagatgacgaggtccgaagaagcggcgggaatccggaactggacggcggtgatccctccctatcagcggccccacgcccgcgcgcgtgctgtctcgctcgacgcattccaagtcggcgatttccccaatttttccaagtccaccccaccaccgagagcctgcccctctcgctctcgctcgctcgcctcggctcggccccgtgccacccgctgccgataacgtgacccacgccttttcacaaccacccccgcgacgcggatcggacggctcagatgcagcgccacgacgatcgtgcggcgcgatgcgcaccgagtgagagagcaggagacggcagcgcctttaataccgtcgtcaccgatcggcttccgtttttgctcgcacacgctgcgcagcggcaaagtcgcgggaatcttcgtgggctgctccgagcggcgacggcgacggggcggcggtatctcgcgcgggggtcaacacagctagatctccctctctctgcgtgtatagaagggcggttgctggtgggaggaggaggaggaggttgagagaggtatgcccatggagcacgggaggaggcagggggtggtggcgatagagtgcgtggcgggcgggtcgagggcggaggagtgggggcccgggagcagcgagacggtgcagacgggcgacgtggtggaggagatcctcatcggggtcggcggacgcgggggccccgcggcgcacgccgcgccgttcaagggcgggcgcgccgccgtgcagaggctcctccactcggcgtacaagcgcggggacacgtccgtcgaggtgcgcgtgcggcggcccgcgcacgcgcagcagctggtgaccaccagcggggagctgctgccctcccccgcggcgggggcggcgacgaccacgacggcgaggatgcaggcctgcatcgtgccgcaggaggccgcggtcgggggcggcggcgcgatgatggccgtcgtgggccgcagccgccagtacgtgctccgctcgatccgtgacccaaactacgccgtcggcttcgtcgaccgcatggagagcgagtgcatcgccattcgaggtacgttcatacgccatgtcgttcctcctcatcacgatgcaaactactacggagaattagattttttttttcgctgaattttttgatccatgtccgtccgtacagccactttccttcggtttgtgcaagctctagaccaaccaagaaaagtaaaagtccgcgactgagctttcgttacatgccatgttggactttaattaaaaacagacaaagaaggaggatagggctcgtgtgccttctgcatacgacttttgtgcacaagttaacaagtagatggtggtagcttgataggtgacaccttctttatcgttctctctctcgcgagaggagatctttttggcgtgatcgatcacggtatcgttttcgattggcatatacttggatcaatgctgattgataatcagaaatttgccatcttgtggttgcaatacatggtgtgattgctcagtctggggatatgatcagaatatcctaggtttgatgtatgacagagtcaggattgcaagagctggtgataacattgttgttggtgttggggggtggagggcagctggtttgtctgggaaatttgaagtttctagagtagcttggcttgcacaaattaataatatggccatccattagtccaggttttttgaacgaattccattaggttattcatggctacaatgtttgtttgattgtttgttgaacaaaggctttactagaacactactctatttaacgatcctaattgcttcttccgtgtgcaagctgcgaaagtcacggttgaacacttttgagctatcatggaagaatccacagtagcctatggcagattactggtactgcaaaccacgcaactacagcaataacaaaatcataagatagctcggagaaaaaaaaatcataagataagatatttattaagcgagttaaaaacctgggtagtttgcatttgatgggtgttctgcttccacaagtaaaacaaacacgtcagtttcagataagaaaaacaccaagttgctgtagtctaagctcaagttgcatacttccaggcaacagacacggcggtgcacgttgtttggaatctgcattttgatttctttatacagaacgccacttggcggtgatgataattgaatcttccctcccctgactcggaaaaaacttgtcgctaaattccaatgcgattcagatctccctggtgactttactcctcagtcat

SEQ ID NO: 64660 - DNA, 4953 bp, Oryza sativa
gcgcagctgcaggacggctacgtggcctacccgtgggagaagaagatgagggaggcgctcccgatccctaactccagcagcttcctctccatgctcgtcctccccacggcgctcgaccgcgccgcctcccgctacaactccgtcgaggacaccctcgcccgcgccaacgcctggatcctctcctcgcagtcgtccggtgtgcccatctccttcctcaacgtccagaccgaggccctcctcaccaaggttcctcaacagcgatcaaacttgcctagagtaaatgttttagtagctagtaggtgttgtgcgtgacatgcatatcttgcatggtggtgcagatctccggcgagacggcctccgcgacggtcaactcggggtcactggccgacctcccgaacctcgccaacgccagcctttacgggttcgaggactaccacggcgtggacatcggcgtggtgaaggcggtgcgcgtctggtacaccgccgccgccggtgagatgccagtggagatcaccctcgaggccggcgacaccaagctcggcttcgccattagccgcaccgaggaggtagtacacctttaccgtcatgccattcattgcatcttgttaactcgtccttgatcctgctcgtgtgattcgtgtctgatcaattgtgtggatcactcgcgaacgaacagggattcatctacatctcgtccgtcatggaggacgacagcggcttcctggcgccgtcgacgaggtcggggctgcgcgacctctaccgggaggcgaagcgcgcgtcgaagctgctggtgatctccagggtgtccgggcaaaaggtcctcccgtggatggtgtccacgtcgggcgccatccggtgcttcgacaccgtctcgctcagccagaagctgtcgctgcaccggcacgccctgcgcccgatcctgctccacctgctcatgtgggaaggcaagtcggccgacgcgccggctcgcccgcacgagccccgcctgccgcctcagccggcgccgtacccggagttcgccgccggccttgtgcggcaggactcgttcggcggcggcgagctgccacggcaggactcgttcgccataggcgagctgcggcggcagggctcgtatggcgtcgagctggtgcggcaggactcgttcggcgtcgagctggtgaggcaggactcgttcgcgtgcaccgagccgccgccggtgcggagaggagacctgcaggggagggacacggcaggggatacatccttcaggttccataatttctcgttgcccaacaactgggtgtgaatgtgcgattgaaattgaacaccaagggacaagtctcactggttgctgtacatatgtatacttcgatggggtggctttgtgctcatacagactgtggagtgcattgtagtgtgatggagcttacatagagtataattttggccggtgaatagtcttgctgtttcagcgatacttagttcgaacactgttgattgtgttgggaggagaataacagtttcatgtttgatttcaagtatgaaattcattgccatggattgcaaagcccatatctttcaaacacctcgtttggaagttcaacgatactacgtatatactttatttgcacgattactaataccaatttggcacattcaatagagacaacctatcttcattcaaatattccatttggaagttcttttcttcccaaatgcactggagaattgtgcttcatttcactaagaagaaatatttacaattacaaagaagggattcctttgatcaaagaatccctcctactaagaacacatcccaaaacggatcacccacaggtgaggcccgtccaacaccccgttcggaagttaaagagtaaatattttatttgcacaattgataccagtttagtacatttgaagagagacaatctatcttaacaagaggtttgaagcatggacatgtacgggctgtgcagggaacaacccaacagtttcagcatgtgagcctccagcaatgaagatacatatcagcctggactgttgttccgtttgctgatcatatgaattgtaaggttaacgagaaatctgcataacgtctagaatccattctttcctttcagattgattactgatagttcctgttcgacgtagtcgccagcacagattggtggataactatgagcatcggatgcttcagcaaagtggcccaatggcttaagggttgcatcagaagcaatgtgtgcaaacagctatttacataaataggcaaatgggtaagtcaatagttcaccagagcaagtaagattaaattgatggaagtgcctcatgaagtaaatcacatcgagaaggagtggttagcacttacggttgatgaaaccctccacaagcttctattttgctctcttgctaatgctattgcctctagtgttctcttggttaccactacctcatgcattccagctaaacactccccaccagtaagccattccagctgcagttaaagaacataaagtaattcaattggcgagatgctttacttgcttgtgtgttggttcatcacatccaagttgtcagaaataagccccatctttcactagcttacactcccagttttctagtgtttgtgtttcagaaaaggctcaaaatacaaatacaaagtttgattctatgattgacaacagtatcaatttcatggaaaaccagaatttagagatcagaacagaaaccaatatgcatacatatgaccttctattgatgcgcgaatatgaactaattaagatacttgcagtaaaactggcaaagctaacctgtttccctgattgaattagaagacagccaacagggaccttaacttccatctttttgccgttccttagccagatgttcaggcctggaaatctacttcgaccatgtatggtcaggaaattgagatcataatggaacccagcaaaaacagtgccctcagaaccatgccgctcaaggtcacttccagttggtgctaggaggtgtggtccctatgaaaaacacacaaataatcgaccaatgtcaacaggatgaatgcagaatggatctgaataatgcattaaaatgcagcgttcattacataattacaaaaaaaaaaacaactcaatttctgtgaaccaacagaaatatttttagctaagtaaacataatgctgggacctggtactgtttacttgcatcctgagtagattaacaaattacagcaggatattacagattgttacagcattacctccttcatcaaagaggtaaatgcatcctttggcaatccaaatccaactgcagccatctcagcaacaacctatgaaatgacacggccgcttgtatataatacagcaacaaaaaacagaaattaaatgtagagcatgatctacctcaattgcagaaatcattttagaaccccaggaatccatggtctctttccattcaggcaatccatcagggataacaggttccgaattcagctcctaaaccaggtttctcacaagtcagtatagaacatagcgaacgaccacacacaatatgcatatcatttcagatatccacaccaaattaaaaggatcaagcaaacagtctcaaccttaaaacgggtattcgctgggcgaggacccactctccacatataccgccatttcgggtctggacccttaggagtggcgggctgaaactcctcaggcatactcttgatcttgtcttgcatctccttgtcgacaagactgcgaggtacctccacgccttcaggtgtcacaccaaccttaacatttgaaacggaaataaagccagcattacaatagggacagacacgatgttttgtgcctgaattctcatggcgatttcacaatgcagagaagatggtctaacaagtagggtacttttagtgatcctgcctaataaggaccaaatttaacccaaaccctcgcctttgatcccaccagattacctgatagtggaggttggggcgctcctggaggcacttggagtcggcggatcgggcgaagtagtgctcgacgacgtcgaggaagcggtcgttgtcggcggcggggcagcgcgggtccttcaccagcagcgcccccgtgtcccgcaggctggcgctcaccgtcgcgcacagcgcgcgcaccgcctcctcccccgccgcgccgcccccggcgacggcgcggtcgaggtacggcgcgaggtccaccagggggaggtccatcggcggctgctgctgctgcgcgcgcggagagagagaggccgaatcagtcgttcgcgacaggattggaatgggggaatcggcggttttaagtagtgcgagggggacaagtgggaacacagctagcgagcgagacaggagggacgatgcgtgaagcgagcgagcagtaatccgcgagagggagagacggaaacgcaaaccggggggcgcgcctggataaaaatattctcccagccccccgcggttcagccacgtcgctgacacgagcagtcgcaaaagagaaatcggttcgttgtttttcgggggattttagcggaagacgaggacgagccgcacgccgcagaccagcagcagtcggcctcacctgcccccctccccaacgccggcaagacggcaagcgcacggatcgcgccaatcacccgccctcgccggcggttcgtgcgcaggtcgaccgacgaagaagcgaggggaagaggggaagggaatccgggattaggatttaggaccactggactctggtgtaggcgtgtacagactgatatacgcttgagttgggctgttttcgttttctcggctcattcctcaacgcggctagacggaagaaacaaatgaaaagaaagtctgtcgttcgtccctcgattatagttcgagtatgttcctccttcaaactgaggaaaaaatagttacgcgaataagataaaataacacctatccttaaaaaaaaaagataaaataacaccttgtttatacatatgaaag

SEQ ID NO: 64661 - DNA, 2197 bp, Oryza sativa
cgcctatccctagaaaatgagtccgaacacaaaatgcatgtcttttgatgaatgatatttctttatctagaattgtcctgtcttgctacaggcttttggtcggtttatatagtccgtaaccgtacatgtgagattacaatcttgtccccattgggcccttgtgagtttacaattatacccttgccatgtcagcaactttagagatattttggtacatttgggatgtcattatagtcttttggtgccagctagccggagtggttgagagtggtcccatggaatcttctcttggcatctttattgctcgagtagtatttttcatctcgggtagtcttttccacctagaatattcaaccactcttttccacttgcttagtccttgatattttacctgtcactagttagaaatgcactcaaaagatattatttagcttagtaacataaacttgtttgaatagtactttccaactcgaatagcattttaccatttcgccacttgaatggtattttgccattactctactcaaatataatttatcattttgccgctttagatggtattttaccatccgaacacttagaaaaactcaagaccttctctatagtgttttggccgaatacgaaaggatggtggtggccccatgctacaacaatgtgagagggaaggacaggatgcgcaggtgtgggtatagcgttgcggttgagggaggtgatgcgcccattgagggacacctaggtgttggttgcggagaaacgcggcctcacgtgtcaaaagagagggagagtcttgcaccgcgagggataccatgatatagttgctcttataaaaagtcttatcatatgctgacaggtagggtccactataggcccctagttgcctctattggatcttgcttctcacgaggcgagtctgcctcagtcatatgccctttgcgtcgacttaggtacggacgctaatgacttgagtcgtatgccctttgcatcgacttgggtacggacgctgatgacgtctactggtcccacctatcggctttagagagatgtgtgtgtcgggttgtggtgggcccaaccaagcgatatgatagtcaaccacattatctgacagcccacgttctcaactttctaggggtaattatggccagttctatagttagcatgtcgcctctcatacgcaaaagatggattggtatccctcgcattaaaagcgagggcagttgcgcgacgtgaagcattgaaggttcgcaccccatcgtatttatggcatagtaggggcccaagcagccacatggctcgggactcacctggtttaaaacaagaaaccaagttcccggtcccacctttcgctgtcgtggcccgatcccacatggcatggttagaaaatccttagagtcctagatagccagtagtggggacctaggtccccactttttcatatatggtacctataaaataacttagaaaaaaatacccgtgcattgcaacgggtgaaggctattttcatcttattattgttcaccgtgaaattcattgtgagaatttgcttagatatatatttttctagaaaatcatgtcaagttagcatgcgagtcttttttaaaaagatttcttatacgactccttttgcatttccaaaagcgaacgaacttaaagcccgactcgaatacggatatgtatttgcaaaagcgaatgaacttaaaaacgactcatacacgaatgacataccaaagtactggcaaaaatatcttcaatttttagaatagtagagattctcttgtctatcattttgtgccgtagacgctttttttttaaagtgtcatggacactattttgatccccaatattattttacttgtttattttcttattgtaccgatttctttaccttttctcatgtagggaaacatagtttgaggctccatttcaaaataactttctagagcttttataatatcctctatctaattagaccaaattttgcaagagatctcacttctaaaagtttgaagaaaagatgctttgcttcaagaaacaaccaatcaagcacaaaaccttagtttgatgccaagcaagatatgcttcttcacttgggtgaaggtaagaaattttgttctttaacactaaataacatcacagaggatatagatggaatccggaaaatacttgatcctattgtgcatatccataacgggacaccctt

SEQ ID NO: 64662 - DNA, 3464 bp, Oryza sativa
caagaataaaaagaaaaaaaatacatgcttttagcaatacatccacatgtaggaattagtgatgatagatagatatatcatatatgtagaatctacgaaacaaatagtaaagattgattagtataatatattcgaggttgataagataagataaatatcaacgatctatccattttctgatgatggccacttcttgcttgcttggtgacttgctgctgcaccctccaccctgcgtccaccctatgttgcacgcctcctagcttgccactgtcaccgcctcccatgccatgtcgtcgcgccatcgctcgacgtggatgccacagctctgtgtggttgcacccaggagcctagcagccacacttctcccgaccaacatggttcttcctgccttctcgctagcgacgcgttgcctccgccctctaggctccgaagacttgcagcagccaccaaggcgccgatggggatggagatcgggggaatcgatggaggtggagaatggggaaatttgcctctagattcaatagttaaaagccatgtttacacaaaaacacctgctagcaaatgatgcatgtgcggatatgactcgttcgtttgatgatgcttcactgcgctttgtctatctcggtggtgccttgtctctgcccagagcccggagctgggggtagcgggcaatgaggtatggcgagcgccacatctcgccctaccgagtcctccatcactgatcatggaccaacttagtaaaacgttcgattggactgaaggtaaggagattctatttatgagtgaaatgtcttagttaaaaatcgagtagccttcatggtgttagagtaggcgtcgaattagtcctagtaggttaaaattggacttggagttgcaaaaggttgttgatggtggagttagtgtcggactctgtaactcggcgatcctttaagaagagtggacaacgtcgtaatttaaccatggtaatgacaatgtagtgcatgtgcacaaggagaggatggcggtgaggccatagactcataggagctaggtgtgccatcggtcccatgtattgatgtcgtcattgtggttctagacccggaatccacgttctgaccaaagcatatgtcctatttggatatcgacaagttgacaatgccactaggtttgctactctcaggaacatgtttttctcaatatggtctcgtctatatcctactacaacccaccttttatctctccatatcccctctctctctctctctgtcccttttcatcctctacgtgaagaagaagaccaataacatgtggtacggtgcaatagtggttatcattttagtcaaactaactcaatcaagtcaaggttacgctgatttgaacttaatcgtataaggacaaattgtgagcctaggcagaaatggcttgtttgagtgattcataccattttcattagagcttacactggtttgctactttcctccgttcataaaaaaaatgtaggtcatccactttcatttgttctagttattttaccatttacatgctgatcttttttaggcttatttgatgttgttgtgcactacattgtgctgaagcacccatcggacctgtagagctaacatagaagtccatcataaaaactgaacctcaatctaatcatataatttctatcataaccttctgctttccattgcaatgcaagggtagtttgctagtaaaatataaaagacaaaaaatgatatgggacacaaaagaaacatggtctttattggagtacacttaaaaaaacatatgacaatctagtttattggttatttcccattagatatcgcgagtattatgtttatcatttcttactgattcgaagagagaaactttgctaaataaccaaaattcccttcatttcgtccattcgctagttggcactttttctcactaccgtccattctttctcactgcacttgatgctcccgtgatgctccttctcgttttcttctttgtccggacatagcccacttcacattgctattgtaaagctagcccttttcgaagggcactttgtgtcatttgactatccaaaatggcaataaatgacaaactattaagggcggtgtctcatggcaaagaaacaagaggttaaagtatccattagaaaacccttgttttttaaattgtcctctagcaaataccttgtatttttagtgttctatatctacaatcgccattgttgtcatcaagcgtactgcctgtttactaaggcaagaaagctaaccactacatgcatggatccacaaggccgctccttcattgccacggcccgtaatcaatagttcttgttataccaatgcaatcaatcatccttgctcgcagtcaactagcactagaggttgaggatttgatgaacgtgaatctcatatgtcgattactcaagaagtataagaagcatggttagaacataatagtgcattcttatgtgtaacattggactttcgatttgtaaaaaagtctacacatagcttaggagagagctacaaatcgaacgtccgttggtataaaaaaattcagacggtcaaatgtttcagttgaccgttggtgcaacattatgttatacatggtgaaacaaaaaaaatcagcctctgatacatacaaatattttgtgaaacacaattcgaacacatggtgaaacatatttgttggagaatgaactcctccaccaggggaccgtgaggcccccctttgtgagttcggccaggggcagcgggagagattcgaggattcggtgagtgaagccgtgtgatgttgagggggtcgagccccccaaagacgatgagaccaaaggggtttatacaggttcgggccgctatgaagcgtaataccctactcttgtgcttggtttattgagtgtagaacactagtgcttgaggttgcgagacccaagcgcgagttcgctcgaaagttcccccctccaccactaggtctggacctccttttatacctcaaggggttaccacatgggcccaacaacctaacctagctccggtggagaagtattataatttttgcattaaatgcatgtctggtctcttgacttgggaagccaagcgcacgtcgtcttgatgatggggcctgtcaaatcttgccgcctgacacgaggggtgcccctgtcagtcaccatttaatgggtgaagacttctgggctcctattacaccgggaaacgggagccttgctttgaccaaagagggaggaccgactccggctgggataagagtataagaacctctcaccatcattatttgatgggacatgtcgggctgcacgtcgcctgacatacgcgatggtgcgcctgacatactgggtcccatcggtcattcgaccggtcacagaccggttgagtgcactgcacaccgcattaaatgcggcgtggcgcgaccgctcgggtcgccataaatgccggtaggtggacacctgtaggcggacacctaac

SEQ ID NO: 64663 - DNA, 4643 bp, Oryza sativa
actcccctcggggagagccacgtggcattggggggcagcctcctccaactagtctttgggaaggagtggccgccaccccaccccgggcctgactccccctgggggagggccacgtggcattgggggacaacctcctccctctaaacatgatactcccgggcccatatcactgacaatattgctatcacatatgaaacattaagtttttattgtttgaaacatatgtttttctttcgtcagaatatagtcatgtgatattttgttataaagatttaattataacaaattcaacggcatgatcaaatcgctcatcggataaatagtttagaagaaaaagtatttttaagatcactaaatacatgcatacatgcatggtgtggggagaaagccaatcgaatggcgggagagagtagtgacgtaaacatcccatactttttatcggtcatttatgaaacattaggttatatatggtgaaacaagaaaatttagttatcgaaacatttaaatttttttatgaaacataacaaaaacatgtgttgaaacatattgctaccgcgtctgaaacattaaattttaacggattgaaatatatgtttttctttcatcggaatgtaatgatgtgatatcttgttgtaaagatttaattataacaaatataatggtatgatcatatcatcgattggataagtagtttaggagaaaaaatattttaaagatcattatatcatgtaatggatgtatgaagtggatagggagatagtagtttgcccatctgactttttatgatacgtcagacgtccgatattaagcgtttccgcatagcttatgccaaaattaatttccccaagttgcttttgtgacgaagtcttgaatggaatggctgcaccacgcgacactcaggatcgtcattagttagcgtgacaggggtttagagccgcctaaacccctcccaaaaccctaacaacccccctaatccctcccacgggatggctccacaagtagactaccacaaataccccttctacatctcccaaaaaaaaaacaaaacaaaaaaaacaatccccttctacaaggcagcacaccaatgccctcacaaatatcactcgcatagtcgcattacgtgcgcagcgaattaaaaaaaagaaaaaaaataatgaaaatagccagagcgcctcacccagagccgcagagaccagcggccagagggggagggggctagggggctcgctcgcccatataaaaggcgcgggcgtccagccgccaccgctctctacccaagcagcccccctctcgcgaggccaatcattctctcccttcccctccgcctcgcgccgcctctcctctcctcgcccccctcaccggagccgaagcttccccgccgccgcgcggcaggttcgtctcactcgccccccctcccccctcccctcccccaatccgttctcctccccggctcgcgtccggccgaacggagcgcccgcctcggggtcgatttggcgagggtttagggtttttgattcgactccagatcgtgtttggttggggtttagcggcgcgacccgtgttattagggagtcgtttgtgtggccgactctgtggtggggtttggatttgatttggatttggtgggtttggtattttttggcctgggcagggaatatggcggggaagtcgaagggcgcgaggaacaaggcgaaggcgcagggtggaagccaggccgccgtcgcggcggagccggaggtgccggtgaccgatggagtcgaggatgccaagcccgagatcgaggaagttagtgaacctgccgtcgtagagggcagtgacactggcgctgagaaggagcagggcgatgcagctggggaaacacaagccgcgaagaagccagctgaaggtaatggtctcccccactcgatcgtgttcatatactgatactgtatttgtttcttcaaatcagaaactgtgccttgtagaatatagaacataattttaataaagctctggtcttagagagataaatgaattgtgcaataccatcgtgttagagaaatatctgagttttagtactgacaggccatcgggctagagaattaccaagtgtgcagtactaagttttacaaggatacagctggtatctgcatttttagtaattaagtagtttagaacgatgcattttcttttttaaaaaaattgtagggtaaggctagctgagttcaatttatgtggaatgaagaacacgtttaatgctgctgctgttgactttgtttttgcattaatgatgataggtatacatagtatctactgcaatgggcaaaaaagtgtctttagcatttgtaagatgcaacaactgatactttcctgttctaactatttcaaaaagctgtgataagctacaaaactctacctggatagaaactttcttgaactgagacacttgttggaatactctacttatcttattaacagcatgtctctttgtttccacattgggctacccgttctcatttgatcgatcatgaggacttcctatgtgcttagatgtgttattaattatatttcgttctctagtgacttaagttctaacaaccaaccaaccgttttatctcaacaggggaggttcatctctaccctgtttctgttaagacacagtctggtgaaaagcttgagttgcaggtattttatatacaaagtgtgctgtgtctctcagtctgtactggttctgtgtaattcgtatcatgatattacttacagctaagccctggagactccgtcattgatgtcaaacaatttctcttggacgctcctgaaacgtgcttctacacatgctatgatttgttattgcacactaaagatggctcaactcatgagcttgaggactataatgaaattgctgagattgctgatataactgctggtggctgttcattggagattgttgctggtatgcaattcaaaattatcttttttggatcattctcttcagttgttccttttaaaatttgacgcaacgatttgtgttttgttctagcgatatatgatgagagatctattaggtcacatctccgtcgtgtcagggaattgctatccctctctagtcttcatgtatcactttccacatcccttgctcttcagcaagaatctgcacaggaaaaatctgcagatactgcaggtacaacccttggttttgccctatgctgtgtagtttattgatgacattctatattattaggaattttttgcatgtcactgattagtttactaatttacacgcaagttttgatgttctgtcttttctttacttaggagattctgggaaaacggctaatcaagagcttgatgggttgaatttcatggaggacagtactggtgctgtcattaatttgttgccatctgtaccagcagagatcaaatgcgtgggtagcatagttttttcttcatttaatcctccgccaagttataggaggtaactctaatgaccgcatattccgcacttgtgtcatttatttggataccttagaaagattggtcaaatataaggctattgcttagtattttgattctccatggaattcacagtcgttgatcctttcttcagattgcatggagatctcatttatattgatgttatgaccttagaaggaaacaagtactgtatcacaggaaactccaaatcattttatgtgaactctagcaatggaagtattctggatccaaggcctagcaaacaggctctggaggacagcaccctagtcggtctgctacaaaaaatcagtgccaagttcaagaaaggttttcaattgctctcaaatatttccttattatgtcaaatgactactcttaagtttctataacaatagtcgggcaaatcttatgaaggttttcgtgaaattttggatcgcaaagcatcagcccatccttttgagaatgttcaggccttgctcccagtgacttcttggttgggagcttatcctgtgccaggtgatttattcagtacattccctgctcacaatttcattctcttttctgtttgtactaaggttttaatgactatttgaagtgttccgcttctggtatggtcaaatcttaagctagttatgaacatgttttctgccggcaggcagaatggtttgatgtgcacaactattcttatgttgtttctacttctacaactattgtagcgttgacttcagttgatataccccataatcattgccagattcttttcagctgattctgaccttgtctgtgaacctttcatccttcctattttccgtagctctttacgtcgatcttctttgctaattattcttgtttttgggactgctattatttattgtagattactccatgtattttgtctttttgtgtagatgctgtaatatagcttttatactccacatttttgtgttagcagaacatagaagggatgcagctagggctgaagattctgttgtgctgtcatatggaaccgaattgattggcatgcaaagagactggaatgaagaattacagtcttgccaggagtttcctcatagcaatcctcaagaaaggttgttacctacctttgcattcttggattgcctatttatatcatctacaataaatatttctggctattgtaggagattgcgtggcaaaacactttataaggt

SEQ ID NO: 64664 - DNA, 5915 bp, Oryza sativa
tgtataatcttgctatggcaattattgattacagaggtcacagggttgtagcacaggtatgtttcctgattactatatttttttttatgttctactggataccttttttctcttgcacatgttaattgcaataatctttctatattcttctgataagtagatacctagatttatactacctctgtcccaaaatgtagcaatttttagcacagtaccttgtcccaaaatgaagctttttctctacctatactctcctatcaatcaatcacaaccatcctccatttaatttgttacctattttgtcttctcaaccaatcacaactatcatccatttaatttgttacatattttttcctctcaaccaatcacaaccttcatacaatcatttcaacctactctcttaatacccgtgcccacctaaaaaatgcttatattttgggatggtggtagtacccttttagcatgatatatgatttcatacagtttgctgctgatgttgttataaatttgatcattgcattttgttgtatgttgttgtttcactctatccttgtcttagtttctctctctctctctcataaaatgtgtcctgttgaaaatgtttaactgagtttttgtttatttgccttgtacaactgtacttgtcttgtagagcatcatacctggtattcttcaaggagacaagtccgattcccttctgtatggttccgttgataatggcaagaaaatatcttggaatgagtcattccattcaaaggttggccaatatgttccttttagcatgcaaaatattctctgtacaggagtaatgaattttcttcagtatatgggctctcaaaacttatgttctttagttgatggtggtgttatcttgttgctagacgtcgtacagttcacaactaacgagaatttgcaagttaatataaactggttgttatgttaattaagatgatgttgcttaataatgatcatgatgggtgcctgtttgatatattttgattatcagtggtgatgctaaaactgcatgttgtaccaagtatggtgactaaagaactattcttgatatttgaattcttcggatacttatatacttttacttttgtttccctgtcaagtttttcacaagcttatcatgtggcttgttagatgaaaatttaatggtttgcctgacttgtgcacaatttgattttctatcaaacggtaatgcaatttttgatgttagccttacttagtggcacttaatttccactgaagatcattatggaaattggaatagcaagtcaagaaagattttttttttgtagccatacttgattcttggtggtagtgattaaccactctgatcatgttatacagcagtggatgtactctgtgccttgtggtattcaaagactatccttatttcttgatgatatctattattttaggtggttgaggctgcaaagcgactccatgtgaaggagcatgtggttttggatggttctggtaatcctgtaaaattagctgctacggttgaatgcaagggaattgttggaagtgatgacaggtcaaaatctatatctaaaaacaacaatgtgctttttctttttctaaatgctcagtggttcttttgggtgctggagatcctgtataagcttcttctaggtgttttgtgtgtgtgtttgggggggggggggggggagggggtgcctcttttggaacctttataattttgtcaaactgcccaaacttgtactcagtgtacactcactacagtgctaatgttgatatccttttattgaataacatgatcctttcccctttttcaactgtatgcattatattttggatctgatgagagtgacccctcgatattctaactacatttgactactgtaccgtttctgtgtgttgaggcctgaacttgtagccttattcattgaggtgagctgatcccgtggtctccctttttctgcaaagaagatggttcgctggtatatgatcagtcctaactatctcatatctttatgtaagcaggctgaatccacaaataaatccactacacagaaagttgcagatgctcctggagaatctaatgggcaattggtaagtacttctgatgctacggttggtgcagaaatttattatggaatactttgtgtttgttcaaaagcattcattcctaaattagtgttacagtcaagtcaaactggatatgctattttcctttataacctaaaacacattgccacgtttttatttctcactttcatatcttcccttattcagttgcatggtaatgatttgtttgtctaaactctaaagttctaacttatccaatatcatgaagcaaaatgattttcccatttttatttaacagtttatgggtgttcaatttcccttgtggtactcatatgcctaaaattctttaaaaaaaatgtggttattcttgtttcaaatatgcaaactggaaacttagtccacctatttcaggctacaactgcggaaggacctgccaaatctgatgaaaactctgttcctagacctgataagtttgatgaagactctggtcctagacctggcacatctgatgacagctctgctactaaaccagctgaacataacgagtcaactgcagaaatcctttttaatccaaatgtgtttacagagtacaaacttgctggtagtccagaggttagtcttagaactactccctgcttgatatccctgctctaatttattgacagcctactctttgctttcttaggagattgcagcagatgaagcattggttaaaaaggttggtttcgtatcttctagacacggtgataccaaagtttgttcaggatctctgctccctagatgtctcccccatggatgggcagactttgactgatgtgctgcatagcaatgggataaatgttaggtatcttggcaaagtgagtctctgaactgatccagctggatgtgagttcattgcattttatgtatagtatgttcattatctaattcctttctcaggtagctgacatgatcaagcatttgccacatctacggggtttgttgtcttctgagataattgttaggtcggcaaagcatgtggtcaaggtgatagatctatcttaccagctgtttgtttttatgatggaaattctttgcatttatttctttaataatttctaaaggatgagtcatactgtcacccagactcatcctgctgtccattcaaacaaatgttatatggataagattattcatcaaaatgcataactttcctgttttaccacgtttaataagaagtcattggaaaaactatgccaatttgttgaccgtactgtttgttgttcccatcccaggaaatacttaggcaaagcgcagatcatgatattggaccagccattgctcatttcttaaattgttttattggcaatgttttggcaccttccacaaaaggtagtgttgacagtacggatacaaaaacccaaaaggtatgctattccacgtgtaagaaactcatgtcatcacttgtattctaactgcaactaatggctattcttttggattttcaaattggtagggtcatgagaagactcaaaatcaaaaatctgccgagggacagaaatcaagcctttctgcttcttcaaagaacattgtgccaacattttcccatctaacatctgatgggatttggtctaacattaaggagtttgcgaaacataaatatctggtagtggctattgcttcttttgtttccgtagttttctatagatgccatcaatataacactccttttatttagtttgaagtgaccgatgatgctaagactggtgctaaaagagttgcagtactccgcaatctttgccaaaaggtttgctttgttcagctctatattcattgagtttgctattctctttcagagaaatgtttaatagtttggctgcaagtagttccaacaaataattcttatgtgctcttttggtcaattgtgacataatctgcataataggtgggaataacaattgcttctcgcaaatatgacctcgatgctgcagctccattccagccttcagatatcctgaatctccaaccagttgtcaagcattctgttcctgtatgtacagatgcaaggaatcttatggaagcagggaaaatccggatggctgaggtatgtatggagaaaatccagatataattttcccgtgaaatttgtgataacatgttttgatggactcatcttatactgattaatgcttcctctgttgacaaataagtgtcattttggacagtgatatgtacaccaatgcacttctttacttgtatagaacctataaaaaatatatatcatagctaaattgttttgaaactattttgaagacaaatctaaccatatcacttttaatagttgatttgaaatgttcaaaagatgcttgtcacttatttttgtctggagggagtatcctgtttaattttctgtactcgtggattttacaaatttttatacctgcatttcagggaacattgaatgaggcctatgcactattttctgaagctttttcactacttcaacaggtatgcatcacagctatattacggcaaaaacgtggatatttgatttctgacatttatttatgacctttaacagattactggtcccatgcataaggatgccgcaaactgttgccggtaacacattagcttatttgtttaggcatctggcattttctagatttctctttttgtttttatgtacataagtcatccataataaaatctttggattttaatttgttttccctttgactgaaggtaccttgctatggttttgtaccatgctggcgatataccaggagcaattgtgcagcaacatagagaacttatcataaatgagcgatgccttggtctagatcatcctgatacagcccacaggcatgttgttcaatttcaatttttctatagaattttgatcttgtccttgttgtgaagctaaatttcacgttattgatacaaaactgaccgcccatcctagatcccaacatctactagaaatctttaaaccaactagagaatgaatgtatctttgtcatatgtgatattaatttacaacatcattttctttctttcaatttgtgcagttaatatcttttatattaactaaccttgtgtgttattttctttttcagctacggtaacatggctttgttctatcatgggcttaatcaaactgaacttgctctgcgtcacatgtctcgcacgttgcttttgctaagtttagcatcaggtcctaatcatccagatgttgcagcgactcttataaatgttgcaatgatgtaccaggatgctgggaatatgagtactgctcttaggtatcttcaggaagcactcacaaagaacgagaggcttctaggaccagatcatattcaaacagctatctgctatcatgcccttgccattgcattcagttgtatgggtgcattcaaactttcaattcaggtcagttcaccagaaagatgattggtaaaaagaatactttgaaaacattgatctcatgtattgattctgatggcagcatgaaaagaagacctatgatatactggtgaaacaattggggagtgatgattcaaggactaaggatgcagaaagttggttaaatacatttaagtcgcgagaacagcaggtataagtttaaactgtatttggatttgtgatacttttaacaagcatgcaacatgttttatgtatggcatagtattgtagttttgtattttcttaagaaaatgtatacggctattttttatttggtcctgtatctcttgtacatctaatatactccctccgtttcacaatgtaagtcattctagcatttcccacatttatactgatgttaatgaaatatgaatgtgggaaatgctaaaatgacttacattgtgaaacggagg

SEQ ID NO: 64665 - DNA, 1755 bp, Oryza sativa
acaaaaagcaactagttggtattccctccgtttcataatgtaagtcatttgtagcatttctcatattcatattgatgttaatgaatctagacatatatatctatctagattcattaacatcaatatgaatatgaaaaatgctagaatgactcacattgtgaaacggaggaagtagctagcttccgagaatctaaaaaactaggttttgtagtttctagcttctggttttctagtttctagcttctagttcattttttaaattatgcaactatagcttatcagaatctagacgaaaaactaaactatttgagaagcttttgattctgggagaagctgtagctatgagaagcttcccaaacgagctagttcagggccagtttggtatgaggcctaaattaggcttgctaattttttggcaacctcaacaataattgtgtatgtttggattgaagccaaattttggcatgcctatataacataggccatttcaatagccaaattagttaatttggcttcgatccaacacatgttggccttacctgtcatgccaaattttggtaaggccaacattggtcacaaaccaaactggccctcaatcttttcactttggactagctaagtttatgtttatttcactttagatcacccccaaacctccactttaacacatcaacgacctccaggatgttgactgtggcacgctaatgaaatcctccacctaggatagacatgtctagagaaaagagtcggcatggttcaaagtgtaacaaactaaagttagataatctaaagtgaaaagattgaattaagggtggtccaatgtgaaactaaaaggtggcccaaagtgcaccgcactctagattttctgatttcaaacgggaggaccagtatcccagtatgaaaatttcagtatcacatgatgttcgaggctaggaaataattattgtgatttatgatcatgagaaagcaagcaaaaccagatgtttcaagcatcgtgaaggcgtttattgtgatcgatgatcacgataaagcaagcaaaaatatttattccgagactgttgtataggtctctctcgagcacaacaatgccaaggatttgcaaaggagctagtacatcaacaaaacagacatgaaagtaagcatcagcttcaaaattcaccgagctgacggttttgcaggacttgggctacacgtacagaacttcagtcaatgagcgggcttattctcgactgtgtagggatagtactctttgccattgtccactctggtagtgttgccgccaacgtccagcgcagcagatgtaaaagccaggcaagaaccagctatgagcgcagaagggatgctccttcctgccaattgggcatttccagattaacagacatgagtctttctagccaatatactgaactataaaattactaattgattggtgaaataaagacaagactattacaaatacgatcattacatgctggcttcgtagataaccattgattgatatgcagaggtaaaaacaaagttaacagttcgtgagatgtctgagtactacccctttagtaaaactgatacacatggaacagctgttcaggtacaaagcaagaacatactacgcacagcagaaaaatatcatggggcacctgttaagaatcccctataaaaattttcattgggcatcaagtgtttgtaaaatctggattagtcctacttaggttctttgtttgcaataaaaaggcaccataaaactcccgaatagaa

SEQ ID NO: 64666 - DNA, 7865 bp, Oryza sativa
gaacagggcgattttgcatcagctacacctttgtagccgaatatggtggcgccggcgacgaaggcgccgacggccccgttgacgtagtcgttcttcttgcgctggctcagcacgagctgctcgacgccgatgtagaggcccccgacggcggcgaacgtggccccgtagctgccgcacatcttgagcgtccggatgagccccgggagcgcgacgtggcgctcgacccggggcacgtcgtgccatgtcgcgacgaccgtgccccagatggtccccgcggccagccccgtcgccgcggccttcaccgtcttcgtcaccggcgtgtcctcctccaaccccatccctcccttcccaacaccaacccgcccgctcctctcctctccactccctgcacgaacagtaacgtgagccaaaccccctagaaacgggatcgagatctggtcgatctgagccggagcgacgcccgcggcgagcggcggggacaggaggcggggcgatcgagcggaggcgacagcgcgtggcttacctggggggaaccctccgcggcgcttgccggcggcgaaggatcaaaaaattgttgggattttcgggggcggaggtagtgaggtaaaaatgggggaatcgcggcgtggttggagaggagaggagagagggggtgggaggggggacggggcggcgtggtctcactcggctcggcctcggcggcgctcgcggctcgcccgctcgcccgctcggccgcaacgttggcgcgggcttgagccttgggcctcctccctacgtgggctgcccacttcggctcgcgcgtggcttcacggcctcacgggcctttcactcgtgtcacgggcctcacagccatgactgattcgtacacttcaatgaaactgagtttgtatgagcataagctaaaatatgcagtagaaaccatattgaaaacctaggtattattataggatataaaaatagacgtctcaaatttatccatatcattataagtaaaaataaactcacgatgacatgcacaaatcttaaacgttcatttctttttcctacaatagttttaggttttcacaacatatctatccgtataagttgtgtgcctcaaaattacgtacttttatccatttgattttaagatctgtgcttaactctatctttttctttctttatgcttaactctctgatctctcacgcggaggtaactgtcaaatatgtatgcggagtgttccactgttttggcatggaaatactatgaactttggaatagtagtatggcagtcaatcatggtggtttttgcagcacgtggagtcccatatctatttggctccttccttgggtagccgtcaccccgctctcccccgagatgcagagttgcccaatgatgccgcgccggggcccgaaaccggtggagacgcagacgcgggaggtggcggtggcggcccccggcagccgaagtcgccagcgatccatcatgatgtcgcgcccgcgaccgcgcgacagcatcacccagacacacaccccgtattccccgttccggctgccaccgctcgcggccacgtcccgcgccgcgccgcgcacgtccctgccactcactcccgttccgagagaccgccgtgccgaagtgccaacccaccgcgggcggggcatggtgatctcgccgtggttttcccaaccgtctacgcggcgcggtggcgtccgtggcgtgcggcctctcttccagtcacgagcggtaaaaagtggcgcggctttgccgaaaaggccccagccgcttggcttgcctgccgcccgctcagctcccgcgtcccgaccggagacgacacgagggcgggtcaaggcgaccagacgaatcggcgcctctgatgaatcgcgctctgctttcctctgcgctgattctacagtgaaacctgcatcgatgccacgtctccgtgccaaacctcgccgtgtcttcggcggggttagctcccaactttttcttcaaacttctaacttttttatcacatcgaaacttttctacacatataaacttctaacttttccatcacatcattctaattttaaccaaacttttaattttagcatgaactaacacacccttctagctctagatgattatggtgcgcgctcattgcagcctgatgccactgctgggcatggcaaagcgaaatgaccgacgagatgcttattatacgttggatctgtcctcaggatcagcacatgactggtaaggttagtttggtgctaccgtggtggtggcccattaaccacgtttccaagaccagacagtgcttgctttaaaaatactcttagccactgaaaccattagcttagttttgacttctacacttaacgccctcggtttatttctcaggtttagtactcagccgacacaaaaacgtttgtaaatacggcgctatcaaacagtgatacaattcagatgagtttataccaaaaatattctatttttgatgcaaaaatttggtttcgaagtactcctgatgcaacccaaccccgctctacatatataatggtagaccaaattcggttttacacttgtacatatatacataagcaactgtactgtgctgtttttctcaagtatgaatgtgaaatatgacagtatccaaatggagataaaaatgtttagaaatacagctctaattaaaaaacaaacagactggattttcactactcagaagataaggtaagaacaaacctatccagcgttgccaggctaggaacaccgtctatttagcaactaaactgagctgctctaagaggcaaagagaatcaagattgcaggaatttctgctaatatcaccagctgttgagagctctgctacaagcaggccaaaatagtattcagcttggaagagcagctgaacacctgttggtgtacagtactatcagttcatttgttttgcctcaacattggcaaaaccctgagcaatcagtacataattttgcttacatttcgcagcattgaggaactactgaagagaagacgatgagaaaaaaaaaatgaagtctactgaatactgaaaaattgtgtagatggactcacttgcattctagccctgcctccgctgctcgcctgggcttgtttttgcgccggcttccaatctgcctgaatccattagtcctagttgattcatcactgcttgatcgaacactggaattactctcttccaggacaagattggagctttctttcagctgcctgcctctcttgttaccagcagcagatgcagtggtgttcttgtctagccttgatgccttcagcttaacatcatcaccttctacttcttcgccatcaattacattgtctacaaaattttccacatctacttgatcaatcttatcggcgaagcgcttttgtggccttcccctcctctttcttgcaggcatagcttcttcagcgccgcttcctttgtcttcatggctccggacaatcgttagcttctttcctctgcctcttcctctacccatctatccaacttagcagtgacaagatttattcagacaatcactgaagctgcaggctctactgaagttgctctatgtttttctctagttgctatttggaaggaaagtactcaatatttcaccgagatacctcgcgatggcgacaatccaatcaagaagataggctagaaatctgcagtcgtaataccaagaacaacatgctgttacatctaactagttcatgatgaaatgggttcttggggtgcagaagcaataaagtttgaggtctattgagatccatatcaataaagaagttgcaaatccagatcaagcaacataaatatccagatgaaaactatacaaaacagcaagcaatacgcatctatcaagataagtttaacaaaaggattttttttttcgatagagaacaagaaacataaaacaaggaccgattcaatatcggaaccattctttccacggatgacaagcaagaaactcaccttccatatagctggcgtccactccaagcagcatcatgcatcccatttcttcatgtttggtagccaaaaaagatggaatttttcgcaggtgctacaggaaaagaaacgctgggtatccaatggatcggcggtaatattcggtttgcgatgccagaagtacccgcggatcgggaggtttcagcaaagattgggatgtggtgttcaggaagcaggagaggactcagggctctacaaatgaacaactagtgctctggggtctgggagttctggatggttgggctccaatagcttctggggtagcagcagcagctgcactggctggggtttgtgtgtgtgagagagagagagagatttggttcttctcatgaagcttttttaatactacctacgtttcaaaataagtgtagtcgtgaatatccatcttatttgaaaaatttatgaaaaaatttaaaaaattttgttacacataaagtactattcatattttatcatctaatagcaataaaaatactaatcataaatttttttcaaacaagacgaacggtgaatagtgcaaaactgcacttattatgggacgaagggagtactgctactcctgtactagtactactactgaggagtcatttgctgtttgtttatgcttttatttacagcttaccaaccgttgaaaaatactgagagagagtgtgtgttcttggcttcttgccattttccagattaaaaaagcaaagacagaaggatccctagccctagggaagcggtttacttttaccatgatgggatttttgttccatgtttctggatgtttaaacacctaggacagccagtagtaactcaacacggcaacacctgacaccctgacgtccaaggtcattttgctttcaaagcgatgccacagttctcgattggctccagcttccaggcgagcaatgctcctgtactgtacaggtgtttatttcagatagagatcaatattttgttcatggcctttacctaagaaaacttcgtgtttataattcatttgaacaggtcaacacagtttttgttcatctctactccgtactgtgcttcctagtgcaagtcatgcagatgccctcatacttctcaaacagtgctaagttaaaaagttacgcagtatagtatttcagagtagagaatgatcaggtctcttctatttactgcaataccatgaagagacaaatcttagcacacttcagctgctgcagcaagtggctgtattaaattataccgtatcctgacacatgctatacttttttattgtattatctcttttactttgaatttgaattcatctttttatacagtttcttatcaaggtagccaaccaggaggttgtactgatcgctagtgcaatagcactactgtatctctgtattactgtactgtgtatcttgagatgattctctcaagcatttatacagaagacgtacatgttcctcttgctgtcaggtcatcattatataccttctcccaattaaccgtccttcaattctcaccgctaacttgcaaacgaggcatgcttgttttgacaagagcttgttgaacaaacggaatttatgaacgctgctagtactcatttgaacaaacggagtacattataaaagatatagtctatcaattatattattaaattatattattaagacagttttcaaaggagaaaccacgttcgctgtgggcaggggtggatccacagtctaacgaccggggtgatctgacaccgatgacatccagcgaatgcacggtgatgctcaaattctaccagctgtgaccccggcataagatggtaaatgaccccagccatcgtcttcacctggcacgtagtacgtgaaactaaaacaatttacttggtggtgttacgatcctagttgattaatgattcttttattagcatgcacaaagcccgagtcaattttcttttgtttcctaagcctcattgtaattaattgtttcgtcgttgtgcttttgcttcgtcagttaagcagttagtactagctaatttcagatttatacctctttgtatgatgaaaggaaatgctcttagcctatttcaattatcattcattcgttgctggtgatcgataaaaaacacaagaacaactttaaaaaagattttgcattaatcgagagaacaaaaaaatgatctacctagtcttttagttaaatcaaaattatagcggtgttcatttagatacaggaattctgctctcgaatatcataaaagtgtagagttgttattaggctacgttcattcacaagccaaagagaggagatcactcgtttttcatgcatacgttttttagactgctgaacggtgtatattttttcaaaaaaattctttatttttttaaaaaaaaatcatattaatacattttctaaatttaaaataactaatacttaattaattttgtgctaatgataaactcattttgcatgtcttctttaatcttcttcttttccattctgtcaaaagctttaagttgatgaccccggtggcctttaatcctgactccgcccctgtctgtgggggctaaaaattcccacattaatcggagaaaaagaaaaggagagtccaggtagaactacaattcaaaaatagctgaaattcggaattaaaaataagcaatattaaaagaagtgtccatataagaacccaatacgagattaatcgaaattcacaataaaaataaaataaaatccgaaattagaaaataaaaggagagtccaagtagaaatataatttaaaaataactgaaattcgtaattgaaaaataaggaatattgagataggagtccatataagaacccaatacgaattagttaatattcggaataaaaataaaaataaaatctgaaattagaaaaagaaaagaagagttcaagtaggaatacaatttaaaatcaactgaaattcggaattaaaaataagcaatattgaaaatataaattaaaaataagcaatattgaaaatatatgaacccaatacgagattaattaaaattcataataaaaaataaaataatatccaaaattagaaaaataaaagagatttcaagtaggaatacaattttgaaacaactggaattcaaaaaataaaaaataaaaatattaaaagaacactatactgtattaattaaattttgaaaaaaaataaattctgaaattaaaaaagaaaaaagaattcaattaggaatacaatttataaataacaaaaattgatgataaaaaataaagactattggaaaaaaaagactatctaaaacacatgacgagataaattaattaacatgcctataaaagagtagagtggtagcggttgatacggcatataaaaactgttagtaaaacaccaaattgaatcctaatgattattaaaagaagggacgacaggtaggacgtgaagcaaacggataaggctgttgccgagacttctagaaagtaaaaaaaaacccattgataatcatattcgattttaaaaatcttaatgataacaaaaacgagaagtagagtgcggcgtgtataggagtacagttacagagccgtcgacagttggtgagacttctagaaaataaaaaatgaattccaacgatagttatgttctatttttagaatcctaatgacaataaagaataggcggcggatgggccgtagagaagtatagtggcattgtttgacgggacttctaaaaattataaaaaatgaaacccaatgagacaataaagtctaaaaactataaggtccaatttttaaaggttcggaacttctaaaaagtaaaaaaaaaacaatgataatcatgttcgattttataatctcaatgacaataaagaagggaggcagcgggcgagccataaaggagtataatggcaaagccactgacagtttggcgg

SEQ ID NO: 64667 - DNA, 12401 bp, Oryza sativa
ttagtacctctgtatcagcatgtgagtctcatcagtatcgcatcagctggggaaacattgcactgaagctgcgatgcagattttacaagtaaagcaaagcaagttaggaccacactcttgagggcactgcatgaccacaccagcacaccatttgctgacagataactaaaagtactgtagacaccaattttctgtagaagcataactatgcaagttgagttagccatctcttagctcgattcaagtctaacctatgacgagttaactggctacaagcttaaaaaacttgcaagctgcaagtcttttttctgcaccagtttttgacagaaagttaactggcacttagctcttggtaggattgcagactcaacaacagcaggagaatagcaaccttgcatatgctttcccatcttagttggctcatcagtcaggtcttaatagctgacaaaacccctcaaacaacacagccgaatctaacgtggcccgggcaaaatgtttaaagaatatactttggatcaacaggattctgaaactgttaactcggttcttcattcatcgtcacaaaggccaccaaaagcctgacaacaaaaaatggatgagatcaacagcatttatataaccaagataaagttacagttcaacaaacatataagacttcgacagacagaagtcctacctgaaccaggaaactgttgggttccattatcataaaatgagtatatattttggactggtaaatggcaaggatattgaccacttgcactcacaaggagaagcatgtacatactgaatgggcaacatctggaagaaattgatcacagtgcagggtaacaacttgatgactgaaaccatgaaatgtcatatcctgtaaatgtattgtatctgaaactcatcatcttacactaggcttcgaaagaaacacggattgaactaaaattacaacaccaagtgtacaattacaagatgagaaaatacacaccatgaatgcactgttcaatagcttcttttgtttgtcactaactcactacaatcatgacaaatttgcacacagtcactgtcaatgctatttgggcaaggatttgatgaaattaacaataaggtcaaccattcgtgcatcaaaagcagggccttccatttggaagtggccagctccttcgatcaagtgagtatcaacccgtcctgctgcattcttgagcttgttttgcagctgctttacacttgtgaagccatctttagttcccatgacgaataactttggtttctcagacttgaggatagcattgtggtgtctgccaaataggaccgaggccattagaccaaatgggtacccaatgctaacataaccaatgacctggtcaaccttatcaactgcagatcccgctattggtgctcctgcatcaggaaagtggatatagatatatgactaagcatgatctaacagctgcaagaatggttgaagaaaacttgtatgtggaatatgagtcattatcttaacacaattgttttacacataatcagttatacttgcagcactatctgttgacaacttgacataactaaatcataagaattcataaatcttaaatcataactatatgtatgactttggagtccagggaacagcgcgtgaagaggttcagtttgagtaggtctcagtagccacagctaatgaataggccagaagtaggtacacctagaagcaaccaactaaatgtaaatatgctcataaaaataggttatgatatattgcctaaagtcaggatttgctgaaaaacaatggttctagctgtaaacaagcaagagacgttgcttctgaggacactaggctaccctgacagaagggaaatttcgccattgaaacttcttgtggattactttgcatctgcacagagtcacctaaaacaaatcaatgtgactaatacccaggtaactctgtatttgtacttcaaagacactgaaataataacatgctagtatatttgatgccaaatccataagaccaaaaacctgatacttcagttctgctgcaacgcacaagctgtttctattttcttgcaggtccatttaagtggctaatcgccaattgcatattcagttagatcaatacagtttctaatgagcaaatcacttggtcgattaccataaccctcttctgtgaagcttcggtgagaatgaaacaagggcaccgacgtcatttggggaaaaagaaaaatcagcaacctaccagcggaggagccgacgaggaggacgccgcgcgggttgagattgtcagcgacccagcggcagacggcctcgacgtccccgacctcggtggagccggtgagcgaggcgcggccggtggacctcccggcgccgcgcatgtcgaaggtgacggcgcggtacccgcgccgcgcgacgccctcggcgatcccgcgcagcaggccctgcacgccgcccaggatcgtgtaggggtgcaccagcaccaccgcgacgtcctccgccgccgccgcctccgcccccgccgccggcttgaacagccgcacgctcagcttggccccgttcgccgcctccaccgtcgtccactccatcacacccacccacgcactcccagtccacccctcaccgagctgagctcagctcctccggtcctcccctacctcgatgtgatccgcttgctcgggtggctttccttcccttcttccttaactccggttggcttctggttggtctgagcagtgagcagttgccgcagttatttctgcatgggccgtgatctgggcccataaatttataatgggccgtgaattccaactggagttgtgggctatgggtctaaacgggccgtaaaaatcgtgttagaaggcattaggaataagtgcactttgcctcccttaaaagtgacccgaatctaatccatgaccctaaatcgcaaaaccggatatctcgaccccaaactattgaaaccggtgcaatttgactctcctggtggttttggaggacggttttgctgacgtggtggtgttgacctagtctatggggttgacgtggcgcttaggtggcatttgaattaaaaatgtatactccacatgttgtcattcacacacataaaaattggggaaaattggaaccatgccattataattttacaaaatttgagatatgccatcctgacccacatgtgattgactcatgtgggttctacatgtcatgtcattgagataccgatggtatatctcaaactttgcaaaattataatggcatggtttcaatttacaccataaagaattatggggagagaagagaaagagaaagaaagagagcagggaggaagaagaaagagatagaagatggcatgtggggcccacatgctagtgggccccacaattttgatgtgtgtgaatgacaaccgagtccacatatacgttttaaattcaaatgccacctaaccgccacgtcagcgaaaccgctctccaaaaccaccaaggaagtcaaattacaccggtttcaataattcgagggtcgacatatctggttttgcagtttagggttatggattagattcgggtcatttttaagagactcaaagtgaacttgttccaaaacattagacatgtcggctactacacgggcgtttgagtccttttgttgtttcgcttttcatttttctcgttgatatgcggaccctagatatggctaggtcctgagctaaccggatacagtcatacagctaatatccactgaagtgttcttggtccgttacagtgatcgacgatcgacgcattcacgcaactgtactctgtcaaacgccacatcgacttcaccggcgatattttcttatcctctctgccttttatttttctcccctaccttttgacgggtccagcaacaaagttgtttcttttgtgtctgaaagaggaagattccaacaaaccgcgataagtcggcagcaatccagcatctatcagcgacctcggtcggcaacatccaacagcagcaaaagcgtaaaacacaggagcactagctggagactggagtgctgctaacaggccaagaacgttgacgtgacacaactaattaatgaaagcgacaatgctgcacaattcacttgatctggaggcacgcatgcataaggtgacctggatccagtgataacttatcacttctggctgtatccatgttgatcttttgctgcctctctttggttggactacagagactagagaagtagagagagtagtacactgtacaccagagacgacgacctctcccaatcgacgtacgagagagaaagaaaaagcatacgtacgctttgactgccgcatgcgtgcatgcgtcgctgcactgctcgaccgacgaccgtctcggtgtctcactcgctatgtcagcgaaagcaatagcactgtgagcggcggtcacgcatgtctgcaaaaggaggggagccgcgacgttcgcggcttcgcccgaatgcctggattttgtgcaagattcgttgcacgatcgcgccgtcaggcaatcgagatcgatcggacggcggccgcctcgatcggtgcatgcatgcgttacgtagtttggcaagagcactgccgcatgcatatgcagcggcaggcagagtgtgtgtggccgatttcgctttggactctacggcgcgcgcggtgatcatcagtgcggtagctggctttgtccctagtgtacgtacgccgctgacgccgccgcccgcgacggcgacaggggcagctagcggcgtagcggagtgaacggcatgtgggtgggcgtgcggcgtggagggcgtcgcgcgtgtcggattcgtgagctgtgcgtcggataggcgagaatctagcgtccttataaccagtaggataatcagttgatcactagacggtgatacgtgcagtgcagtgagctggtgtagtgagtagtgtgatctcacgacacgtaccggccgcaggagagtcgtcgtagggacgtgctgcatgccagctaatactgttagaagtggcataataaggaggacgtaattaaacaacatttctttgttatgacgacagtctatagcagctgcatcgctggagcataagttatccgtaagactgtaaccggccggtcgaggcctacgtaagtcaaaggaggaggggagggagaacatccgcgaaggaagggagattttggcattttgcacaggttacagtaatttggaacgatgcagctgccagttgaatgccgcacggatttatatatgcgtctgatgttttacgtactgtcatgctgatgtggttgcgcatatatctagtaaaccaacgacaaattaaactgccaaaactctcgaaatttctgacaaggacgtggcacgcgggaggaactcgagcaacgtgcttgaatatatgatcaacaaggacatttgcatagagcgtgtactggtagtacttctcctcgtttgtaacatactcctcatgcataaaaaagcgcaaccatccatttcattttagttgtttgcatattttgtgtgcggagaatctttgagaggctacggttcggaacttcagagttcagagtacatatggttttaattttgtatccatgggactgaaaacataatcatacctccaaaattaatgtatgtcttacgtccttcgttaggtcgcaatgttgttcaatcacgtcgcgccagcaagcacagcgacccgctttaatttcttgtccttgagatccttttaggacgcttagccagttaaaacgatgcatctcgatcacaataattattttcacgtgtctctaccgtttttttgttcccgaaggaatcgtagtcctggagtactagtgaccatacgaactgcagattcgtgaaaaaaaaattgatcggtctcaccgggtgagttcaagataatagtatctagtttaaataggagtattactgtttcgtttttactgtcacaacttcagaatgtcacttcaataatataagttttcagtgttttttttaaaaaaaagacgattgtcaagatttaaagataaatagtttcttggatagttgtttaaaataggagggagtagcttataacaagcctaaatggcaaaaatggaggacaactaactaaagtgtggtacttccagctcattacgccatgtaccccttatgtactatacgacgcatttttttcgctacgaacagcagtagcattgtcctcgcgacggcgacctaaacctgatcaaccgtccatccatctgactttacttgtactgttgtacacgcactagagacgtgcgtgcgtgcattgttctgacgattaagcatacgcacggtcttacgtactcccggtgaaattcacaggcctctctctggtctactgccaagcacttcacaggatccccgttattttggggccggaaaaggcctaaagggaaacagctggcgcggcccatgcacgctgccacacaaccacagtgccatatgtgtcggccactactcgccccggccccgcaggaggaaacgaaaacggcatccaacaccgccggcccgaccccgacgcacgcccataaatacgcgccccatacaccgcccagacacacgacccgctatctagctagctagcttccccccccccccccccccccctccatttcccacacctcccagtacgcgcgtctccgtcgcgctcgcgccggccggctgcgtctgcgcgcgcggtacaagagatcgttccatcagggagcgcgggtgatcacagcagccgacgcgcgcgcgcgcgcggcagcacggcgtttcaccgatcgcgtcgttgcgcgcgatcgagctaccgcgttgttgtttgaggagatttagctaggtaaggcttgcggtgttcgccaccagcccacacaccactctgatctcgcgccggtaaatgactggacgcctgggcagcagctgcgtcgtcgtcgtcgtggaggtcgtcgcttcctttgtgacgtgcctgtcgtcgtccccgtcgccggagaagtgcgagctgccgccgctgcgcgtccgcaccggagggttcatcagcgaaggtacgcttgcacaaagagatgcgtacgtgttatgtacgtagggccggccggtggtgtggccgtgtgatatacactacatgtgccatcacgtttggagatggtagtggtaccctgtaagttatgaatagtctgatatatgactgtgcactgtgcacaagcttggtgccaccactcaagctccttgtttatcacgtaaaaaaaaggagtttcagctcgtatgggctgtgtaaacacccgactgacgtatgggcccccggaaaaggacgagggcccctttgtcggtgttaggtatcttttcttcagtcgtttcagcttttaattacttgcttagtgcatctctgacaagattgtctcgcacaggttaaagcaaaaaaggcccggaagttttcccttgataaaaaaaaacgagaaagtatccacaagggcgacgatatataacaacaaacagaaaggtaaggtatatccacgggacaatcttcaggcacaacacgagttctagttagtccagttcttcgcttggtgcacgctccagcgtaatgaacaaaatgttatatagagtaagaggcgaaatcagtcgaaactatcatcagcgtcagctttattatatagcgtgatgagccatcaattcaaacaatatcttactaaaggataattttactattcaccgaaaggtacaatatttatagcgtaaaaattttaatatagaaaacttgatatctcgagatattttctcaagtacaataaattttttctttactaaatgattttggaatttcatcggctaaccttggtgatgaacgtagctagctccgccctttatatatgtactccattctaaaatataataatttttagacttcaggatttgtcataaaatataataacttctccattaatattcttttcccaaccaatcacaatccccaccatttacttttcatacatacctccactactcatccaatcacaactctccactactcatttctaattactttcttaataatcgtatctaatcttaaaacttcttatatctgggacggaggggtattattttaaaccaagaagaaacgtttcgagcatgacattgttttcgctcggataagagtcacgcggcatacttgcttcatctgagtactattgcaagtaaagatgaactctggcctttaattgcaaagggtccaggaacatcaaaaggaaagaaagaaactaaacaactgccatctccatgtttctttttgaacgaaaggtcatcctcatgtatcgatggactttaaagtatcgaaccgaaacgatactccagctgacattaatggaagtttttttttttctacaccaaagatgtatatatgtacacaaaccattacgtatgcacctgtacctacgcacacgtgagtgcaaccccttgtctcttcatcggacccatgatgtttattgtccaacataaaccacctaattggtaggtggaaatgcaaacctagacaattattgaaaatgaaattgtagtttctggaactggcaaagctagaaaaaaaaaagagcttaggtgatcggcgttttttttttcctattgtttagttcttatttggctacttgtttcttgaaataaaattttaaatcagccattaggtgatcggcgttttgttgtttgtttggaaaattcatagagcaaggcaatggctccaactgctgtcgattcgaaaaggatttctgacatcactgaagatggatcaatggacaggcgaggaaatccggcagttaaagcaaaaactgggaatggagatcttccatcctcttgctaggtaaagctatgttttactttaattctgttattcatatatctacaaattaactgttttaataagattggtttcttgtttattgaaaaactgcttttcttggattcccaacatgacaacgttggttgttgattagattaggttatgtttcagtcttcaaagaactatgaactaatattgtcagcacatagtgtgatcacaaccttatagcttgttatttgctagtaaattcctacttcgctgtctgagttgtatgcagttcagacttcagatttccaccaactggaaccttcaagaataatccttcttgcagagcttctagccagttgagtggcagccaaacctggaggttgatccaccgttggaaagctatcaattctgtactcttcaggtttaacactacgcgttttgctcttcatccagatttactctgcatgggcaataaccaacctgactaaaaccttacttcagaagaccgattgttgtgaactgtgttaaacctttgtgttcgtattcccgaaaaaaaaaaaagttcaaccttgtgttgcattaggacacttccaaagccatgtgcagaatctacctaatcttgtttttcaatatataagctgttacaagttggatttgggatcgattggacagttaattcaggtgtgttcctgatgcagtcaactatgggctcgtgacatgcgccttcttcggcgtcggggtgaaccttgtggtgttcctgcggcgggtgctccaccaggacaacgcagaggcagccaacagcatcagcaagtggaccggcacggtctacatcttctccctcatcggcgccttcatgagcgactcctactggggccgatacatcacgtgtgcaatcttccagatgatctatgtcacggtacgatggtcaagttaattatattattattatttttaattagctcttctgttgttggaatgatcttgctgaactacgcgtcgtgtgtgttgttctgaactttctgctgatgatcagggcctggtgatactgtcactcgcgtcgtggttcttgctggtgaagcccaccggctgcggcgccgcgggggagcactgcgacgcgccgtcgagcgccggcgtcgcgctcttctacctgtcgacctacatgatcgcgttcggcaacggagggtaccagccgtccatcgccacgttcggctccgaccagttcgacgagacggaccccagggaggcccgctccaaggtggccttcttcagctacttctacctggcgctcaacgtgggctccctcttctccaacacggtgctggtgtactacgaggacgaggggaggtgggtcatggggttctgggtctcggccgcggcggcggccatggcgctcgtgctcttcttgctcggcacccccaactaccgccacttcaagccgaccggcaacccgttgacccgcatcgcgcaggtgttcgtcgccgcgttccgcaagtggcgcgccgaggtgccacgcagcgagctcctgcacgaggttgacggcgacgagtcccagattgctggcatccgaaagatcctccacagcgaccagatcaggtgaatatcttgtttgaacgatgtgccaatgcactttgatcgatttgccgtttgactcaggcatcaaacagtgttgattcgagatatataatcgggagtggattctaatccctcgaggggatatcccctcgtatacctttttcttctaaattcgatgtaaatagttgtgaaaaattctaaaattttttttgacaatgtagagtataatgatacctactagtccaccaaaattcaagttcaaattcgatctacacatcgagaaaaaaaaacaaatttagatataaacagtacgctactattcatatgctgaatttgtcttttttatatctcgacgtgtgagttgagtttggacttaagattttgtggagatgtatatatgtgttgtatgaatgttatcaaattttttcagaatttttcataaccgtttagataatttttaagcaaatgagggaatatccattcgagggattagaatagtttcctatataatcgatgtgcatttggtggcgtgttttggtgttcaggttccttgacaaggcggcgacggtcaccgaggaggactactgcacgccggagaacatgcaggatccgtggaggctgtgcacggtgacccaggtggaggaagtgaagtgcatcctgaagatgctgcccatctggctgtgcacgatcgtatactcggtggtgttcacccagatggcgtcgctgttcgtggagcagggaaccaccatgaacaccaacatcgggtcgttccacgtgcccgcggcgagcatgtcggtgttcgacatcctcagcgtgctggcgttcatcgccatctaccggcgcgtgctcgtgccggtcatgtcgcgcctgtccggcaacccgcaggggctgaccgagctgcagcggatgggcgtggggctcgtggtcggcatggcggccatggtggtcgccggcgtggtggaggtggagcggctgaagcgggtgggcgcgccggaccagccgagctccctgagcgtgctgtggcaggtgccgcagtacgcgctgatcggggcgtcggaggtgttcatgtacgtggggcagctggagttcttcaacgggcaggcccccgacggcgtgaagagcttcgggagctcgctgtgcatggcgtccatctcgctggggaactacgtgagcatcatgctggtgagcgtggtcaccagcctcaccgccggcgacaggcggcccgggtggatccccgggaacctcaactccggccacctcgacaggttctacttcctcctcgccgcgctctcgctggtcgacctcgccgtgtacgtcgcgtgcgccgtgtggtacaagggcatcaagctcgacagcaacgaggagaaggcgaacaagatcaccgtgcacgtttaggcttcgggcctgtaactcgtgacggctcctgtttagatactgggatggcaactaggcttgccgtagtaataacgacgcgtgacagaatcatgtatggcccatgcaacttctctgtcacgactaaactccaggagctatatatagccagcccatgttcgaaccatgtattattggattttgggaataagttcacttggtgaccctcaaaagtgattaaaatctaatccgtgaccctaaaccacaaaaccggatattttaacccccaaactatggaaacctgtacaatttgactccctcggtggttttggaggtcagtttcactgacgtggcggtattgaccggctctcctttacacatggcgctgacgtggcatttagaattaaaaaatatgtgtgggacccatttgtcaatgacacagaaaatagattgtgggacccacgtgtcccttctctctcccctccctcagttccctctctctcctcgccgttccctctccccctctctctctcctccgcagcaggcggagatggtggggcgacctgcgagcggcggcggcacccgggctgagctccaccgtgacgaagacgaaggagaccacagcggcggcggcgggaggcacacgcggcggggtacaacgagctcggcccggcagtgggaggacga

SEQ ID NO: 64668 - DNA, 9448 bp, Oryza sativa
tgtcagtgggccccacaattgtgtgtgtgaataacaaatgggtcccacgtatactttttaattgaaatgccacctaagcgccacatcaatgctatgtgtaaagaaaacccggtcaataccgtcacgtcagcgaagccgtcctacaaaaccgccgagggagtcaaattgcaccggtttccgtagtttaggggtcaaaatatctggttttatggtttagggttacggattagatttcaatcacttttaagggtcaccaagtgaacttattccttggatttgtgctaaacactttgacttctgaatcttgtgacgatccaatagcttgaatacatgtgtgtggaatttgtagctttgagtttggcccaaacagcgagttggtgagggcgctgcacacggaccagcccacctaccccgcgcggtcgtgcggcggcaagccgcagatactgccaatgctggtgagtgtgcgccgcacgcggccgggacgtggcaggactgccgagtgccgaccacacgcgtcgtgggcgtcgatgacacgtacagactagtagtagtagactacagagaacatctactagcaattcgttggcgttggtaccgaggctgcttcgctcgctcgagcagtttgcacttgggctcgccatgttagcacagtccacagtgcgtccgagcaaggttggctataagaggcattttctcagcttatccatatactttctccgtcctagtaaaattgacgttcaacgccccaggcttatctcaaaaaatatgtcgctacacagagaagaggcactttagacgccaaagcaaatttaatggttgattcaaatttttgaatatgttaataatggctttgcccctttatcaaacgtgtggccaaggcgccgatttatgtactccctgttacacgtggcagtgagttgtggttactttattactgctggaaacatcctctagaatattctgagtgcatatataaatgctggaaatgacaagctgaatcaaatcatggggacaatttggtaattttgcacaacaactaatcttggttgctaaccttaaaacgtcaattttactgggatagaggaagtaatagttagctctttataattaatataggacccacttatctctcttatatagttttttggttcttgtatccaagccggctataagtttacagccagcttctcctctctctctcctccacctcagcatttagctagcttataacctatattataattgctcttacgcgcatcgcgccaactcacaaatcacgagttcgggtagaagcgaggagcacatttactgcaaagctacaattgtaacatcaggtagagctgtatccccttcgatgtgctaacgggatgagaagtagtagtagttgttgtcttgcgtattggaggaaaaaaaaacgagttcaagttattttagactctgtacttcgtctagaagcacaagcgcaaggctgcagaccggaccgcgtggagtatagcagcatcattactgaaagaaaacaaaatattgttttcagctgtctaaatatcgtccttattttggaatattgcaacagtagaccttggtgtacagatgatgacactcaattaacagcttgtaccgttgaaagctgcaacgcactgtgccatcttttttagaacaaagtgaggtaccacactaccttcttgaattgaaatgatggagctatagccatttcttcttttctgatctctgtccccgtagaacttagggcacagctagtggggatggccgtgcatcatcagctttctgtcacgcgagtaattctaccgatattaatcctgttagtccgcacatatggtttcctgcaaatctgtgcattgttcagcacggacgctgttgccagaatagacctgatcgaagcattgaattagcagcgacgcactctatatataacagcgtatcagtggattattattacccgttacacccacttcgcactgaagcctccccaaggaatttatctgacaaaccatcccaaattgccatgttgcaaattgtgccaaattgatatgtgctgcgccacaggactcaaaaataccagctgcaactctttgaagcttatctgcttcatgtaaatcgattgtgtgtaactgtttctgccttcttataaatatagccaggcaaccaaacctttccaaaaaataaaagaaaagaaaaaacacagctgcaactgccatgaagtcattttttttttgagaactcatgcattttattaaaagggggaaaaaagcaatctgtttctgaactgccatgaagtccagtccatcgctttctgccagtaagcacaatcccagcctcctagggagtactcgctgaccgtgctaccgtggcactgctctgtgctctgcctagtgcgtatggtcaccaaaccaggtagatccacgcatgtgtttggtttaacaaaactaccaaaattaccaaccccgaaagcaaaatgccattagtacatgactacgaatcactaagtacgtagtactgtactacctaagtaccgtctaagagtagtccccggcgctacaagaagacaacacaatggccgtcttgcgccgtgctaagctgctagatctagcacatatattttccaaccagttgcacctacagggacctaattaatcgacctaactattgggcagatcggagatatctcaccagatcagtgtctgaccacatggatgacaacgttgatactgtcacggaccgtgaacacggtcatctcgccaccagttttgggtgaccaagactgtgggtgatgttggacgtacactgctacgagcagcacagtgctctatatatctttgcagcacatgcaggatgcagttagaattgggcacgatcgttgcaggcgacaagagaattcacgcaaaagctgcagaggacagtaacattaatttagatcgatggacgaagcagctgattaattgcgtgttagctggagtacatagtatatgtcagcatatacattacgggacatgttatgttatacagtatattttatcggagtatacagtacgaacaccaatacaccaacttggggacacaagtgggcgcgaatatgatcggtctctgactctgatgaccaaaattaactaaacaaaatggaaaagacatgatataatactgagagcgtttggtctgctgcataccatgaagtttaggtcgaggaattagtagcctagtcgaaatcacgattcacgaataataatcaacccgttaatatattactgtatcgttggagagaaaagtgactagctaataataaatgaacatctttcctgtatgcgtgtatcttgctgaagaatatcctagctaatccgctgttatgcggcggccaaggggttgccgacgaagggttcctgaatttatgaaagaatattttccggcgttgcacactgcgcaactgcactttgatgctgaaaagacacaagctggcggataacccaaaggccaagttaggaggacattcgagggcgactcgctgagagatattttttgctgcaaaaccagttcagaatacgccatcacgtggccatgattgtcatcaaacgaaggctttggaacaggtagcgtgcgtaggagccatgcacaaggctaatcagtaatcacaaagcaaagctcgccttacgttatttacgagttataatcttctaaataatggcttaagggttgtgtacaagcaaacgatccatatctaatagtacgatccaacaatagtatgccatgtactatttacttcgggtcgacgagtagtttgaataaaatcgtgcactggacagaggacacgaccctgtacgtgttacgtactacagcaatgaagttagacatctgctgaaagaaaagtatgcttgcaaaaccagactttgcacatgagaaatgcgttagaagaaaaaaaaaaccagtacagtagcgattagtgagacaaggcctgggggattagattaattggagtattggacgaattaagtagccaagtagcgccacccatttcaaataaagaccggaagcaaaaatgccgttaaaacttcgaagtcaaatgctgtatttggttgtcaaagaaatcgcataatttttgtaaaccaaagtaccaaaccactagcaaaatctcaaatcagattgatctgaaaagaaaggtgacaaaaccactctctaagctacaggttggtgtcttcgctgaatacaaaataactaacttatttttgtttcagcccctgtataaattctagctgctgtgtgccttaaacttttgcattgaaaaccttaaagttaaaggacaaattatacatacatacatacatcacttgggccacatgtcaatggaagccgacctaccactttgtagaaaagcccaagatcccttcatatctcatccttcttcgtccgtttctcccggctcgcctcggcggtcgtctctctctcggcgatttcccatgaatctggctcggatccgggccatccggcccgatccacctttgccaatttccagcctctctcggtctctccctcgttgaagcctacccggatgcgaccgattccccccgccgccgtgcgccgcgccatatgctttctcctcgcatcgcgccgccgcgacaccaccaccaaacccctccctcctcacaagaaaaccccacccggccgatccctccagcacggcgacgcgctcccggccgtcggatggacgcagcggacggcccacgcggccccagccccccgatccgggtcaaggccgccccccgggcgcgcgatacacgtcgcgacacgtgtgcgggcgtcagattcccaatctccgacgtggtgtggtgggccccacctgtccgcgcgtcgggccccacgcgccagcgtcgcacggaccgcttttaaatagcgcatcgacccggtggattcggaggcggcctcctcctctcctcctcccctgcacagaccactcgtttcctccacaaagagggagggaacaagggaagggtgtcgcccgccccccaccccgatctgcctccgccgctccgctcctccgcgcctgcgaaatctaccaacgctaactcaggtgcctcccacattaccctccgccaccgctgttgtttcgtgattcttttcgatttcggtacggtgtgtgaaatcgctgcggtgatttttggttgttttcactctgtggagtttgtgttcttgggagtaatggtggtggattgggggataggacaggcgagctcgtcgtcgttgatctcgtctcgccgccggggattgatgggacctttttgaggtggattaaagcagagctataggattttgttgtgtctcctgggcagatctgtaggatttaccgataggatgatagtttgatatgctccatttccgcatgcttctgtagttgtgtaccttatctccatcgctatgccattacaactcattgtaggaacttttgccaaaccttttagctattcccgttaatcttgtgattaaagctgctacctttacccaccaaagctgcctcctttggctgcatgcttccatcatggcctctggcccctccatgttgggattcgtctttcaacgcctcaggacgaaatggccgattactcttcttcttttttttttctgaaactcagcgctatgggcacgagtcacgacgctgacaaaccgacgaccttacacacggacaacatttcaagaaaagaaaaagtttgattcttgtgcggtcgtcgtttctggcattaaaaaaaaatctctctctctttttttttcgcctatggaacctagccggcggcagggcacggcatatgcttctcgtgctcccggtggtgtggttggaaatgccactgattttgtagaaaagaaagcgaaaggaaaaaataaaaaagacatcgcactcacgcgccgggcagcagcctccgccgccgccgcccccgcccggtcgcgggcttggtgggttgcttgacctagcaaaaggcatcgtgatccccaggtcgctccaccgtcagatcccgttcgttgcatttggacggtgacgattgcctcttactttccaggcaaattatcactgttctctgcataaaaatactgtatggtctggaacccatatgcccatcgtcaggcagcagctgcatgtcttcgctaggatacaaaagtgcaggggtcacacagcctgcaaaggtcggcagggtggcgctgaactccagccccacctgacggcatgtttcaccaatttatcccccctctatctctgtacatttccagccagagataagctggacacgcagaaatgaacaaatcgtagattagcggatctggccccccttacctcttcttggatttgcatccaccacttgcagtatgatagttcacacaccactagtgcatgcatggctggcttgtctgctattagctgcatgtgctggtgatttccagccacaaacaggtgcagcgagctagcaatcatcctaatcaaacgagtgcagccgtctaatcggaatacaagaaggccagatcaccagcaccacaatcctggagcccgtaggaaaaatggtaggctcgtgtgccttccaagtcaagtgagacagtcgcacatgaatctgccttgtgggatggcatttgcgttagactagacgcgtgcagtgcacttggttaatttgaccctagctaggtaattatactaattagtcttgatggtactgttccaccaacctgcaggagcaagtggttttcttttttgcaaagattggtgtctttttaagagtagaggaaacttcctgtgtgtttaattgttcgtcaaaattgaccactcattaggatatgacgatgtctgatgaatatggatagcttatatttgaccgcccagtttgtatggctggatttaatgaccttatcataatcagatatggtaccatttttttcccccaaacaagtgataaattccttctgcacacgtttctggggatggtcctaggcatcatccttcagagttcagactatctggacaaagtgtgcgttccgacatatgcacatttttatcgaggaacatataactactgtagtactagtatttttcaaaaccacattacatcccaagaccaaacctttctcgcttgttgaatcaatcaccatttccttttcgtttactgcaccatgctaagcgtaattaggctattcccaactcaatgattaggatgatgtctatatcattaaataagttatcatataggataaaaaatgatgtgacaagtgaataaatgagtaaagagaaggaaactatgttttgcatgagatattgtttctacacaatatccaagacatcatgtgagataagaagcattaaattgaagtatggaatagtgatgtttgtattggaagagtagtgtctagggggtgtttagatgaggctaaaactttttagcccatatcacatcggatgtttggacgctaatttggagtattaaacatagactagtaaaaaaactaattttataaatgagagctaatccgcgagacgaattttttaagcctaattaatccataattatcaaaagtttactgtagcatcacattgtcaaaatcatggcataattagactcaaaagattcgtctcgcgaattagtccaaggttatataatgggttttgtaattagtgtatgtttaatactctaaattagtgtctaaacatccgatgtgacagggacttaaaataagtcactggaaaccaaacaggcccctagtactagtttcttgatgctgtggagtttatggaaactatgtctaatgggttgagaatggccttactagtactaattcactgtgctatggtacagtgatcagtcttgtcatcttgtggtaacttgcgcaaggcagatccgtagcagtacatgtgaacttacgatgcacgccctagaaagcgaatctgaacatgggcaagcacatgctgctcggctcgctgctcggaataacctatcacatatactttaatcaagaaaagtgatggatcgcatcatgggtgtgccgccctttcttttcctgggttgatgctcctcaactcgtgcatacgtaatctattgcttattggcttagttgcgagatatttttgttcgtgtggggtttccgtattattgcattataatattgctcaaattgcaccttctgatcccactacaatattgcaatcgattctcactttctcatcacctgcgattgtgattgttgttgtaagcagcagatgggtgccggcggcaggatgacggagaaggagcgggaggagcagcagaagctgctcggccgcgccggcaatggcgcggccgtgcagcggtcgccgacggacaagccgccgttcacgctggggcagatcaagaaggccatcccgcctcactgcttccagcgctcggtgatcaagtccttctcctacgtggtccatgacctcgtgatcgtcgccgcgctgctctacttcgcgctggtcatgatccccgtgctgccgagcgggatggagttcgcggcatggccgctctactggatcgcgcagggctgcgtgctcaccggcgtgtgggtcatcgcgcacgagtgcggccaccatgccttctccgactactcggtgctcgacgacatcgtcggcctcgtgctgcactcgtcgctgctcgtcccctacttctcgtggaagtacagccaccggcgccaccactccaacaccgggtcgctggagcgcgacgaggtgttcgtcccgaagcagaagtcggcgatggcgtggtacaccccgtacgtgtaccacaacccgatcggccggctggtgcacatcttcgtgcagctcaccctcgggtggccgctgtacctggcgttcaacgtgtccggccgcccgtacccgcgcttcgcgtgccacttcgacccctacggcccgatctacaacgaccgggagcgcgtccagatcttcatctccgacgtcggcgtcgtgtccgcggggctcgccctgttcaagctgtgtcggcgttcgggttctggtgggtggtgcgcgtctacggcgtgccgctgctgatcgtgaacgcgtggctggtgctcatcacctacctgcagcacacccacccggcgctgccgcactacgactcgagcgagtgggactggctccgcggcgcgctggccaccgtggaccgcgactacggcatcctcaacaaggtgttccacaacatcacggacacgcacgtcgcgcaccacctcttctccaccatgccgcactaccacgccatggaggccactaaggcgatccgccccatcctcggcgagtactaccagttcgacccgacgcccgtcgccaaggcgacatggcgcgaggccaaggagtgcatctacgtcgagcctgaggacaacaagggcgtcttctggtacaacaacaagttctaactgctgctgctgtgaaatcagcatcacacatccatagccaagcagcaaacaa

SEQ ID NO: 64669 - DNA, 1530 bp, Oryza sativa
gtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcagctgacacttttttcttctttttgtactacagcaaattcaatcctatggagctggagctggagctggacctggtgctgaatctattaggcctgcggcaggtggcaatgctggatacccagttgaggatcgtccaatgatggctggtgggggcatggaagccagaaatattggctttggtggtgggatgccagagcctccccttccaccagatgcatcaaatacattattcattgaaggaattcctactgattgtgcacgtcgagaagtttctcgtatccttaaatcccatgcctttttctgtctatctttaatctttcatttgcacaaattgtgggtgtaaattattcataatatgcctccatctcttagctgctggtccttcaccttcccccaagatatcttccgaccatttgttggttttcgtgaggtgagacttgtaagcaaagaagcaagacatgtaagtgagctttttggtgctgtcacgcctggtctcttgtttcgttcttgttcatccatctaagtgctttgctgttaacagcctggtggggatccaattctactctgttttgttgattttgaaactgctagtcaagctgctattgctatggatgctttgcaaggtgagtcagtgaactatagtttgttgacactgagccatttatcaccttttgatctcaaatttcttttggctgcgtaatgcccaattaaatctgacagctgtgggtacaccatgtgaagctgttgatccatctctcctatcagtgtcttatgagtcatgatattgaacttgtgtgttttcttctctatctttttccctgtttttagttatctcattgtcatgcatgcttataatttggatgctttgtttaccaagatctgatagatgcttgtgatggttggtaatttggggtattttgctaaaagccgacagtcagtttctttatggttgaatagaactcattcgactgaagtatttgtccttaaaattggtgtggagttattggccagcagctaaaagtgggctgtgaaaatcttgtctgttcctaatttatcacctgaacat

SEQ ID NO: 64670 - DNA, 26297 bp, Oryza sativa
cacttatgatgcttgtttttgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaaattacatggtagttgactggtcattgaaccgttcgtttgattgcttaatttccatgttttaaatcatgaaaattcatggttaattttgcaggctacaaattcgatgaacatgatcgcaattcaccccatttacggctccagtttgctcgttttactggccccaggggaggttcaggacctggtggtggtcgtgttaggcgttaagttgttcgtccttttatcaggtgatttgacaactctggctgctcaatgtttttttagaaacaacttgacctcaagttcttcggtggaccagataacatgagtcaatcgcttttcctaccttgtaggcatgatcacatcgaatgttcaagtgaaatgatgatagttcgttggtcgctctagatatattactccatagtgctaggattggtaaccttctgttgttccaagttccaactttggtgccttggctttgtgagatgctttctgacattaactagttattaaacatcaaagctgaaaacaattcgtggcatcgtgcagatgtgatgcttatggccggttatattgggatatatatatatacttctggagacaattttgccgattaatgcgtgttgggagaattttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaggcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctaacagcatggagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacaataatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttccctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaatagcaattcaaaaatagcaggtggtgggcactttgatagcagcatttgtgtaccttggaacagcatggtggctcatggatacaatccctaacatatgcaacaccgagctcctccccccaggcagcccttggacctgcccttatgatcatttattctatgatgcatcagtcatatggggccttattggcccacgcagaatatttggtgatttaggcacttattctgctgtcaactggttcttcttggggggtgccattgctcccctcctcgtctggtttgcacacaaggcattcccaggtcagaaatggatcctacttgtcaacatgcctgtgctgatcgccggaatcagccagatgcctcctgccacttcagtcaactacacggcatggatatttgtagcatttttgtcaggttatgtggtctataagtaccgtcgtgactggtgggagagacacaattatctactttcaggtgcccttgatgctggtttggcattcatggctgtcttgctatatttatgcctaggactagagaaaatcagtttgaactggtggggtaatgatttggatggttgtccattagcttcttgccccattgcggaaggtataactgtacaggggtgtccagtggcaagtgcatagccaagtttcttctcatccacagtaccgccggcaatggtatctcaatcatcttaaggaggatgcaaagatcaaagaaccatgcagagaggctttaaacaactcaaaatgaagaccaaaaagaaaatgtccatatgttacaaggaagatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggccgccgccctcgtgctcgccgaggaggaggatggtggcgcccgtgctgcgcgctagccccaggaagtcggtcagcgcggcgtcgtcgcggagcaggcggtgcatggcgaggacgcagttcacggccacgcactcgccgcgcttgacgtggagcatccacaggcggacgtcctcgagccggtcgaccacggcgtggaactcgaacgccaggccgagcgcggcggcgacgcgcgccagccgcgctcccgtctcctgcagctcctgcctcgactcgccgactccggtgatccgcacgtgcgccggaggcaccgcccgcgcggccaggctctggagcaagcccggccattggagcccctgcttgatgtcgaagtcgatgacgtggacgcgctcgtgcccctcgaactcgcggaggaggcgctcgttgagcgtgaagtgcaggaacctcgggatgggcgtgatggcgttgagtatccgcagcgccatggcgtcgtcgtcgccgccgccgaaggcgtcgtcggtgagctcccgcggcgggccgatgtcgaacatgtgcggccacatgcgcacgacgcggagcgcgagcgcctcggtgaagtaggcggccacgcggtgcatcggcgtgggccccgccggcgaggccatctcgccgagccgggccaggtagtagttggcggcctcgtggttgccggcggagagggagtcggcgcacgcggtgagcgcgcgcaccagctccagcgcctcccgctccgcctgccccggcgccggcacgccgttcctcgcgtcgaactcgggcggctgcggcggcggcatcatcgccgacgagccgccgtccgtgcccgacgaggacgacgagtcggacggcgacttgctgtactcctccttcttggccgcggccagcgatggccccgcggcggccatgccgtgcgggaacgccgccgcgctcggcaccaagaagaccttctcctcctccgcctcctctccttctcccgccgccgtcgcttgcatcgtccctgcaatggattgatggaaccatacctcatcgccgtcgccgcccatccgcgtccgcttggcgcgaacaatggggccatactcctcgaccgcgtcctcgtcatgcgcccgcttaacggcgcggtgggcgccattgccattgccgccgggctccggcttggcgccccaggacacggactgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttccccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactaatttatgctattttgattagtatactagtgaataattagataactactatgtagtggacctcgagtaatgtagtggaccccgggtaatttttattctagattcgccgctggctccaatcctcccttgcagatgaaaggataatctaaaaggatcgattaggcaatcagcaaatgcctctgtcaatggagccaatggtggccacctgctcaaaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtccccagtgcagtttttccttgttggttgactggtggtcaacgtaatctcgaccgcacatctctgatctgacggctagtggtagagtttgactggttgaggttgatatttcaccatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtacactttttggagcttgtgttgtgtaccagcgagttaaacacccatgattgtgtttcctagtgctggtttgtttgtagtgaaaaatttcctgatgtagcgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaattgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatataaaatttaaaaatatatatatatatatatatatattcctatatggactctagactcgtcttttaatatttctttttttaattctgaattttccataaattgtatttctatatagactctacgctcttcttccaatattatttatttttatttctgaatttttattatttctaattgtatttctatgtggactctaaactcatctttcaatattctttaatttttagttttgaatttcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttctaatattcctttttttaattccgaatttcttttttttcttaattgtatttctatatggactctatactctacttctaatattccttatttttaattccaaatttatattatttcctaattgtattcttatatggactctatactatacttttaatattccgaatttctgttatttcctaattgtatttctatatggactctatactctacttttaatattccttatttttaattccgaatttcagttatttcctaattgtatttctatatggactctagtctcctcttctaatattccttatttttaattccgaatttcaactatttcctaattgtatttctatatggactctagtctcctcttctaatattccttattttttaattccgaattttaggtatttctaaattgtatttctatatggactctgttttttctttttctccgattaatgtgagaatttctaggccatgagagcgaacgtagaaattctattcctttaataatataatagatttttggtcgggaatttcgaagtttgattaaatcttgttctaaacatcgaatatttatgatcggaggggtagctttgattgatcatggcaatatcaacaatggttgttgcatttcagacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgcatgtttatcacctgaaaatgatccaaacatgattccattcgaatgaaaatttaagatttgatttgattaacaatatgtagttttacacattataccttaaatctgtagtttcgtggtaaactcggcattaaatctgtagtttttttatactccgtcgtaaatatgtagttttacaatagtttggtcaaaatatcagtagttttcggaaaatactaaaaaagggggatcc

SEQ ID NO: 64671 - DNA, 2329 bp, Oryza sativa
tacgttcagcttctttacggtttagaatgcggttaaccagaattgactttcatctggtaaaattaaacatgccgctaaacaagggaccataacaaatagagtgaaatttggaacaggacagccaagtttgtccccaaaagctcgattggttgagcagtctgaagatgagaagcaaatgcagattgacagaggacagatgatcaagacatccttaatacaatctagaagttcgtatggtaatcacagtatggtacatatgaaagaaatcaactgacctaactcgatacaaacccaacaaaagaacaagggggtcccaaagtggcacccgatcacatcaaacatctctgcctcgaaggacccagtattgtcaagaataacatcagccaagtgtaaaataataatacacaaggaaaagaagagccgcgatgagaaatgtgtacattacaaaggcagctgggttctgcttttaacaaccatgtccgtgccctactgaaatctcagttttctccttatacttcatggttgctaatttacatggataaactctccagctctttgagaaagcggtttcaaagatcatatacattgctaaccaatctatcactcgtgaacaaatatgtttgtagttcaattcgtcaggcttccttacagaacaaaccacaaatcaatttgagagctggaatcttcctgtcggtttcctctttcgccatccctgaacaaacagttcaggacaaataagcaagccaacatttttccagattttcatacgaattgactgaatactttggaagaatgcacttacaaatattgcatagtaaaagagtgtgagtatcgcaagagccacaaagccatactggaaaacattgtacctgcatattcagatgttaaaatcagaacattttcaaaagtttgatgctccaatatccaccacatggatatatccagcttattcgagcaaacaactgtaaactgactatggatttgcatgctagatacatacttgtagagatacttaattccacggagagattgcagtgtgtggccaaagatctcctgagctgcagttgcttgcgcataataagcaaaagctgtggcacagaactgaatcacactgcaaaagattttagatggcctcttagtggagaaaattaacagataatcagcaggtatgcatatgttatggaggaagcaaggttgatgaaaccaacaaagtcgcatgtcaacatgttgaagcgatttttcagctgcactaggcacaagctaagctacgtcaactcaatgtttgctttacaaaagttcttcatttacactactgctaaccgttaaaggacacactgattttatatatagaaacaatttcagatatatgcaacaaattcacaattaatagacgctaccttgtcagcatggaaaaagttccaatatggaagatggcatcataatttacaaaaataatagcaataaacaattacatctaaaagaagcctcagtagcacacctgatggagcaaagtaggatgagtccaacattaaacaggaacgagttcatcaaagttcctccccatctgaaaaaaaatgcgttatcaatgattccaaaaaagatactacatagaaaaggaaatgccatgggatatgtcaaatacttcattgggtgaatggtgatgaaaactaatttcaaacccagcatcatttccccagcaatcactgctatgaggagatagaaacagaagaatgcaaaggcagcagtcccaagcagacctaatacagaaaacagaatattggtcaagctactgtcatcaataggacgagttcagaacaatgtaatgaacagaaatataccccaaacaccatccaattttacgaagatttcattcaggaaggaggacaaaggagggtcaatcaacaagtatatgacgatatgtgcaacccaagcaatcgatataattaacctgagatcataagtagctattagaagacaattgcagataggttggactagaatagaagcaaagtccgtacaactatttacacatacccgacagcaccaaataaaagttttccaatgtaaccaagaactgtcaaagcccaggtagcctcagcctgcaccatgatggatgttaagccagcaataaaccaaaagaaacaatgtaaataggatttcatgttcagttacctgttctccttgagggtacatctcttcaagagccttcatgtcatcttctaaaagtactaattcctgatgattaaaagggcaggcaaaacataataagagcattaatagagcattacagaaattattggcatgtggtacacaaatggacacgagtgtt

SEQ ID NO: 64672 - DNA, 2073 bp, Oryza sativa
gcccgttttttctgcagcaaatatgttcagtctcaatttcacattgaaaatttcaaagtgataattatatgtagtagaaaaatatggttctaatgaatgctcataattgaaaagaagtatgtgagaatataggcacctttatatattgtgagcgtgtaatgacagcttttgggcgccggacaaatgagaatataagtcccaatggaaggcaagcaattccaacaccaccaaatatctaccaaacaggaataggaaagttgtaaaaagaaaccagcatgattgcagcagaattggatgttggaaaggatccatatttcaaattgtttctagtacagcttacactcaataaaagacataaagctatcggtcacatgcagaccagtagagtgaatagatgtagctatacagaaacggtgataaagcaaaacatgaagattgaagtaaaactcactgtgaagagaacagatccaacgatggtagcaagagcaaccacatattcagggaaggtagcgcgcattgtccaagttgtttgagagttagcaggtgcagtgtaagctgcgcactgaataaaacaaaccgtaaagcagtttagtcgtagataaaatgccaaaagaaaggtgtcgatcaaatgttgctattggatggggagcacataacatcattactataggcataagaaagcataatttgattgattgactaacctgcttgggcgatgtactgatgcaaggttgaccagttgagaaactagtgaatgaatttggaaatgtctcaactgctgaagaaagatgcctgacagtgaagtccactttgccaacaagtcctgcagcagaacaatgaaagtgaggtcatgtaaagtgaaagcatcccaaacccttagaagccacggtgttcacaagaccactttttttttccttgaaaaaaaacccttttttttgcagagggcattcaagggacctagcaggagttcattttaatacatcgggtggaagaaagaaacaaggattatataagaaacagcgcaaaaacaaaactaccaattgtgaagctacagactactggtcgataagaaaacaatttgcgggtataatgtggaccggggagatatactacacaacaagtgcaaagctcaaacaggacaattcagatctggcagctgccttcctggtttgtacagcattgattgctcgaaaataagtactaattgaaaagctcaaagcttgagctagtcactccaagtgaagccagaagaattaacactagtaaccaaccaactcaagattcaggtagaacaggtcacatagcaaattcgaacagattcaaaaatcccactccaatattactactagtctagaaattttagcatgataggcaaaggagagcagtgatccgcaccgtataggatgccgaggatgaggccgcaaaccaccgcggagacggcgacccacaggagagcggaggtgagcctcttccccactgacctgcaggaagcaacaacacacggatccaatcaacaacattcagtgagagtttagcagcagatgcgcaatgggatagaggaaagagtggaaatgtatatgtatactacttacttgtcctggtcgccctcgtagtagaacatggcgaaggggatgacgaggaagacgaggacggcgtcggcgatgtagacggcgagccagagggtcttcatggggagggtgagggagcaggcgccgctgtagatggcgcggcggcaggcctggcggttggcgacgtcggcggggagcatgaggatggagaggagggcgacggtgatgccgaggacgacgacgagcttggggaagtaggcctggttggcgtcgtcggggtgctggtagttgatgagcaggtagacgctgacgagcaggacgaggacgctcaccaccgccgccacgatcaccagcgccacgttgaagtcccccatcgcggcacggtaccagatctccgctactgcgcccgcccgccggctagggtttgggcggcggcggcgctgcggccaccggcggcgtgcgggatctgggggatttgggggggaggaggagttggggttggggg

SEQ ID NO: 64673 - DNA, 7988 bp, Oryza sativa
tacttaattaatcatgcattaatgattcattctattttgcatgcgcgagggattagtttctaaaatcaacaatcaaatacagtttaaggggttgtttgattcgtgactacatgttgccatactttgctacacatcaagttagctttaattaagttagctatgtattcggttcattgttacacataaccacgattttttttctctctcatcttgatctcatatgttatttgtcttgtaaagtgcggtaagatcatagctttctagtcaaagcgttgcgttagattcatagtctaaccttagctatggttggtgaagaaatgctactagcaacctaaaaacacaaggtagtagataaactaaacatcatactgctatctgatatgatattgtcctaacatgttaactcaaatggtgtggtcaaaaaatttattctatgaaaaataatattatggatgatttgttttaaaaattttaagacaataaaggttcacaataaaaaaaattatgaaaagaaaccggcagcggagggtcgacacaggcatacagtgcagcacgggcaggttgggtttctcagcctcatccggtggtattgcttgtctggaactaccgaagctgaagctgacccggggaaaggtccatttggttggtagatctggtgatggcactcatcaatcactttcgtttcaagttttgatgatttataattaacgtaggtcggagtatatgttttccccgcttttcttggttcctttttaccttcgatagatggcaacaatttgtactattgaaaaccacaatatcggctggtaaaacataaataccatatacgaaaatcatgccgtgttaagatgtctaaattaatactattgtgttgtgtaaattaagtagcacagtactagctaatcacaatacatctggctgtcacatgctacgagtacgaaggtcataggaggcacctagcagatgacatagaataatgttcccattggggaatgtccaatgttccttgtctgctcttaagcataggctaggcatatattattaaaaaaaatgcaagacaccaatatatccaaggaaataaaaaaaaagcaaaacaatgagtatatgagcatcctggattaattaaactactctattcgcttaatctcaaacaatatacattcagacaggacaagtcagtatctatgggcttcttcgaagggcaattttgccgcagcgctacggctgcagcagctcaatttgctgcagctttgccgtgatatttaacagcatcgatggctgccgaacgctacaaaagttattatcatgtcggagcaccatgccttgtgttgtaaaagttcgaattttggcggatactttacctcatgcgtattacttcctcgctaccaagccaggtattatattcactgttcagccgtaaatcgagctggaaatgaacataaaagaatttatctgataatacatacaccacataaatttgcatgatgtcacgccgcataatatatggggatggccgtatttgtaaatttagtgttttattagtatctcacaaaaccttgccgtttctttatatctgcaggtagtaacaatgttaaagctaaagctcaaagactaacacaatctgctggagggaacatcaacatcttctaattttcatccaaaaaggaggcagcattcataaattcattcttaccttggcaacgaccaaaatatttacataaaataagttttgatctcacatacctgcggtaaacaaaaagttaagcatataaacattcacacatcagcagtatttgtagtagtcacctcagtcctcaaatatcaaacgtagcatgagatgatacctcaccagtcaccaccacagccacaaggctttgacaacagtcctcgatcagatcacggtcataggatttagtgggaaaaaatatttacttggattagtaaaaaaaatgcttacatcatggaaacatgtcgaactgttgggtgtttcctcaaagaggaaaattttgcctcctggctttctttcaaacggagttatttgctcctaagctataaatttctgttccccgatatctaaaaacctaaccattcaatttacaatgcagatatggggaagccttctttcattcaaatatggtttgcattttcccttgcaaaagggaattatgtatatagtctatgaaacctctaagctaaccgcggcagcatcgatggcatcactgttattctgctgtgaccacaattcagcatatcggccaccctttgacagcagaaaatcatgtggtccttgttccactacctccccattctccaaaacaataatctgaaaatacaaattttgaaacaagatttataaaagaatcattgaagtgtcatcaaacaagtattcatcagtatcgagtataatggaaagctctgtagctcaaacatatgaacaaatgataaatcagctataattgagatctagcccatgatggtaactatcgatttcttgaatcgatgcaaaagaaaatctgttgctgttaactgatacattactctgaatccctatttttagttcaataaatcatattactttcacaaaatgaagttgcaggtttttttgttctaatgtatttgcatgaacatgcatacctcatcacattgcattgcagttgtcagtcgatgtgcaataaagatagaggtacggtcaacggacaaagtcttcagagaatttaaaattgacgcttcggtggtgctatcaagagcgcttgtagcttcatcacacaatctggtataaattagataacaaaaaaaataagcaaagggaggaatgcagtaaactcatcttttgcaaaattagtgtttgttaacagtgtgaaataattcagatttagcagggttcactctgaccatttggcacaccatcaccatgacatgttaacttcatacaagggcttgcataggaacaataaaaaacagccacttgctcaattgctaaagcatggtaatgctagtcagacaacgctgaatctaaagctttttaaggctaaaatggaaagagggaattacagaatggaaggttccttcaagaatacacgagcaattgatactcgttgtttctccccaccgcttaactgcaaaggaagtaaaatcacagattttgagacattattgctaggaccaacaggttctgactattctggatttggcatgtcataagacactgcatctcacctttaatcctcgctctcccacaactgtgttgtacttgtcaggaaagttcataattgtatcatgaatagcagcccggcgggcaacgtcataaacctgtacgcaaataaactttagcttgaacaaggtcaaatgaccctactccctccgtcccaaaatataagggatttatggggggagtactataacttcataatgtaaatgtattggtagaacacagtacctcctcatctgttgctgataaccgcccatattgtatattatgcttaattgtgtcattaaaaagtacctgcattggataatgcattaacagtgtgagctactgagctcttggagtgaactgtggtaactcctaactgatatgtgaaaagcatgttgatagagctacttctatttactcaacaactttacatatgctaactaaagttgcacaagggcaccagaatgttccaattgtgtatagtctacatgctttatccatttagcatagtaaattcaataagacaagaaaagtaatgcagcattgacagatttagagcagtagatagctaaccgtatcttgcggtacaacaccaatacacttccggagactatccagtgtcacctctcggatatcttgcccatctattcgaatctgcaaagatcaaacaaaaggcatcacaagaatggcaagcttgatacacatctgaagatatacatgctataaaacggatatcaatttcatcatcagggaatcaaaatggaaatagatcgttctttgttcttacagatcctgaagaggagtcaaaaaatctgaagagaagcctaagtatggttgactttcctgtagaggaatacagttaatgaattgttcgttgatcacataaatttgaattttgctaatattgataaaacaagatatctcattccatacaaccccaaaaaaatcactatagtcagccttgaatcagacataaatagacaaaacgtacaaccatgccagatggttatttgaaatgaccttatcagaccataagcatgtttgtccaaattatagaccaaagagaacacctaacccctaattttttttagttaacccaaaattcagattaaagccttaagagacagcccctgttggatattaaaaaggcaaacatttttctaggaaaataacaattacaatatacacccaaagcttattgttgttcagtataggtaggccaagcaggctttaattagtatttgaaaacatccattgctagaaaacttgatatccttcattaataacttttctctctttgccatggcatggaaaaaaatatggaagtattggcttgtgctactctttaatagaaggggggagcccgggaaacaccaaaaagcccatcctctttttaacaaaacaatttgctgatacgaccatgggagaactcatacacgccttcaacttttgagtcaagttaaacaattggtagatgcaatttgacaaaaaaaaagttttaccgctgccactagttccaacgattgcaacactctttcctgcaggtacagtgaacgtggcacccttaagaatcttcctttctggtacgtacctggaagaaatcagttccttcaggtaaactacaacattaactcagataagtctactttacaagttagactacataatagatagtcataaaatttgcttaattgtacttagtgctttgatagattccataatgatatattgccagtcatttacatcccaatatgcacataaattgttgacccacatatgaggtaattaaaggttgttcaaattcaaatcgtgacagcaacgtagatccctaaggcagcagtatctgatactgttttactcagatgccagatggtaaaaaataacaacatgagaatattttacctatttgaacttgattgagaattgaggcgatggtcaagataaaatttaaatattacaggagagcacaaacaaagagaaccactataacaaattaacttgagcaaaacaaggaaagaaattccatctctacggagataaatgttaggagtgcttcaatatttcactttggtgttcagatgctctgagagacgtgactttttaaggaagtggtacaagcatgtaataagtaaacagaacgcaaaatttacccaaaatgcacgttctcaaattcaatgcgtcctcccttgaactgcaaaggctgtgcatgtggttcatcctttattccaggtttttcctgaacaaagtgaaataacagcaatgaagtttctggggttgtgaaaggatgaaactgaaactgcaagccatttaggcccccaacagatagtcacgaagtttttacctcaagcaattgaaacatagacttcatgtcaatcaggctttgcctagattctcgatagacacttccaaggaagttcagaggcaaagaaagttggaatagaagaccattaaccataacctagatatcaaaatttaatcaaattaataaaaatcagtcaaaaataaagaagaaaagcagaaaactggcaacatctggaactgatggttcatggttcaaaattaactattgttccaaatccacataattagttcataatcaatgatcatttgacacccctcgaagtggcatttgatgatttgccaccgctctgcctttgatacatggaccctggggctacatgtcatagaaacatgagtggcaaataatcaatttgacactctaaaggagtagcatatgatcaaaactttccagttagcccttttcacttaaacaaccttcctgactataaaataaacataatattgcaacaacatgctttgccactgtatgaaatggatatggtgctaaccgaacatgtcaaaacgggataagaaatacttgcatcaaataatatataagcggatgtcataaaaaattaccaaatcaccgacagtcagagcaccactcattacaccgtatgaactcaaaaccatagccgtggataaagccgagctaaatatgatattttgtccaaagttcaggtaggcaaggctactttgggttttcagtgcagcatcctcatactctgaccaaattgtgaaaaagaaatagtaattaatagatcaaattttataaaccaatttacgatatatgccaaagcaacatgtcagctaggattcatcagatttacatagcatataactaagcacttgataaatcaatgtgtacaagctcctaattgtttgtgaagattgaaaaaaaaaatccaagatgcaatatcaaccctactgtttctcatggaaaacattttccacatgtatttcatgcctcaatataagtttttttggtagtttttatagaagatgaaaataacattaaaaccagtgaattaaatgcatagagtatatctttcaaaaaaaagtgtatcgagtaacatatgcatgtctacacgttaacaaggtttcttcccagaatgaacattatatatgtactcactctttaaatatttgtcatacttctcaacttcaaattgttcattgttgaagtacttgacagtctggcccaataaaggaagttagaaaaaaaaaggttaatacaattagaatatgaaagcttaagaacatagactagatgccaggccaattgaaaatcatggtattacctcatagttcagaagggagtcaactgccactgtgctagaagcgttatcagctttattcatggctgtcctgaatttggtccgccactgtcataataatgcattacgagtcaaggcattagtgacaaaaaaacagcaaaaaatcttgttagactatgcatggatgacagacacggtctgatagagcacatcattcacacctgcgtcacagccaaggtgaaagcaatataagtagcaacagaaactgaagtaatccaagcaaaggtggaaccaaatttgtatgcaagtatacttgacaccataccaatctgtaaatggaaagaaaaaaaacagaaggcacacatcagacaaaaatgtaaaatgtgactggcatacattacggaaagttagaaacaccaacattgcgcgtatatgcatagttgatgggatataacagtcaatgacaataatctgagtacctccaatattgtgggaacaacattgaacaccatcactgtaaggatgtaatttatcgcacgactacctcgatcaattatgcgatttagggcaccagtttgccggctgaaaatatagaagccaggtaaaggcatataagagctcagataattttcaactttccagttctaaaactcatgaaatatctgattatttgcttgtttcttataacttgtttccacaccaattttcagaagaatcaaagtgggatataggctataaccaccaaaatagtgcagccctagactaggtttctcatcatctcccatgcgtaaatgctgaaatatatacatgcagtcaagctacctaatttggcaattccttgcaattatttgctacaacttgtaagccacctacattaactgtgatgcttttctatatattgtattgtgcatgtgtgcattaacggaaatatatcatttgataaatttaagataaacaaacatataagatgaataggaggcattttctagaagtaccttagatgataacgaagatcaagctcatgcaagtgcgaaaatacctgcaacagcaagagctcagaaggtaagataacccataatttaaccagtaaggtagtgtttggttgcaaggatgggatgggatgggatgggacgaacccacttttaggggtgtttggtttaggggtgggtgggatgggt

SEQ ID NO: 64674 - DNA, 6994 bp, Oryza sativa
  unsure (1)..(6994): unsure at all n locations
gggttggtccctggagaggaatattcctctcagatccgggaccaaccgatccgccaaaaactggcggacaaactcgtcccacctgggacgagcgacggcgtcaccgcgccatccaccaccttcgcgagctccgccgggcgcccacgagcgtcgccgcctcgtccacacccgccgccacctccacacgtctttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccgcctccacgagtgccgccgctcatccgtgaccgccacctccgctagcaccgccgccactccactcagatccagccgccgcctcgcctccgcgcccggcgcctcctccgcttggtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctctgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactacctaaaggagcatgtagctttattagcataaacagttccatatgattaaaaatgacagaaaatgataaagaattatcatagtcattacagatgggagtgcacatcgggccagtagcatgatcaacagtcaatgaacagctagatgaggatgcagatgtcaagatagtaatagctattttttaatgattttttctcaagcttttttttccatgaatttaatttttttaatatataaatgttgtggaaagtactgtttacaatactagcaacactacataaataagacaagtacatcaatgcgtagaaagaaataaaacttgagataaacaaaagattcataaatcataatgtgctggaacatctagataatagaggaatttagtagatggttggaaaaacatgacaaatgagtggtaacattggaataaaaaaggaaatttcaatagttaccgtactggagactgaacggatggctctcaatgtcactttagaaaagacagcatttcgcagttctggcaacagaaatcgacgaataaatcagtagaatcagtatatatttcaaagaggggcctggcaatgcatgttgctccaagctcacgaaaggaactcattttttcagggaaagaaacaaccatgcttttttttctaaccaaaaagagtttacctgtacaggctgatactcccgatcgtgcaattccatatccaatcagaacagctgctgggcttgcaaagagagccaatagggtagcattagcctctgtgaatgatgcaagtgaagtttcagcaccagcaagggctgcaagccaatcgacagcaagcttaaacaagaaaggcacttgaacatttataacctggtgttcattataaatgaaaacggtcagataaataagttgaaagttccatgtaaactgtaataacagccaacttctgtggttatcatttcttatatgccctaaatgaaggtgcataattattcctttgatttgacaacagtacttgaaaatagttgtgtatctaacaagcggaacttggcaaaaatattttgaggatatacatccaacagataggccatatctagctactagattgcatcatattatgccaaaatgattccttctataagtaaaaaatgtcactgcagaataagaagtgaatatgtatagaactccagccaggaagattagtattgatctcaatccagcataatggtcaatggtactctatcatgagataagtggcagcttataaggaattgccataatgtgcaccttgttattattcattaatgactaattaataacaaaagaaatatcttaacaacagaattaggctgcaggtttatcttagccacaaaatactctgctcatatgggttaccactttcaggtgtagcattacctttgccccaactaagaggcccaatgacaatataagcctgaagcggaaatccgggctatcattcaacaataagtatttcccaaggtttttcagtatctgtgtatctgctatctgatcatcaacatcctttttggagatatctttcttcactttgtcatcagatgatttcccaactgccacagcattggcagatgtggaaaatgcatgtcctctctgcaaacatggcaagaatcacaaaaaaacaaactcaacaaatgagtcctttcatagtacaaaggaaaacaacagagccaagtaaccaaactcagactcaattttctgtattggatattgattactagagttgaaatcaaccgtgagatacttgaagaacatttaataaagatgaaaacaatgcattttaaataccaaaaaattgcttgacagaatcatcacaagcgtagcaaatattattgcttgtaatcatatatatgaaaaaatgtgagtaagcgtgtttgtactttattttgtgatctgatggattaagtctgaaaaaatcatcagaagcataacaaatatcaacttgaacgcacgaatgtcagcaatgacaaagaaaacaagggtatagtaaatttctgataaatttatccttttgcaaggactgagaataacactgaaacaaaaccaaatgcgcccagcaatgccatccacaatgcttaataatccttttttaagttcctgtatcggtcaaactagtaactaatcacatctactacagtctacagccgactgttttgctaggaaactcgcttgtttgactgaagtattgatacaatacaaaatacataatcaaccactactgcctctaaccatccccaaatcgaaactaaaccaaatgcaataagcacaatgcagtaagccagtaaccacaagttaccacatcgcggggaggcggcgggtaggtggagtccgacatgaagcagctgaggcgaccaaagggggcatacttcccgtcgccgggataaacccaacaattcggcccgaagcctccgagcagagggctcgggagaggcctcggcacggtcggcggccgccggaatatgggggcggcagcggcgaccggcgaggggtcgtagcgtgagcgtgagccgcggaggaggtggcccgcggccagtatgcgggaggtcggcctcatggcgctcgccggcgacgacgatgcagatgattggatggaagccgaagcgtggaagaggcggagttggacttggacactgccccgttaaaaaaacggggctgataacgggtcgggctcggctcgcccgcggttccttggaaaccgcagctcggctgttcggagtgggatcggagcggtggagctcggcggcgccggcgatgtcgccggcggcggccagtggagatggggaaaaggcggctactggtgctacgttttttgttttttgtttttttgtgaagcagcaatttgttcagggatcccggatactccatccacctcacgaaaaacgatttttcctgttatttcaaaaaaaaacagataaaagaaaaacaacctttttttttcaaacaaactcttttcaagtttttcccggtgggaaaacaagttgtttctaaagttaagcaataaggacttgtcttagtttcgtctttagaaatttagagtctagagtaaatgtaatttagggttaaattttaaaaactacatgtataatccttacttcattctatgtcgaataaaaaatcaagggaacatgaattgggcatacttcttttttttttatgtgcgtgggcatgaggcatgcgacgcactaacaagatgaatcatcaaagcacatacctgacacatgataccgatcatcgaatttttgtcaacttacttttgcacataaatagctaaaaaaaatgttataataaagttgtgctaatgggtttttctctctccggtttggggccatgtgccgccgctaagttggcacatcttcatagaaaagcatttgacactgactatacttctacattagaaaaaaaaattagagttggttctaatgttatattagcattggagagggtgtaatgttatattaggattatatggttttatactatgttgttgtgatatattagtatgatataattacaagattataatacacacataaatgttataaatatcggtaaaaaaaggctaatccaactattaaataaccagtacacacaggctagagaacccactaaaacacaacccaataacctaattttcaagaataagtagccaaatgtgtagggtgaccctttcaataaagatgtgtagggtgactggatgagattgcttttggttgtattttcttgtaacaagacctgtatgtgtaggatgagggtgggtttttttcccttctcatgtttccttctttcttgataattttgcaaaatttattttgagtaaatttcacaaaactacaaatattatgatcaaactatcacaaaactacagatttaactcggtgtatcacaaaactacatatttaacattaaattatcacaaactatatatttaaaataaagtgttataaaactacatatttagtaataactaaattatcccagtcaaaaaaaatatagctccaacataacaactatgctaaggatttaaactctaaagctatagtttgtgataactttaatattaattgtttagttttgtgatatttagccttaaatctatagttttgggataaatttagtgctaaatctgtagttatgcgatacaacaccttaaatatatagttttgtgatagtttgatcaaaatatatatagttttgtgaatttttattcacttattattttctacaagaatctgaaaagaagatagaagtcatacttaacgggcccagatattcacgaaaggcccagcgcgggaaaccaatgggctgataagcccatggcaacgtggcccaccgagttgatcagactagatccaacggtgaagaacccagaggcttaatccaacggcagctgctttctaggcggccctccggttatagccggcgagcgctccaccccacccgccgaattttccctccaacctgctaaaaccctagcacccgccgcccccgacggcgccgctcgacgacgagtcgccggcgtcggtcgccgacgagagctagggcaagtgcggcggtacagggtttcagaggaggaggggagcatggcgtcgaacaacggcgcggggaccctcaggtcaacctccatcaacggcgtcaagctctactccatcaccggcaaccgctacgtcgccccatgggtcctctcgaagaagaagcgcgccctccgcaaggacgcaggcatcctaactcgcctcacgctcatctgctctctctattttgggttcttttttcttgtgcaaatgacatgtattttctcatttattgtcgtgttgctgtcctttttttttgggggtctttttagagtatcagcggaggctggatttgatccatgacctgaggttcgagaccgccaccaccaagatcaaggtgacaccggatgagcagtatgtgatcgcctcaggtatgcgagctcgctgaatccaccattttctgcaccggcgttgctttgatcaggttaaactccacagtgcatactcagaaaggcatataactaacatataccctggaataaaaggcagtgcgtcaatataacgtaatggtggttcaggagtcagttcgcataagttgctgaaggaataggtgtccaacaatatctttagtctgtagtgtctttctgcgtccatgtccacacctataattgagctttcatccttgcctcactcagatgagttcgcatagtctagcgaagttaagatgaaagctcatgttctgggtgcgagttggcattggagcatcacacaattatcgtggaatgctgccgtccccctactatgtcattggcttgcgcttcatcgtccccctactatgtccttggcttgtgcttcatttgaagtcagagtcaaaacatttaaaccactaaggcgtttcttggagaagcttgcgtttatgtttgcttattgtgagtccaactttgaataatcccatgccttcagaaacaatccatgtaattcatgctctacaccttttttctttagtttgtaatatcacttgttagtttaatcttcacctttaatgtgtttcagtattgtcactttcatcagattgtttacacctctgtatgtaagtggaattcttctgtctatgatgtcaggtatttaccccccacaagttaaagtctatgaattgaaggagttatcaatgaagtttgagaggcacatgatttcagaaattgtagatttccaggtgggactaggctctagtgaagctcattcctcttttactatggagaagacatttgaattttccacaaatcagaaacttgcattttcattagctgtgtaacaaattagattgttaacttagactgtagtacatctctgttgaatttattttgcttatgagagttttatactttccgctatgagttcatgctttgtcgtgggatgtaatttaaagtatttccacattgatacaaaccattggagattaactgctcaaaattgtctactatgcttgtaggtgccaacctctgtatctttccttttgtatattttctatctaataacacatattgcatctttctgtaggtccttggtgatgattactcaaaacttgcatttttgtgtgctgaccgttctgtatgcctnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64675 - DNA, 27103 bp, Oryza sativa
tgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaattaataaattccaatataaaatggggccagataaaatttcattaaatactttgcttaatcctttaattcctagatttttctgggatttatttgagctaaggaagtatttttaataaatggaattgcatttaaggaataatttaaattgaaaaaggttttaaaagtcttcttttggctttgggccgaaagtcggcccaaaacccttctctctctcctcggcccagttcggcccagtccgcagccgccgcgcccacgcgtccgcccgctgacaggtggggcccacctgtcagggtcgtcgtctacctccggccgccgccgcccgaaaccctagtttcgcgccgccgccgttcctttccaaattcggtcgatcctttccttctccggccgaattgatagaggggaaacaatctccgggatcttctctaccttttctcttttggaatcatcggctaattctttttggaaatcgttggattcgagttcgaatcggattcgtctctttcctccgaaccctaaaccttccttctcgtcgccagccgccgtgggccttcgccgtcgcctccgagcccctttaaaaggttccccgagctctcctctacccgtcgccaccctcgccttcgcctctcgtcgtcggaaacgctctagcatcatgggacctagcgccgccgtcgctccagccgtgcgccgccgccgttccagtcgtcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcaccggagaagagtttgaagagttccaaggccagcaaggcaagtcacacagatcccaaacaaccctttgagcatgttgatcccatttaaagctatggtttctattcaactattgcatttattttcgaatgtcattgggtggaattaacctattgtttgttatagcccttttgttcttgattactttattccttgataccttgggttattataattggactagttgagctttatatatattggttcaactagatattaggtatgattgcttagccatgcttagaaacattagcacactttcgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgcattgtttataagggggtgattatgattcaggaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattaactcctggtttggaatggtacattcctggtttggagatagaactgtgcagccgggatggttgttcagaatggttgggcctatacaacaaggtatgttgtatagcgttggattaatattgtttaatacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaataaggctgatggtgtggaggattaggtgtaaccttggtcaagctgcctgtggagtggagccgtctgcgccgtttatcttatttttccgctgcttagatctttattgtttgagaggaactatctacctctgtaatgacattttattcgcttattaattaaagtaataattgtactctattatcaatttgttattgtgtgcctcggctgattcctagacgagggttcacacacatgtaagcgtttggaattttggatagaaattccgggcgtgacagatacggcgaccgcttggctggtgctctcgcaaaaccaatcacaaggacaacaagagtcgtcagagaccgacggccgtagcatacgccacgtggccaccggcaggcgacggcgtctcacctggaccacggacacgtgtcagtggcgttgtacacctgtgagctgccgctgccgccgtcagcagaaacaaacacaaaaggaaatggagaggccgtccggaggagcgacgagcggcggcgcgtgggcacaccggccaccgccccacgtactactactactttcagcactccatgtgtttaagtactccctctgccccgtaatattgattttgattttttcttatgttgtttgaccattcgtcttaatcaagaaactttgaaattattatttattttatttatatcttactttattatccaaagtactttaagcataattttttattttttatatttgcacaaattttttgaataagaagagtggtcaaacagtgtaaaaaaagtcaaaatcacttatattatgggatggagggagtatgtgtttacctaaagtagtactctattcatattatttactaggaacaaaaaaatgccgtcgactttttattaacatttgatcaatcgtcttattcaaaatttatgtgtaaatataaaagtatttatgtcatgctttaaaaacatttgaagataaatcaagtcataataaaataaatgataaaataagacgaatggtcaagcgttgtaaagttaacggcgttatatattaaaatacgaagagagtactgcatcagtatcatactagaagaagtaataccagtactaaacagctttgatattttcgctagtagcccgcatatatcctcagttaatttgttgctttagttaaattgtgttaagagtgaattgcaccttgatctgagtatctttttttttgttatcgtagttttactttagatcacctcttaattcatggtttttactttaaaactagggaatgttacattttctagaatagatggtccaaaatgaagctctggaataaaatatagcccaatgtataattcattaataagaatagtagtataaaaatctccatgtaaaattattttcagttgattagtactcaacaaggtatattgtgtcacgtagaccataagatattgtcttgtagggatgtaagtggacaatctcactacccatataaagcctcacttgccaattactttctcaaaactttaaaagaaaaaaaattaactagaacaggtaaaagggaaaaaaaatcccgcttgtccgcttcccttggcatctggatggtcacgtggcaggaaagaacttgtacagtagtagtacgtgctagggtttgaagtaggagcgcgtgtcaatcaccaaaaaaaaaaaacaaaaaaaggcacagcagcgagtggaaaggagtcgatgggattttatgcccaaaaccgcgagagatccaccgctgtttgatgggttcgttgggacttgggaaggaatccatcggcgaatcgccgcgcggctccgatccggggcgcaagcgcaaggccaccggcccacgtactccactactcctactccgtagagaggcgacgcgtttgcgcgggcggcgccgcggccgcccaacccaaccgtcgctgcctccgtctccgtagtccgtactgcctgtgtctgcctctgctactgctgctgcctgagagcaggtaccatagcatagcaggctacaaaccagctacaaacatattttaaaaaaataaataaggagagagaatggtagcaggctacagatttatagccagctgtagcacggacttcaagacacagtgtgtatgacagatgggaccatatattaatagtgtaatatgtaactattatatgaatgagctattatattggctatagatgaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgacatggagtactacgagcaggaggagtacgcgacggtgacgtcggcgccgccgaagcggccggcggggaggaccaagttcagggagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttttccttctttattttttttatattttttccaagataaaatggctgagctggtagggagttctagaaggaggaaataaagattacgagatttgtaatactactacgagggacagcatgcaaaaaagaagtataattgctatgctctctctctctctctctctcttttgtgtggagtggaataaaatgccagctctgcttatggtcagattttcacttttttttggagtgttaagacaaatgaaagctccagataaattagtgagtgctactgcttatctgaataaatgagatcattcatcatcctataaaagaataattaagaaaatgggtgtaccatatatgctattggcagacaaaatttagcagtacttgtaagtactagaatttggtttcactttattttaagtgagattgagcacttgtttatcatgctatcatcggtctacaattagttagaaactgtagttcgcagctcagttattactggatcaaaacttcgtcctttttttttattttttgagataagggtgtttttactcggcctcatatatgcaacctttttaaattagcaaattagcctatcaatcagaaaacttatttcttaaataacccaatctaaaattcgcttctatatatatttaaattcaggacgttgggaaggtcacttcgtccttttttttaagcttcggatcagttcgcactagctggagaagcagagatagttgcaccagattgatggtggttcgatgcctacgcctacgagaataagtactatatactgtatatgatattttcctcgtactagtatcatacgagtactttgcaaaaacacctcgtatctatacgtccgtgcttatatatatggctgtatatatacgtccgtgcatacgatcgagtactcggcaatggcacgtgctgagtactaatgtaaccctaatagtaaagggcacatgttgccgagagcttaagatactcattacggggagccgtgcgagtgattacatcatgtgacgacggatgattgcacggtctaattaattatcaattatagtaggtaatccatcgattagattagtggtcacacacgcacacacacaccggccctaatcgatcgctgaattaagacgcgtttccgcgggcggcgcagcggacgacgacgacaagatgtcacgaagcaggaagcaactctgcacgattgacaccagaattgttgtttaggtggtaatcctaattgtaatagattagacagtagagtaaaggttaaggtcttaggggggtcggcgctggcgctagctagttaggaggagtaggattctgtgaatcttgtgcacgtcgctggacggctggatacggatatggtccagccagccagctagcgctcatgttgagtcaccgtcacggccaaatggcagcgaccatgtcaactttgccacgtcactccggagaatactcttaacagtggtattttcaatccgtctcaaacaacccagtattagcactatgaatttaaacaaggcatacaagggacaaatgatgtgtctgtaagggcagtcccaaccctccacctaggatgatgtctatgacattaactacattgacatgtgggacttttagcttatgtggcactatattaattaagagagagagtgaagagaggaagaaactgggtctcatgcaagacacagcttcaacacgagaacctatgtaccagacactatcaagttttttgtattggaagagaatattgtcttcataatagatgaagaattaatatggttggtagagaagagagatgatgtatttattaatggcccactttaagaaaccataggttgtagagtgtagtttctattgtgatgtcttattgacataacaccatagataccgcttatggacactatgggttgggactgccctaataggttagtatattttaaaacagagattattatagtttagaatagagttagtagcgaaattttagtcttcagcagcatagttattaagagaaaaggacttacgctgtgtttggaggtgggtgctgggaacccattcccatacacggaaaacggagcggcccattaacgcgtgattattaaccattagcctttttttaaaaaatagatcaatatgattttttaagtaacttttgtatataaactttttgcaaaaaaaaaacgcaccgtttagcagtttgaaaagcgtgcacgcggaaaacgagaggggagtgttgagaacttgctcttgcaaacacacccttagttgttttggcaaaaaaacgttggcgtatacagacacacatttgaagtattaaatgtaaactaataacaaaacaaattacagattccgcatgtaaactacgagacgaatctactaaacctaattaatccgtcattagcaaatgtttaatgtagcaccacattattaaatcatggcgtaattaggctcaaaagatttgtctcgcaatttacatgcaaactgtgcaattgtttttttcgtccatatttaatgctccatgcatgtgtccaaacatttgatgtgaccgaaaagttgaaagtttgaagggaactaaacacaaccttagtactccctccgttttttaatatatgacgccgttgactttttctcacatatttgaccattcatcttattcaaaaaaatttatgtaattataatttattttgttatgagttgttttatcacttatagtactttaagtgtgatttatatcttatacatttgcataaaatttttaaataagacgaatggtcaaacatgtgaaaaaaagtcaacggcgtcatctattgaaaaacggaggtagtagtattttatagtgaggttcacctctgaaagtctatgctttgtacttcaatgtacagccatacattctgaattagttcatcagaagacatgaagcattttattagtagtagcaattttctgtttcttaattgaattagcttctgaaaaccaagaaataatggctacagtaacacacgccttttcttttcagtaaaatcactgaaaagggttacgctactactacagaagaaaacagctgaattggtagcataactattggctatggctaacggctgtaatttagagagcatgaaagggaaatgcgcacccgatgagatccttcattccttgctttctttagttctcttcttttgacgacagctccagaagatgttctgcctccctcaagaacaactttgtcagctgcttttggcctctgcggtacactatgcacgtcctaatatttacttttgacttggtctcgttgctctcgtcacttctgtgaaaaagacaatgagagtaatggtgaaacacaaaaacaagaggtgtacagatggaaatgtcaagcatgatagtgctaatatgcagaaaaaagtatccattaagcaacgtcaaaaggccctacgtccctacctcgttgcgtcttctgaatcactgagatcgaatttctcaagtagttggctgtcagatgcttcagttccagtgccctcttcaagttcagtcattcttgcaaaagagaagggcttgatcaataaattattgacaacgccatagaaaaaatacaggtacactgacatcgaatttctcaagttgtgggtgtgttacttgactctaagaagatccacaagcaaactcagtgctccattatcaccactgacctcccatatagcactccggagctcatcatctctatcttcattagatccaatctacacgaacagattcaaaggatttctacaatcaatttaccatgaaataaatatgctcatacagaataatgctgaaaactagggaaaataaataatatgtgaatattaaggtcatatcagaaaatgtgaaactagatagcctaaatgcttcttgagaagctttcttaatccttttagatgagtaaaacaaccttttttatatcaccaagaaattatgattgatgatgctgccaaaattagtaccatgtgtgataaaattttggactcatggataatattttagtttgaaagcaaatgcgctaattttcataaatactgtttgccagcttacagtacaagtacaggaggatactggttaataagacaactctatggtctgttgagaagtggttaatatcttattaaccagtatccccaggcattagtcccctttatgaaaaagatattaaccacttctcaacagattagatggttacgaacaatgtcatgtaaaatttggggtactaaaatgtcccaaaggaaaaaggaaaaaaaaaaaggacagggcaaggcaatgtcacatatgcaactgatgcctttgaacacatggtacagagtgtgaaaaacactaacctctccaagcaatgaagcggtatgctcaagctcatgttcttgcagagcaattgtacgcagggtacttataaattcctgagagaaaacaattttctcgatatatgatggaaccttgcgttgaccactccagctataactagaaaaaggacttgtattatttttgttctccttgttttcaccagaacagctaccaaaaaatccattttcaagcaaactacgaggtaaaagacatcgcaattcggcattctgtaaacacagaagatatggaaagtgagacccgtgatgtccaaggatacttgttgggcctaaatttttcacaacattcttcatatcgtaaataaaaactagagctaagaaatgttgctacctgtatctccagtagcttcatcttaatatcagcagattgaacctgtcgaagagcttctactggataatgaatctgcatttggaacgtttgttagctctagtttttatttcaaacaagtagctactttcttaaggaagtacgccaaacggaggaaatatcaagtataagccatcttatcactatgaacatgtggagcacttcaaacaatcagcaactttgataatgaaaaagggtgggtacatacgatttcataatttgaactaaaagaaaggagatattctcagtgaataatggttttcttatcttttaaaatgttaactaaaagtttggtcctttatgtatcccagaacaccgatagagttacacttacaatatttagctggagaacaattaagtaatggctacctacaatgtttcaagacagacaagtgctttgccactataatgtttgacagaaagagaatatctggcagggaatatgctaaacaaagaaaactgagttgacaaacacctgttgctaaaagtaatctcttactgagtgttaccatgagataatcgtcaggattgttgtcaattacaaatccatagaggtatagtagttcctgcaagtaaacaaaactatgtcatttcatcagcaactatatttcagtaatcataaacggtatgaatatttgatgacatttaatcattttgtagtttctcggaacaaaagactgcagcgctgcagcttcttttcgttgactattgagtctcaaagtcatctatcagttagaagccccaaagtaagattattttatacttcagaacattagcaagtgtgtttaatgcaaatccataaggaactaaaggatatgtgaatccatgaagaaatcaaatcaaaccaggcccagtgatgaaacaaagggggccatagagctccaagaagttcatcaccgtcatatgtccttcctcttcttttcttttttttttaaaaaaaaagaatggccagggtgacggcactaatgaagctttcctggattgtttgtctgaagtgcaaccaatatctaaatgcacaaatcaaaagaatcttcttgtgggtagttctattttggctatatatcaataatgcccgtatcagtatatagagaaatcgtgacagagaagtcagaatgagtatacacgaaaatatgaaacagtgacatcaatccaagtcacacaataacaagtacgataaaactaagagcaacaacttgagaaaaataacacacttgcttataaactagtcagactagatctgcacatatgtaactatgtgagtaatacctcatttcctttgttgccataatttatgcagatctctgtttcagccttcacaaagcttttatcagctagagggagatacaaaaataaacagtcataaattggaactataatcttatatcaaaatatttgattaaaggaaagatcatgaggttctcttatcaaaaggaaactggagctacttatgtacctagtacaaggtacattgaagaaggacatccagtaacatgtcccatggaatcaacttcccatgttgccagcgcctttacatctgaaaaatatgatatacctatgtaagactgaaaataacatgttttttcaatgagtatttattttcagtacaacaattttttttatgtaaatccttgcaaattcgcctacagttttttttttgtcaaaagttgaatatagaatgatctgccaactagatatttcgtctatactacataattcataaacttttattagaactcttactatgattacaaaagtcgattccagggacaaggccctcaacccaaattgactctgtattacttgatttaggattatcattgccactgatattcttagctgtaatggcagtcccagttccctggaaacaaacagttagcatgttaaaatttggaacaagaagatatgggtgaacaaattaattgaagtattgagatgttaaaaacaaatacaatttggcataattataaacaatgatttgtcagataagttggatctatattcacgagattggcaaagtatatgatgagtcctcaaaagtatatggcgtttccttgaggacaaattgtagcatgtcacaagtatattttgtttaagataattgtagattactgctgtaattaacaaaaccacaacttataatataaaagtcatttccctgtttccgtgttataatatccagttatgcaactagtttgttcaacagaaacatattcttgcccccattcagtttctttttttttttttgtggcacataccttgagaccactatatgccttcagtaacagaatttctctgttggtatgaaaaattttcagggccaagaaaggtcctatgcgatgttcctctctcttgacaacaaaattccattcaaggtcctatgctactctttcatgacaagaaaaagtcatgtaaccaatgtttaacctctttttcacttttcagataggttgtacatgagcaaaaaagaaacctaaatgaccacatataatcgaggggaaaaaattaagccacacacaataagtaaataaaacaattgagaagaacctctgaagctaggatctgcggtcagaaaaaatgcaattaacctgaggggcactgagactagaatcaccacaatcatcaccaatgttggcccgcttttcgtctagtgattccggaaaaacataaaaacgaggcaatggtatattcaatgctcgagtccagaatattgagtttgccctgccatagagtcgtgctgctgagttacataaaacaaagaaagcagggaactgaaccagcaactatgtgaaggaccctgcatcatatgtgtatattgcatttttcatttgttgacataaaactgttgttccaagatatttattgaaggagctgcaaatcaaagccatcacccaattaagtacaattttcttatgaatgagctaatttccaccttgatggcttgaaaattgtaatagtagcaaaggttagttgatgctaggtacaaaaacatccccaccattttgtaaactaatgcctaatttgtccaaaaaaaaattagcacactgaatcttttgcacacgaaattaacatgatatgccatgtcaatactatgaaactacagtatcagtaaggcttatattattccccccaaaaaaatgtaagccttataatatgacattatcactgcaaatgcaaagcataattatacataccaaaggaagtcttcgaaccgcacttcaattgagctgcaaacaatattttgatagtattactgttaaataaaacgaatttctttgtcagtaaacatatgatagggagtcatgagaattagccatattggtatatcattgccatactagacagtaaaaatcacaaactcggtaggtgggcatacagatgtataacagaacaatatttgagtgatattgcttgtggattcatgggttttaagtacgcacagaatcaataaacaaaaatcatgctggatacactctacttagcactagaagccttcacaagaaaatattcatttaatagggttggctgaaaagaatattcagatcaaaatatttcaaaggtacacaaagcccagtatacagtgcattaaaatgatttctaacgtatttataagttaaacctatgccatgtcaacaaaattcataaatgttctgtaaaataaaagtagcaatttatctcatagtgcagcattgccatcttggtgattctcatttctataaaattaaataaaaacataggcgctatcccagatgacaacaaatggtgcactcatacacatgaagatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattggaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggccgtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtagtgacaagtgcacaaaggagaccaaaaataaggaacacattcaacaaacagaaagcaagcacactactcggtaatctactatagcattatatatcatcaggtccacgttacattctaccactcacactctcatctcatctcatcactcatctcactcttatctttcagcttgcatcgcaggtgcaaggaggaaggcaagagactagcgaagcactctcacagccacaggacacatggtgaattgcacagataaacaaaatgctagcacaccagcgaagcccggagcgagtgcgtcgtcgacaggttggtgcaggacgcccaccgtatcaccgactcggcgaccgccacatccaggtgctcgcgctcgccggcgccgatggtgtggttcctcctgctgttcatgccgatggcgcgcgacgggttcgcccttacggcggccctcaggacctccgctgtcctcggagccgaggacgagacgagggccaccaccgtcgcgtcgcagtgagctttctcgcccaaggcgtcaccatcaggcgacgactcaggctcgccgggttcttggccgcagaagaaggagaagctcggcatggaagcgaccggggacgggaacacggcgttgcagggttcgcagacgccaccgaaggagaaccccgagagcgcgcacgacggagcattctcagcgacaaatgcagagaacgatgatctgcaggcgaatgtgggggagcacgcttcttcagacatgctttggcaggcgaccgggccaccggtgttgaagctcacatcgcggctgcatgacgccagcggcgtcgagaacgaacatgagccggcgtcctctcctctgagattgatctcatggcaatgtccacaagaatcttgggattggtcggcatgatcttgtatccaggaatgctctgtgtaacaacagttgtttagattactccacatggcaagcattacaaaaaaatggggaaaggaatcattagcagctgatctgtacagtaaggtccgggaatgatgcaatgacaaccaaacaaaagattccacgaaggatgacagaatgaaccagcacaactaaaggaatggctacaatagacaaaaggtgatgaagtgccaagaaattttaaagttcatctgtaccacagtggatctaccagaacatgaccctacaacaaactgtgatgcaacccagctttttcccccagccgtgcaagtttaaattagaccaccaacttaagctggcactaactcagtacttagcagccaagttttgttaatttattcaatatgtaaagtaaacaaggctaacctcatcaggaaaattttgatcaatttcgatttacaattccagttacatgcatgtattaatagtcagtgagcattttccatcttaaaaaaaaaaaggcagttccaagttctcaatatgatgctagtgatgtagaacaaggacaggaaattgaaagtgtgtggtttctgaaaagattgaggccgtgtctcacctaggacctgcttggctgtgagcctctgtcgaggatcgcgccgcagcatctcggttattagctccttcgctgaatcggaaaccttgtcccagggatcagaaggaaaccgcagctcagtcgacctgatacattcgaaaatctttgatttggttttcccccaaaatggggggatgccactcaggaggatgtaaagtatcacacccgcgctccatacatcggcagcctcattgtacccaccggcgagcacctcgggcgcaatgtaaaatggactacccaccatgccactcaagctccgacctgacaaaaccgaaacccaattcagcttcgaaacaccagccttgacagagagcagccacgaaattgctcaagaattcccaattataccaggctggatgtaggttgcgaggccgaaatcggcgagcttgatcggcgaagaaggcgatttgctgacaaggaggatgttctcgggcttgaggtcccggtgcacgatccccttgctatggcaatgcgccacgacctccatgaggtagcggaagagcgcggcggcctcgtgctcggagaagcagccgcgctcctcgaggcggtggaagagctccccgccggcgcagagctccatgaccaggtgcacggacgcctcgtcctcgtacacggccttgaggtcaacgacgttggggtggcccgagaggcgcgccatgacctcgatctcgagcttgacccccctcacgtcgtcgggggacacgaggcggtccttggcgatggacttgcaggcgagcgcctcgccggtgaccatgtcggagcacgaccggatcacgccgaactggccccacccgagctggggccccagcgcgtagcgatcctcgaggcacgacacgtgcgccgcctccagtatggcgccgcgtagccccgccgccttgtacgagttgtacttggcgtcgccgccgccgccagcggcggccatcgcccggaggtcccacacgctggaatcagacgagattctccgctgaaatctctcaccgactccccccccccccccccccacctcagtgcatcatccttgcttcttcggccactgaatctgggcacgaacacaaaccgagcagagaaaatccaaagctttttagcgctctcgaaaccccaaaatcgcgggcttttccatacaaatccccaccgagatcattccccggaaaaaaaaacaaaacgaataaaaccgcgtggattcaggagatggggggagcgccgcgaaattcaaaattcccaccagggagagaacccgcagaccacgcggccgccgcaccggaggaggaacccctcctcctcctcctcctcctccggtgagagagcgctccccacgagcaagtctccccgcgactcgagcccgcgcagatcgagcacccacccacccttgctgctcgacgcagaagccaaaaccaaaaccgcccgacaaaacgtccgacagcacgtagcggaggggggagagtcgacttacccgcgcgcgctggctgctccggcggccgagcggagtcgccggcggcgaggtcagcctccggcagcgcgaggcatccgggtggggcgagagagagagagagaggggtgagggtattcgttggtggggggagggggaagcctttgctttttgataggtggtaggagaaagaaatgagcatccaataacaaggccattaattaattaattaaatcattgttcatcttaaccctaggttttattttaaattgctctaggtttggctttggagtttaccttagagacttgttgctcttgtttgcttttgttactaactggagcagtagcagggtttcccaacggttaccgcggtaaccgtgaaaaaccgtacaaaaccatgcaaaatttatcaaaattttaatttattttttaaatttatttgaatttaaggaggttaccgcagtatttatattaccgtaccctcgcggtaagcccggtaaccgcgcggttaccggcggtaagtcgaaccctgagcagtagtactctactcatccctccgcataaaaattgtagactacgaatctggacataataatcttaggatggagtaagacgatttattaggataagattttgataaacaattgttctactaatatgttggttgtttatatagtaacaaattacgatcataagcaaatacttttaaatgtagatataataacatcaattttatgttggttggttaaatgattgttctaacagagtgaatagtatttgttgttgactctagaagaaaaaaatgattttcgccagactggttagttaggaagaggtatgaacgatgatgtatgagactttgaattgttctaatgtgtttggttggtttgaattaggtgcagcagttgtggtaaggtcttgtctttttttcgaagtacaaattatgcgtttcgggatttgttttttttttttttgggggggggggggtacagaccgttagacaccaatacagatgcagtctgtacttcgagtattttttttccctgcgaccgtattagcacataggagtagtataaggtactagtatgtcaatgcatgtaaagttgttaaagactgaagaaaatgagatgtgcaatttgacccggtagtttgagatacactcaagtgtagtgacactctttctacaactcacgcaaaaacataggtgaaccttcacaaatcagtaaggatatgcaagcagctagcgcatcctggtacaaatcactcaaagttattcattctataaaaaaaataatcttatgtttataaaaaattccttctgttttttccaatgtcgacccaattatatgtcgcaaaaggagtcccaaaaaactgcaaatgcaaagtaggacagaagcaaaagaaaaaccagaaagaaagtaaacacaaaaagggcccaatctcctaaaaatttgttgtttagttaatgtggtgatcatgccgatgtgtgatggttgccctctttgctggattggtttaaggagcactacaagttgtgcctctagtggggctacaaataattgttcttaagcaatgccatttgcatgcctttatttttttttttgcttattattttttgtccttgttctttctgttttgcaagtgattgatcaggggaaagaaagatctaatgcaatgttgtgtggttggctggcctaccagagtgggaaagcgacaggagggcgaaagagagatgcactgcatttaatttgcttccttctggtttcaacgggttcgtttgcttgcgtccatttcggaggtggaaaaatgaattagcacattccctagtcagaccagctagccgtagccaaaaattaaaatttgaaacttaaatttgagttgattcttaaaagttgctaagtacacatatcttaaagatttacgcataaattatttttgttgctaatcatgcttaaccaattaagattttttttaacggtcagacccgttgctgatattttatataaagaagaaggtgccccattttaagaggtaagtgggactaacctagtgctcagttaattagagaaagtgagcaaaaaccacaactgcaacaccacaccaatatatagctaacttaagctaccgcgacaaaacccaacacaaggcaattaagatcaaggatagagtaacctaacaaggataatgttgaagtgcatctacatatgcgtgagtatatacgacagttcaaaggaagaaccatgaaaagttgaatttgatgaatgtgtcgtttatggatgggatatgagccgttagccaaattaactccacaacatggctactaatacaagcaagaagagaacatatatggaacaaacaaatgatagcgacaacactaggtcttattcatgaaagaaacggcatatatagcatactcaaaaaggagaggaatcatgcaaagtttcaacgtagcactagtgttttcaagccggagaacaattctggtggtgggctgcaggatgatggtgtctctaagatcctggacgttggtgagtgttggtcggggtccaaagtggagcaacaccatcattatctcctaaaccgttttttgattaagaaattaaagatagagaggctcaatgcaatgcaaggaatctggaccctggaattatatggccagtgtggttgcaatttgcattgcattttgcactaggtgaaccactagccgaagcttcccacacgagctggtagctagctttgcccaaaaggttagcccggattctttgttgctccaaatcaaggaggctttccgtgtgcacggaaaaaaaaaaaagctagtaatgggtacgcgtgtgtgtgagagagagttattgtttatgcccgtttgttaaagctactccatcggataatgtgtgtatctttcttcgtgctctcatggatggattcgtatcctctggcttgacgtagcaatgtcactacgtgacattatttctatctaaaccatccgtttgaaatcaacggataatatatttgagcggtaacatgtgttttgttgataacattccgttaaagccgtatcgatttggcgtattcaatgggattatgctctttttagaaacttgttgcataaaaaaaaactcataactcaacttagggcttcttcggaatacgggaattttataggattttcagagaaaacagtttaattcctccaaaatttctatgaaaatcctacaaaccgaatagatccttagtattgaagtgtgaaaaaaaagagaatttcaccacaaaatttaccacacattgtttcatcaatggaaaatgaaatataccgtttgggatacctaggacgacattcatgctaacttatcatatgctttactttgcaaatactatgtcgatctcgtgcaggatatatttcagcaggtaacatgttttcttttttaatacactttgttggtgtgtggatcgagcgtatttgataagggcattgtttagttttccccatattctcaactttccatcacatcatatcacaacaaaaactttcctacacacataaaattccaactttttttccaaactcctaactttcttcaaacttccaacttttttcagaaactaaacacacccaagattattctccttctataaattctctgtccaaaacctcatgacactagtttgtcctaggtttaactttggcaaatgatatgtgaatgcaatgctctaactaaagagtttgtaccttgtactctaaacaaaccatttctcgtttggtagagtagacgacaacagctcagaggtatccgtacaatcatcagctccgctagccacgaaaccacaccgtacgttgaccactcatctgtcgccacctggcgcttagctggtctagctgtctgtgaacacgcagtgggccccacctgtcagatcctcggagtaagtgtgtaatgaatgatcttcgctggaatgtcaacggtggggagtaagtagatgatcacggtcggttgtggctgccacgtgatgtgattagatggagctgagatgctgatgtgtgtgattagtgggtaggattagtttgttcatcactttttgaaaaaaaaaaaacacaccgtaagttgtggaatggatccgttggccttggcctttgggccgttgacctactgcatctgactttcctatcactcattttttttattttttttcacatgtttacttttgtttttggaaggttttatactcccgttctaaacaaatcaatctatccagatttgctgtattaagttttatcccattaccatcatgattgatttattttgaaggacaattttactatcattgagaatgtgtcaggaagtatcatactttctaatgtaaaatttgatgcatccaggtactacagctactatgtactttgaggtaaaaaaaatataaaatataggtatctcgagataatttttaaaggattatacaatttctctattttgaaacagagggagtacgtgccttgtgcttagtaggtcatgcttatgtcatcaacatgcatgcatacagctcggcccaggcggcaaggcctatctggagttgagatgtgaagcccaaagtcatatcaccccttctttgctgtttgaaattaggcctgcttatcatgggctgaaattcttcggccacttcatttttcttcactttgcaggcccaacgattggaagcttctaactagagattttggcccgtttgtgaaacgagaaccaccgtcacatcttacgaaaacgctaatccgcgacaagtcgcgcggagcggcggacggcgcgtgtacggtactcttttttttttgttttt

SEQ ID NO: 64676 - DNA, 1216 bp, Oryza sativa
ttctctaaaaaaaataagaaaaaacaagtgtaaaatactctctccgtcccaaaatataagaatttttggacctgacacggtcttcgagatgcttctttgaccaacaatatctataaaagtaagatgttttaaataaaaagagttgcatattatgatagtttatttaatgataaatatggttgatcttcttttttgctattaattgttaaagttaaaaatgtttgacttgtcactatgctaataatgtttatattttgggacggagggagtagatgattgaaaaatacagaaaaaacacaggaatgatcgtttgattgcaccacaggaaaaacacaggaatgagatgagaaacatagactcaaagaaatttttttaagaggttaaacatcttgctaactttcctccaaaatctctgaggattacccattacatacgaatttaaaaagataagataggattcaatcatttatttcaaatgcttccatagaaatatttttcatatgattcaaatcctccaacttttctacttttcatacaaatcaaagggccctaagacagatgcaatctggaccgttcatgcgtggtgcgtgcagaggagcgctgagtgcagcaccaccagggtcccgaaaagcggagattccccccttcctcctttggctttctcccccaacacgtcattccttcctttcctttccttctccactccgccatccgcaaccgccacgcaaacttcctctctctctctcttctcggcgcgaatccagaaccttctagaaggagagggagaggagaggagggcccccgcccccacgggtcgccatggccgacgcgtactggaggtacgccgccgccgccgacgccgcgcgccaccaccaccaccaccagctgcccctctccgccgcccccgccgccgggatgcccgccccgccgcctgctgcttctcaggtcgccgccgccgggcagccgctcaagcggccccgccccgccgacttctccggttcgcctcgccacacctcactccctctcctcgctggcagctgctcgtctcggctctgaagccggcgcgggtgttcactgtttatagggttttagggtctcgcagttgcaatgctcggctgttcttcttcggtcgtctctgggttgtctcacttgcgtgatatcgcgtgtgcatatcgtatcattgcatttcgtacttactgttttttcgctagactgt

SEQ ID NO: 64677 - DNA, 1153 bp, Oryza sativa
gtgtgcgggcccgagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtaagctgaaaattcttctgaccaaaatatgttcagtgtcgttgctaatgcaaaatcttcagaaaacaattgcagaccagcatatgtgcactgctttcttcttcagtgtattcattgctgcaaaatcttcaaaaaaaaaaataaaattgcagactatcatatatgcacaggcgtgtaagcggattgacccgtgaactcacttataagctaattaagtggatcgatcaactggttacccacttatttggcgaataagtgagttggtgggtcagcccacttacactccagcactgctttcttcgtcagtgtatttgttgctgcaaaatgttccaaaatttacaggtttattggtctttaattagtatgtgaaaattttgcaggtgtgaggcgatgtcaacttatcctaggacgtatgatctgatccatgcgtactccctgttcacaatgtacaaagacaggtactggattttgcttctgtttcttgtgctcaactttgcagttgctccagccatgaagctagctgaatctattgctgttctctgcatgtcatcagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaagggttcgcaaaaatggcattcatcatgctgatgatca

SEQ ID NO: 64678 - DNA, 5749 bp, Oryza sativa
  unsure (1)..(5749): unsure at all n locations
tttgaaatatttaaagctcactagaacgcagtctatgaattccatatgttaaagaatccaggatgttatccactaagacataaaagaacaaaaaaggacaactattagttccacagaattacgtaaatgcatgaatatgaaaaggttgcttacccccagctttaacaatatcaacaagatcatccatcaaaattataggcatcgaacggggtatagacccaacacctagaagctgtatattttcttggatttttatttcttggtaatcatggcaggttatgctatcttctatcaattggaaattggcacctccacaaccttttgcactctggatcaatagcaaaattagcaagagcaacttcatagtagtagcagaagttcaagcaattacaaatatagaaataacaatatataaaatgtgataaccagatgtgttaaccacaggtgaaccgttataggtagaacgagaaaaataatgccaaggacatgaaataccttggatttgcaagatgcaggaagagttatacgattcccagcctcaagctcaggatgaaccgtaaacctgttcaagataccaaagaagtcaaaggttcagtatggctagagtctagcacgaacatatatgagcatgctaatcaacacaaaccttgtaaaaagtattgaggtcatcatgtcttaaggtagcacaaaatgcaatattatgttcatattaaggcaatcacgaaattgctctgatctttgaatcccctcccgattcttcaaaatctactgctttcaagaagttaaatcctcatgcattttttttcaagtcgttatctagaaaaatgtttttccaagtaatttcaagagaatcttaaccccacttgcgtagatacttaattttacttcccagcttttggcttacaagcttaggaacccaaagaggccagtgttacaagtaatgtataacacaaatacacaatgacaatcctgccactttgcgagcacgagtggaactgtggaagtactaaaaacaatctgttaacttttgctttagaaaagctttctatggttctgccaaaccagctctgtcagtagaccactgagcggtgagcaccatctaaaccgcagaattaatatgcaagccagagccagggatatatacatcacaacttcacaagcccactggttctaatagaagaagcaaaagcttcagtcttcaactaatactggtataaagccctgagacatgcataacaaacctgcacttgcatttcctgcactgatacttcctctcgccttcgatcatcttcacgccaccggacctgatcacggtccccttcaaagtgagcagagttcccctgtgcttcaccctcaccttcccaatgctcggggacgcttctgccgaacaccaccattaccaccaaatcacgatagcccgtaagcaactgcccaaaaacaccaaaaaaaactacacgggcattacgccgaacacaggtgtcgcatgcgtgcgctcaccagggcattcgagtgccgaccccgaggtgttgacgcgcacgtgcacgaacttcttctccattgtctcgtcgcccgccttcctctgagaatcaagagtctctgagaaaaaaaaaatggggggaacaagcaggtgcaggtcgtacggccgcctggactactaaccttgtcagctcgtcgagcggcggcatcgaatttgtcgagggcgcgttgcgcggcggcgtcgaacagctcgagcacgtccttggggtagtcgtagagttggtgggcgacctcggggtcgaactccaggagctccgcgaagctgcgagagggaggggagacggggttagggtttggaggggggagagaacggcggcagctggggaggaggacgaggactcactcgatgacgagggggaaatggagcttgccgtccgggaaggggaggaggatgcggcggaggtcgtcggcgtggaagcggttgaggaaactgtctaggcgactctcgaactcgtcgaggtcgtcgacggcgaactcctccgccggcggcggcatttgggcggcggtttgggccgcgtatggtggccgtacgggcaggaaagggcggagaaaagctggccgcggagaggacacaaggcggtgacgacggctgacgggactgactgacgcgaggtcacggtggtggtggtggcctcgatttgggggaatttgggtggagattaaattgggccggttcttggtctagaaagctaaagcccactatattgagcccgttaggcctctcgaaaaatgtggcccatataaaagttgcccccgttctttttcttctgaaaactcagaagaaatgtgcctgtctgttgttggtagcagactaacagtaacattttgctttattttcaccgggtaaaccagtgtttgttatttctcagccactttaaaaacgaagttgtctgttttcatagtagagcaggataatagtataactcacttcctacaattagcccattttaaagccaacatatataataaattagctataagattggctcttctcatctctctatctctcttagagcaagtatgataaagggttgtaagaggctgaatgcttaagtggatgagagaggagatgagagagatgggaaatgggttgtaagctcatagccgacttaagcacaggaaccaagaaaatatgtaagatagacatgtggactatatatttatagtgaagagctaaccaatatgagtgagctaaggctataaagatttatactattagcagctggctgtattattagccttgctcttatacatctaatatatttatcttgaagtttgtgttaagttggctcttacgtaaaagataacacctttaatttttattttattatagctcactattatctttgctcttgtgcctccatctccatcgtggaggtcgtgtgctttctcatgtgacaaccagtccacctccatcacaagatccactgctttattatcgaacggtcactgctttatccactgcttcattatcaatctaccgacacacagtcaatccctaattataggtttagctcgtgctttcggggttttatcctcaatccagccatctaatcaatccctacatgggctggtccgttgcaaagtaacattattagtggataatagcaagctggtctttgtagcacttccagctacaatagagattactacctggaagctcctcgttggtaaaaccacaagtccacaagatgtgccactggttttgccggttggcggccatttgacctgagccagcatgaagcatgctcgagctcgacgaggcgcctaccgcgcatactacgtgctatcaaacccaaaccagtaagattcttgagacaaaaacgcgcggacaatctaacaaccatcactttgctaatcacctttgtcacatgtgaagtgcgaacgtgctcgctcgcgcgctccagcgaatacgaatacacgcgcgcccttgcaaagcaccccactttccgcacaatcagttgagaacttgagatgtgccctgtggatcagtgatgtgtcatgtggaggcctcgtcatttcccctcccctgctggctgctgcagactccaggccgcagcgccactgcgccagcgggacgcgcgaccagcggcgggcgaccgagccctgcatatgcacaccggacagggagacacaaaagcgatgggaaagcgcccgtggcagcgaggattgccggctcctgtcctgccacggcgcgagcagcggcgcagcgcatgcaggtgccccaccacagtgttgccgccgcgcgcgcggtcgtcaacgaccgagaagttgaacaaaaggtacgactagtacagtaggtactcgggtcgggcgtgcgcgcgaactgcggcagccgatggaccagcggacgcgagacggagcgcgcgcgtgtggcaaactaccgcgcgtgggagcgcacgccggcgcgggcggaggcggtctcggcgcaaggggacaccgtacgcgagggggcgcggcgtcgcctggtctcccgaggtcgcacgcacgcacgcacgctgcggcgtggcgtgcacggaggtgggtgcggaggcctgtgcgtgggagtagtttgtgcacggcacgcacacgttcatcggacttgacaatgatccgccggctgaactcatttttctaaccggctttcagctctaactctactagtaggtcctcgacctcagcatatcagatcgtgagcttcgtcttgaatacagcgcaaggttcgtgtacgggaccatcttttttcttctgttgatctgttcatggcctgtttagttcagaaccaaaaatttttacttatcatatcgaatatacagacgcatatttgatatattaaatatagactaataacaaaacaaattacatattccgcctgaaaactgcgagacaaaattattaagtctaagtaattcgtcattaacaaatatttactgtagcaccacattgtcaaatcatggcgcaattagacttaaaagattcgtctcataatttacacgtaatctgtgtaattagtttttttttatatttagaactctatgcatgtgtctaaatatttaatgtgatagagtaaaaagtttttgcataagaaggcctcagctcatttcctcctcgctcgacatccatgggtttagagcaggtacaatagcaggctataagccagctgcaaacatattttaagaagataaatgaggagagagaagagcagcgggctacagatttgtagccagctgtaacacggactttaagatacagtgtgtgcatgacaagtgggaccagatattaatagtgtagtatgtaactattgtatgaataagctattagattggctatagatgaattggagctaataattggctatactactgaacttgctcttaggtggcgagcaatattgttagcacgccggcactgacggatgaccgtgagctagcgatcgaggtgtggcgtgagcgtgacacggtgtcaactgtcaagtgtgccgtctcccgtctagtatgttcaaacattattccgcatgtgtagccagttgcacgtagaggacatatttgtattgtaaacaagagagtaaacacgtactactacttaaaaaagaacgcacggtattcgtttctgtaatataaaatgctccattatttggaattggtgcatacatgaacacaacaaaaacagctcaaacagaagataaacttatgtcctacattgcaaatggcgataaatgtatagcgcaaaatacctactaaccacgtacggagtatgcccaaatcaatcagccacctccagtgcgtcgttctctcgaccggttaaatcatgcaaccactcgcacaccacaacacacacctgccggccccatcaccccgaaatgatccaaccgaaccaacaacaaccacaccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64679 - DNA, 1141 bp, Oryza sativa
agtggatccccccgattatctgcaaaatggtctcctgacatcaaggatgtacgttcaaaccttgatcctatgctaattgccaattttgtgaggtaactgataacttatactgagggtgttctccaaatattagttctctaattttaatcttccaaattatgattctttgaacatatttagagtatgcaatgaaccaggtatagtttcttctcttcttagcatattttattgcatagtgttcttcttacgaacctgaagggacacattatacttctgaagatctatcacagtaataccagcaataatgtgccattcttagtgtatttcattacatagtgttgttttaacgaacctgcaggggctcatttaagcttctccaaatctatcacagtaataataccagcaatggctttggcacataattgccgatccagaaagtacatggaatggcttttggtgtttattagttaaatgatgaaaaactaaaaaagacatttaggaaacatgcagtttatgacaacagagtagtattgtctggtctcattactcatatgaaggaaaggcttcccatacactgtactttcactctactagtttattgcgttgtagtttttcttatttttcattttattgcctgccaaggtagttggatgcaaccatagttgggcatatttttagcactttagtattttaattttagcgccttttctgttccttggtttcaagttcaaagatatcagctagtcttgccttctgtgcattatgaatgtctatgtactgcactcaacaggagaaccaatgaactgaagtctgatctagacatacctgttgaaattatcaacaagtttgaggaattctgggcagcttccagagctactccactgaaaggtgcttatgttccaatgtcagcttattttccttttgttgctgtctagatcttggcctgaatcctgtgagctaatattgaagcaattacaatgtactacattgtcttattgacttacatttgaccaaaaaccctgatcctgttcccaaatgtaatactccctccattccaaattgatcatcatataatatttttaagaatattctaaaatgatcatcatatttgtgttcattcattaagtttatttgttatttg

SEQ ID NO: 64680 - DNA, 1667 bp, Oryza sativa
tgcattctttcgttcttttgggtacacaggaagaaattccatcttgaaggcatttgtcctcaaatttatgggttattcacagtgaagcttgcaggtacagaactatttgccagtattctaaatcattgcgagtaattcacttgtgtttagctttctctgaaaatccagttggagattgtttctgaaaagctatttaactcttttttggagtatctataacaactgctatagttggtattgtttcatgatctgtttaattttcagttgctcttaccttaattggcggggtgcagcatgttgatgcttcaggaacaaaggttcgtggagaaccacatatgcttcttgtcggtgatccaggtactaatatccataacatttgttatatacttaaatcaaaaccatcctttctgtacataagttgaactagtgtttaacctttttccagaaaacaacatattcagttaatatgctttcactgtaatagctacacagtggactaccgattaccgctaggctagcttagtccatatcttcggccagaccttctctaagctcctggaaaactagcttgacccatagctggacgccatcatctagcttgtccgtacatggactcaatcctctcctgctgaagcacctgcgtgaaaaagtgcatccaagatgatttcctgtataccaaaatgttactcgtgcactgcacaaattccaacactgcctcttgtatatggcagaaatgttcaattcagtccagtggggatagatacaacaactaggcttagggccaaagtggagagaatagatatccatcctttttggttcatcaacctcgaacgtgctgctcaatgatgttccagggagcaatttcactatcaaagaggggttgggaaagggggtcctctgtcccaatgcattttaccttggtaattgacccgttacaagaaatcctacagcaccacacagaaaggcatcctctaccctatcctatcaagaacagactgaacgaaacatcgctataggtaggtccaagctactattcagtgtgttctagaatgtttgctcaatccactggactggtgacagacttaaagaaaaggttaggcatattcatttagactagaactaacttgtagtcagatttatgcatctatatttgaaaaaaaaaagaagtagagtaggtcagcttgaccagccccacttgcatcttccttcccagggacgcacaaataacttcttttggattcataaaagtacagaactactgcttgacatccacaagcttcataaagtgcatttggtgttcctaatagagacactacaaacagactatatgaaatatatattatctctaactgaattgtgttctattaaattttaggcactggcaaatcccagtttctgaaatttgctgctaaattgagcaaccgttcagtgatcacaactggtcttggaagcaccagtgctggtttaactgtcacagcagtcaaggatggaggtacctatgtttcacatctccattctctggcagcattatatatcgtgttttgtatttcctcgatttcaaaatctgaaactagtaaatgatttttcatagcaagtttcttgcataataactgaaacgccattttatatttgataataggggagtggatgcttgaggctggcgctct

SEQ ID NO: 64681 - DNA, 6860 bp, Oryza sativa
aggttctgaacggtgcaattctggacaagaacaatatgacacttgccttacttcaggctcagtctgaacaggggacttgataatataccctgcatttcttatcaccaataatttgataataacaacgagttattccttggcttattttgttgaaactaatgtactagaacaccaaagcacaaataaaccatgggtttctgcagatcactcatcagaatattcaccaataacttgattggcacctagcagatcatccaattgtctgcgctccttccaccattttcccatgcttcttgccttaccctcatttctagaatttattcgctggtgctacataatgctcatcacgaacctgaattcctcttccatgctcccaatatttcacagttttcatggcataattctaactttaggtgacccggcaccccaaccaaccaaccaaccaccacccacccatgtgcctgcttgttttgctacaaacacaataatcatcttcagataatatgcttatacacctaaattatttacatgccatattcatcataaatgatagtttcatccgattgggttgagctcagaactttttaaaagccatgatacatattatgtggctacatacaacttttcaccttttcctaaaaccaatgcatagattgttgtgaaaatacaagtattttagagctctataacatctgagtagcatttctcgttgtagtatgcgagagcatgacaggacaacaatacatgaagccatggagcaacaaacaataagcattgcaaaggtatctggcctctttgatttaaacaattattaccatttagtgaactgtggcacccattaactactgcactttgattcagcgtcatttcttctttattacaggctggattagtgacaacactcaacacaaggactacagtgtttggtgccactaacccaaaaggacaatacgatccaaatgaatgtactgcacttgcacatcaagctcttatgtcgctttgctacttaaccaaaactgtgccagaccacatagtattcaaggcatatttacttgcacattctactacaccaatgtgtagtttgatactatggtgccattatatgcctctaagctgttctaattatcctttgcagtgatcttatccatcctgaccgttatatttcttccttttcttttcagccttatctgtgaatacaacactttcaggaccactgttgagtagatttgatatagttcttgttctcttggatacaaaaaacaaaaaatgggataaaatagtttcatctcatatattagctgaggtattttcattgtttttgatgtttgacattatcttttgtttggtttcttgaacaagctgcactatgggtgtgcaaacaacttagcatagcattctaaaacaaacttttaaaaattgtgcagaacactgaagaaaagaaaggcaagacaagtgatccggaagtaatgtggacactgtccatgttgagaaggtgagacaattgattccaaaaagtaatgtcgatgacctccatgctgagaagatagaaagttgtttttaatgttatgttgatatcaggatatgtttacctcccatgtcatgataaggttgagcttagagacctgtggtacgctatatgccaatattgaatgcatgcaattcattatttttgttcaacacttagaaattgttttgttggcttcagcaaatgttacttccgcagaccataacataataataagtagctaaaagttccaattgtagttggctggatagcactgagaatttttattatatttctttgtcaatactaaacaatgacgcttcaatcttttataattccaggtatattcactatgtgaagcagcatttcaaacctgtgctgaccaaggaggctgaaagagttatctctagttattatcagcgtcagcgacaatcaggaactcggaacgcaggttagccggacttgtttttgtttcttgaagtattttgcagcctctcaaaaataagttttgtgcagcaaggacgactgtgcgcatgcttgagagtttgataaggctagcacaaggtatgctttgtaatctacactggatcactcaccttctcatgcccatcttgtctcaattcttttacactttatcttgtcttttctgctgtagcacatgcaagactaatgttcagaaatgatgttacgaaacttgatgctatcgctgccatattatgcattgaatcctccatgacaacatctgcaatagtagatactgctgggaatgctctgcactcgaattttacagagaaccctgaccaggaatgtatcctgaaatgtgattccatagcttacttatccaagaatatcaaatatttaactgatgaaatctcgaactgataatttttactgtagtgccacgtatatggatgttcttgcctatgtctctggtatggccttttgattcgggcaagcaaaggtgatctgttgttcctataaacgttaacactacagtactttccacttcatgcagctgattggctcattctgacgtgaaatattttcttatggaaatgcacctttaaagtatagattctgtaaactgataggcagctttctccactccttttgtttgtcttgacatattatagatattgaacaggagaagaaaatccttacgcaattgggagttagcgaagactccccattgttataaaatatcattaccaatatgaagatttacaagcaaacgtggcttatataccatgctgcacaatgaatcaagtgatatgccaaggtgataaccactcttgcttgggacatttaactattatggtcgtcttgttcttataattataagtgagtggtaatggggaatatgggataaacattgcagggaatatgtgatttgcactagattactacggtcagtttggctctaccaggtaacggtattggaaattgtaacttgttgttttagatcaatgtactggaacttgaaggtctgaaatagcaactactccctccgtcccataatataagggattttaattttttgcttgcactgtttgaccattcgtcttattcaaaaaattttggaattattatttattttatttgtgacttactttattatccaaagtactttaagcacaacttttcgttttttatatttgtacaaattttttgaataagacgagtggtcaaacaatgcaagcaaaaagtcaaaatcccttatattatgagacggagggagtaaaaaggttctctactttatattatggcaaattatattatagacttttcattgtcactcactcttgacatttccttttggttgcaaggcacgccaagtagggttattttgctgtaagtttttttttttgtcatcacagcaaaggacatttgcagttcacacaccgcaccatatgcacctagatcataaccagattggaatgaatcccaacatacacaggtgaggctaaaaatccatgacatagataggacaacaaattaacaggaagtcaattcaaacacagcatccaactactgccagctcaccacaacaaaagcaccagttccctctgtgaaaagaaacctcaactcacttcctgaacaaacacttgacacggtgtgtgtcgatgtctaaatgacatgcaacctaacagcactgcctccaccctggccttggccctagaagaggcccagttgcacggcggcaagtcctgccaggcccagcatagcccatgacctggccctgagcccagctgcaccggcggactgcttggcgggcggcgcgagcaccgttgctggggttgtgggcgtcagaccggagcttgtgccaggggacgccggtgtcgctggtgtcgtagatggagtcgtcggtgtggtggacggggcttttggggctggggctggagaggccgcggcaacgtccacgacgagcttcatgccgttgctgcagtggccggcgatgccgcagatgaagtagtgcttgccggcggtcttgagggtgacggtggtcgtgccgctgctgtcgctctggagcgcgttgctagcggtgcacgcagcgtagtccgctgcgctcacctcatccaccgagtgcgccccaccggcgtagttgaacactggagaaaagtaaaagttgcttagaaatgcatttgcaaggcagcatatatagcaggtgaactggtgaagtgcagcaagttttgatatgcattttggtactaggaagcatcaatattcaatatcaatgcacatgttttacttctttttttttcagtttctgatgcaagtcatgtttactagttcttttttttctctagtatgatgccgatgcacattttagttaactctgttagtggcttgtttagtaagaaatctatcagattaactgatctctcctggcaagcacatgatcaaaaacaatgtgcagcacttggacaaacaagtgagaacctgaacacaagaatgttaaaagtaacgcagaggcttggttacatggcgctcaccgagggtatcgcccattttgaatttcttgtcgctggcccaggtggtgtaatccgcccccatcgcccagccggacgtgtcgccgacggtgtacttggtcgccgccgccgccaccacggcgcagctcacgaggagcagagctaccagggccagcgacgaagccattgcagcagccagaatcaaaccaagaaagggaattggcaatgtgtgagtttgtgttgctctgttgagatgcaatgcagagaggattgcaagctagggcccttatatgcatgaaactgacgaggtgacgagatgagtgagtacaacgtcgcagcagctcttcagctgagagagttggtgaagtggctttcgttggagttggttgggagcaggaaccggtccatgccttgcaaaacgcattgctttcaacaggtacttctcccaaagtctcaatagtagacagaaattgccttagaaatgactctactctagctgttcggttcattttctttttgccaaataccttttggaaaagaacagtttcttcatggtcataaagctctagttagtttgcggctgaagcttgctgctttgatgccttttcagctgcaacatctttctcatgaatcatgatgcacacacgtcgcatgatattcttgcaacgaagcagagaaagatgaggaacacattaattcaactggtagcttggcaatgtcaccagactggccattaatttgttctaccaacattgtcttccttttagaccccataaggacattttccccttataaaaatagtaagcagagtatttctatgcttgcttaatccctgattagaatcagcaatttgcaaatcttagccgccatgaaaaagccacgcgaataattggtgatccgatcatcaactttgggggcagagtaacaggtgatctatagccgtagcagctggacgcctgaactaaatagcaatatatgtttggtgactagccatctcgtactgtcatatgggtcaaagcgaggattttgccaagagatttgatgagagattgcaacggcttctggttaccggtgaagcaattgatttctggttatcggtgaaagcaatcttacttgctgatccagtagttctcgagtcatttatgtgcaagagcgacttgcaaccagaaaattttccagataatgcaacgagatggtccggaccctgtcccgaaggcaaatggaagttttggtggttgtgtgcaggattcatctacaggaggtccaaaagattaaggaacaagctagctatcaattcccggaggtcaatctctaatccggttggtgaatggtgatcacgtacctaacataaaaagattagtctcgctttagggtttggtagacaaagggcagttctgttgttaatcttgtttcgtttgtcaaaggagcatatgctgttctgttcttgtagtccctcaggtaggaagcttcaggcttcagttactactttgcttatttccagtgaaattctctgtgcagaacagtagaaagatgagcacaaacccgggttcagacttcagaagtgttccagtagtccagccttctacactactgccatggatctatcagtccatgacaagatcaatatttagtttgttgtttgcagcacaggagattgcatccaaacaatgaagcatcatcagttgtatgggtcatttcttttcttcaactctaaactttgaactagcttatttttttttcaaactgttaaatggtaattttttaaagaaaatctatataggagttgtttaaaaaaatcaaattaatctatttttcaagtttaaaatagtcaatatttaattaatcatatgctaatgagttttctcgtttcgcgtgcacgaaaaatctccctgcaacctatgcatttttgtaaatgtttatgggcccgtctatatataaacgtttcgtttatataggagttgcttatgggcctgtctattttttttggaataagttcactttagatcccttaatttgtcgcccaatctgattttcatccaccgtccagaaaaccggatacaatgcatccttcaacttacaaaaccgtgcagaagaggtccctcattagtattgtgcctggttttggatgacgtggcgcctacatggcttcctttgactaggtcctcgtcccacgtgacattgatgtgacgcttaagtggcaattggatcccggaaaaataataaaaaccgttggacgcatatgtcagcttacacataaaaaaaaattaaaaaggtgggacccatgtggtcccacatgtcagcctccctcttctctctttcccctacattgcaagggagaaggggacgggcggagcagaggggggtgggggaggggttgaagtcgagct

SEQ ID NO: 64682 - DNA, 14025 bp, Oryza sativa
gcagtgtaggagagagagagaggagggatagagagaagagggaggctaacatgtgggaccacatgggccccacctttttttattagttttgtgagtagcttacatatgggtcccatggtttttattatttttccgggatccgattgccacataagcgccacgtcactgccacatgggacgaggacctagtcaaagggagccatgtaggtgccacgtcatctaaaaccaatgctgccgagggacctcttctgcgcggttctgtaagttgagggatgcgctgtatccggttttttagaccgaggatgaaaatcagactacgcggcaaattgagaaacctaaagtgaacttattccctatttttagcatcatcagatgtacgggctgtttgtggctcatatttcttgatttaagcatatgataaatcgggtgaactctgtctggcagggtgttacatattccatttccctgctttaaaagagcgcattttgtttgtcatatccagttaattataacctttgatttggtggatagtttttttcttgaacgcgcaaaaagattacacgtcaatatattagaagaatagaatgtttgttatacgacgcaatcagtcagaccgacttatgccaagaaaggggagaaaaaaaagactaaaataaagaagagacgaaagactactgtgacggctacacacaactccaaatagctgggagggggcagagccactaccttcccaggagaaccccaaaattagcgataccagctaaagaccaaaggtggccctcagagaggatggactcaaggacctccgagaccgatgacaatgcagagtcgaaaactctggagttccgctctttccacagttgccaagagactaggaagaccatagaatcgaaactggcccggagatgccccggcaagcaaaccctagaagaaggccaccaatcttggagacagctacccccgggaggagagagggcagtccaaccaagaggcgacagcacacggagccaaacttaccgagcgaacacggaatcgaggagaatgtggttcgctgtctcaagcgaacacgcaatgaggatttggtggatagtagcgatgggacaaggtatttccacactagaatagtaggaaactttcgatttttcaaccgtcggatttgttttgagatgcatactagggggaaaagaaaaaaattcacgtagaaatgggggcaaggggaatcaaactcacagcatgctgcttgcgactgcggaagctactgctaggggaaatgattaacactaccgctaggccagctcacagtttaatcatatacttcctcatccggtacttatattattatattatagggtagaggaagtatttataatttatatacaagttacacggtaagtaattgcactaatgatattatctaatgacactatagttgcatttgaaagtttttctccttaaaaaaatgtcaaatgttatatagctactccttttccacacaccacgacttgattgatatggcttgttcaattaatttgttgccaaaacaaactataccaaaatttggtaatataattttgttagtgcaacaaactcaacgagactttaccattgtaacattgtcaatttgtaccaaaatttaataaatccaataatttttattcacaaaactatatcaaaatttagtaaggtgtcaaagccaaacaacacctctacatcttgaccttgacaaaaatttggtagtgcaaaatcttggctttaccaaaaaaatttgaaaatgtttattttggcaataaactgaacatgcccatattgttttttaatgtcacaacatttgaaacctaaattcatctagcatggtaggcctgatgccaaattaaggatgactttttttctcccttttttatggtaggcatttgtacaccacaaattcttatgtgacaatttggtttcatagctaattttccttaaggttatatttttgttgaccaaatttttttaacctactcatcgcaaagttaatcatgaatcaagcatgtttaggttaggtttagggaacactaaccctctgtcatttaaggatcaggcatacattctcacaccactggagatggattaatcggtacggttaccttgcaagctacgctgactccaactacagctcatccccttcttccctctcacaactttccctcacttgtgacaatggggagataaaggtccagcggcagttgatggtagacgatttttcttcctttaagattagacactttgtagatacagtctggatggaagaggtgtctgtagtgcaaaattgctacaccttcactcatatgcaatctagatggaagatattcctgtagtgcagaactgctacctcatctctagcggtgcactcagggattcatctgctacaccttcactcagtgtggatgcacgcttcgtggatgcgtgggcctgttcactttgatgtcattttcaaccttaacaaattttagtaaagttgccaaaaaagtggctatatttaatttgctgccaaattttggtagctatataaaaaatcctaccaaaattttgacaggcaactataccaaaattttgataatgacaaaatttggtaaggttttttttagcattaaagtgaacagacctataatctggatggaagatgtgtccgtagtgcaaaattgctacctcatccgcaatgtgttgtactcaattcttctgtacatgcagaaggatgttcgtagtgcaaaacggctaccacgtctgcaatgtgttgtgatcaaatgatgcatatgtaacgatgcactatgatgcgtagcaggtttgcataccaacatcctcacgtatgtcatcgatcctctttaattagtgggtatgtagcaacgggtaaatgtaaagatcgtatgcgatatagcgccaaagttgtcacatgagaaagaccaccatgactatcaccatattaccacctatgatcctaatgatagaaataaatacatgagattgtgtgaagtgaacacgccaaggtgtttaaccatccagtaaattatatttatggtatatatatcaatgttaaattttataagagattgtgtgacgtaatatgcggtagcgctaatctacgcgctacacgcggaatattagttcgagcgccgcacaacgctccctccttctagtttttcccttttttaccaccgtacctttactccacatcccacatttcctcagttcatttttttttgttttttaccaccacaccttccgtgtttcttttttctcttttccatcttatccgtgctttatcaaaggatccgttaaaatattaaccatctagatttttccctttttctttccttctctctagtttttctgttttcgcgttttagtaaaatatttaccgtttagtttttctttccgagttttatttttttctagtgtctccccacgtttcaaaagtaacgaatttactcctatactcgcatgaatgccctttcaaaagtaacaaatttacttgtatgaatgcctccacatcgtacgacaccattcctagatggttataaaataattactaccaacttacaacgctagcaattcttttactggtgttataaatattgtctagatttcgtggtctacgagtaaaacaatgctaccttcctctcgatatagcccatgatctcatagccaccgtgtaataatatgtttagtgatgtgttcaatacatagcataagagtaaaaactaagacttaatggtctgtgagtaaaacaattaccacattcatcttgatatagcccatgatctcgtagccactatgtagtaatatgtttactgatgtattcaatacacagtaatagtattgttaatctatatcacaaaatggttgtacgaatgaaaaaattataggctcaatcacacataagtgataaaaattacccacaagtgaatcaaactagaaaagaaaaaaaaatgattcagccaaaaatccatcgtgaaactaggatcctggtggctttgttggatcttactataaggactggtggctttgttggatcttgctataaggatggagaggttggtttgtgtcttatgacaggtagtggagagggtaaccgggtggcgagtggtagctgacgatggaataatggaaggatgtagcggcgtggtatagagatgggctcgatgttgcgcagtagcagacatccatcatctagcaagcacgaaaaaaatgcaaaaacattctcgttcatgtcatagagacgacgagcaaaagaaaaatagcaaacaatctccatcaccgacggactccaccctatcctctgtgaccagccacatggagcacgatgtgcaaatatgagacctatgcagcacatcgatttagatcagataatattggagattgcacattaatttgatttgaaaaaggaattggggcttcatgcgtgaaggtaatggagagtattgagatgtaaatcggagtgccatttccttacttgcttgttctgttaatgtcgctgacgtggagcagccgctggttgttgctcttggcctaggtgaacacctccttgctggttaaggtgctacccaacgtccagcaacgaggcccgaatcagggcctttgcctcaaccaccaccggccaccgctcgccggccatcgccgtcaaccgccacgatgtcgttgttctcctccatggtgctatagtgtgtcaccgatctatgggctgggatggtagatcaatttagatcaaaaaaaagggaaaaaatgaagtggggcgagagtggttggttgggtacgggaaaaatagaatatatatcggaagcaggaagctatttttatcgatgtaaatcatttactccgataatagtgggagtaggatgacagaacgtggggtaggatcggaagtagggaagttgtttttattatcaaagtaaatcgtttactccgataacagtgggagcaagatgacgggacgtggggtgaggtgggcggactaatacatgtttggcgctcggaatactaagaaacacgctgtgctcctaataatagtactacgtaatatgctattttattatagactacatttaacaaaactactaaacttgacaaaattatgatataattataaaatttgtcatatggcggacacagcaggggacacgtgcccccttactaaataggaactgccaagcttctctttcaatcttgtgtcgtcgtttccaacaaacactctgttattatccttaagttttctctaatggcacacaatttgaaatcaaaattcaacaagcacaaccacgatgcagtgcccatggctatcccctggagacatgaaaccatcaccgtatgctaacaaaactaattatgctcagcactaacaaagctaatctctattggctaaaatttatgtacagcattcctgatcttgtataacccacaacatttaatttgatcccattttactattctttactgaagctaatgctgaaactgatcatgtaaaccaccatcctgaacatattgcacatttctgctgctctgaactgaaaagatggtgctctgatctaacaaggcagtgctgaaactgaccctgcaaaacccacatttaattttaatctttaattatatcatacttcctggtttgttgctgatgtacctagtcaaggctgatgttgagcatgcaagatcccagtgaatttcttgacagttgacacataataattacgtatgcatccttgttgtattctcaaaataattcactctaactatatgtggcaggtctggttaatactcaaagctactagactgccataggagaaggacatggtctgagtataagaggatttatttgctagtttgacaatatagaatatttatgttttcaaactggttacacatgtttaaacatatttgtagacgaatggactatggatcatggtcccaaaatgagttcaatcatcactacatatctatatgtgcatccatttgctatatgttcaaaatgcggcacagcctaaccatccatcagaattcagatggtggtcattcctgtttgtttactcctcagttcttcttgaaccacctggtgtttgtttgcaaatcacctgctgtttgtttgacaatcactagtacttttatttgcaaataacttacttccttggtaaataaatcctcttgtactcagaattcagatggtggtcattatagaatgacaataaaccactagtacttttatttgacaatcaccatctgaaccacctgctgtttgtttgacaataaaagtatctgtaggatcgagatgtcgactagagggggggtgaataggcgatttaaaactaaatgacacataatcaaaactaacctaagttgctaggcttggtgagggtcaactctaactaagcaactaaattatgttttgcaaacctagggtgatagtgactcaattatatctctagaaaagtaaatcacactcctatgtcaatgtttagcaatcctagggtgatatgatctcaagtatgtctctagaaatgtaaattgcacaaatgtaaatgcgacaatcaaatgagataaggagacaagagatttttcaccgaggtttggaaactcgccagtttcctactccccattgaggcgagcccaactccaccgctcaaccacgaagccaccgcacgcccccttcatcaaggggtgggcaaggcgggagccggcccacggagaggactacccaagcctcgatcactagggtagttcttccttcactccgaaggtggtgaactccaaaccactcacaaaccagcaccgggcctcctccacaatcttctcggaaaggtcaccgggcaactcctccacaagctgtctaggaggcggcaacctccaagagtaacaagcaatgacccggcgtggagatgatcaatcaagtgccacactagctctacaatggaagcaatgcacttgactcttggctaattaaccctctaacacactagatggatgaacacaaagctcaagtgggtgtgagagaggtgcaaggggtgtatgcaattgaattgggtgccaagagagcccccttgctgctggagggggagtatttatacttccaccaaccaaaagtagccgttgggggcgaaatcccccaactttgtgctctgccggtctgaccggaggtatgtggccggtcagaccgtgctactctacaacggctagaaaactagccgttgtagtgttgtcagagggccccgtcggcctggccggtcagaccgaggttgagtggccggtcagactggcctcggctgaccgactacggctccgtcggctctgtatcggccatcccgagcagcaccatcccggcctccagggggccggtctgaccgcgcatgtgccgtcggtcagaccgccgttgtgtgtccacaattagtgcttctcattaattaccaaaattaacaacgggggcctagatgcttcaatctccccctttttggtaattgatgacaaacaccacaaatatatatatataatcaaaagctccccctaaacatgtgcatatcaatcatagacaacaaatatggagccaatgcacattttaatttcacatttcaacaagcacaaacacataagcaaaatttcaatgtgaacttcaagaaatattcatccatgagcataagatggtcacatatatatcaatatcacatacaccatccatcatcgcacaagttcacatcacttaaccattcaaatcacataagtcacaaatcattgctcacaaataaacataggctattaagaccatgaagggtccaaatgacatagagagtcaaacaaaatgataaagaacacacaatatagagtaatagcccatacccatacaaaatatagcctaaacctccttaacctattagatatgaggtgactaacctcactaccactaatcccaacccacaagacataaagcgcacttttctcccccttttggcatcaagtaccaaaaaaaaaggtcttcattcttgtggaggagaaggaggacgcgccgaagtggaaggatgaggagcatcacgacgacgatgatacacaaatgcttgggagctctccaacatttggacttgagaatccaatgtacccactctagtgtgcaatctccccatggaagcattcaagtctccaacatccgtgcgcaagccacgaacatcctcatgtcatgcttcatgcccggtagacaagcgttgaatacttttacttagggtattaatagccccaagtaccgggttgaaatattcattgggttgaattccaaagtaagtatactgtggatggaagaaagcatttggatcatacccatgaggaggaggaggtgctgagcttgagctagctccaagatgagaagagggcaccatcctaagcatgtggagctccaagctgaaggcggggcttgtactgcttgtgcttcttcaaattttgccagcagccccaagcttgtcttgaatcaacctcatgatgtaaggggcataatagattccctgagtgaatgtccccttggagatggcaatctcctgcatcatgagagacacaatgtcgaactgacgaccctgaatgatcgtatcgatgatgtgccaagccacccctctaatgtcatcattgttgccaaggcgagggaggatagtggctctcacaatcctgttaaccacactggggatagtcctcaatccggcaaccttcccatgtgtgtaccgcactccatcttcataaaactgagagagatagtctatggagagcggattgtgagtgtgctcctcatgcaaatcatatccaaagtctaggcgaatattgaggagccgccagaattgcctccgagagatagaacactggagggtatcggacatccacttcatctcattatagtccccagccacccacactgtagcatagatctgtcggatcaaatcttcattgtagtcttgcttgagagtcacaatccggtcaatgccaacagtcttgaagagatcctacaagccctcaaactctggagtctcgttgatgtctctccaagaaatccacttatgctctacaaatgctttccctgcataaacctgctcatacacagacttctggaaagcggtgtgaaaacggggatccggggtgtcccgaggccttaaaaactgatcatgatgcctcaagatggtatactgcgatggattcctcatgttcacatcaaactagatggagggatcaacgtgcatatcatcacttccttcatcctcatcctctccacttccactgtcatcatctccacttgcctcctcactagccccctcaatatttgcttcaacctcttcatcactttgagcgtaatcctctccgctcgattcctcaggctcactcacgggatccggagtgggcgcacaacgaccatggcgagtgcggggaggcatcactgtcaaagagcaaaggatgtgtaagcaatgattttagaaaccacatagtgaggtggacggaaacggttgtcggccagtcaggggcagtcagaccgcggaccgatggccggtcagaccgacggccacagccagtcagaccgcgagcatgccgcccggtcagaccgccgtggtgcggccgtgttgacgaaaaaaatcgaacacaccggcctgggagatctgcttagctcatgtgcaggtccaaatcttgatgagatgcgagcgtgccagtcagtttgatcctgcaactgacaagatatgcaaatagtagacaaaacagccgatcggttgacaagtcgatggagtatttccagccgatagccgataaatagccgatgctgataccagccgatagcgatagggtttaagcaatcggctatatgtccaatgtagatagtgatataaacgcaattggctgacgacgatgtaataaaataacaatataatccagtagaaaccaatcggctagaaacaagatataataagtactgatccgaaggttaaagcacacatcggctcgaggtccgatgtcatgaaatccacaagattagattaaacagtgaaacctttgttgtcatcggctaaatccaacttatatgtatatgcaatccttatgagccgatgcaacatccagataactcatcggctgaaaccccgatgaaacccttattggcaatcaagaagcaggctagagattatggttctaagcacgacttagtagatgaaactcaactgatgcagcactaagtatgaaaagaaacataatacctagacaatcaagccgttgactgagttttcagggtggtagatgtctaagctaatctaatctagcaatgcgttttagccgataccggcagaaaccctaaaacgagaagcagccgatagagctaaattgatatgctaagactagattaacagagacatatgataaataggtaggcaaatatatcatccaaaccagagcaatccaagaggtcgaatgtaccgatgcagccttgaacgatgccgatgtagatgagacaattgcctgggccgacggaacattggacttaccccttcgccggagatcgaacaccgatgcagccccgcgtcaggtgccaagtcccgccggacgataaaataaagtagaaaaggtaaaaggtggcgatgcgccgaattgtattgatcgtggagatagattacatagaccccgggtgtacatatttatacccatgggttgatacaagtccttgtcggacaagaaagaaatttttctaaagataaaaggaaaagataaagtccttataggacactaaacacactttcctaaagataaaaggaaactaacaaactatttctaattaatagataacttgccatgctgcattctctttgaactcggtctcttctggataatcttcttttagtagatcaatttccttaaccgaatatagcaagaatgcgacaactgacgacttgacaactctcatcggctaatctcaggacttcgaagccgatgctgactctaagccgatgactactccgggcttaccaaatttcactgttaacaggccggtcagaccgaccaggagccctcggtcagaccggcgagaggcagccggtcagaccgcccctagggctagccaaaccgccactgacagggtcaaccaaaaattcatccacaatcacacagttgattccaacaaaaaaatgctaggacagggttgcacaagattggaatatgaacatcaaagggtatggcctatttcatcaagactggaacaactacccatagccctagggtgaaatagatcgatttgagagaatgcacaagagggagagtgatttaccggttggaggagttgaatcacaccaagaaactaccctctattgacgcaaatcgaagaacacctcgtgcttcacctagggttccatgccatggatcaaaaactcaacaaaaacacaaacaaatccatggaatagagagaggaaacggaggagaatcacttacggtgtaaccggagagaaatccacggtcaaaccgaggggatttggtggagggatgtggctagggtttgggagaggagagaagaggagtttttttcgagttggggaagaagatggctgaatgagaggagatggagtcgggtaggggaagaagagagaaagaaaaggaagattcctaggcccaccattcccggctggtcagtccggctatatgcggccggtcagaccgctagggtgcggccggtcagaccgggccctagtggccggtcaaaccgccgccaccaggccggtcagaccgcctggcccccagccgactgtgcacagcccttgcacagttcggttacccccactcaataaaattcaacaaaaatttgatttttggagcaattttgaaatgtgtgagttgaaatattgccaaccattcataacatttgaaaattataaagatttgcaacgaaactcacttgagtgctaggaggtgaccttttatggtctataggagtttttgggcgaatttgattttcaaataacttttgaatgatttggtttttgaaataggtttgaataccaaaaacatttcaaatcttcttctctaccaactttgttttgaaacttttctcaaattccttctcaatcttattttggggataaatctcattttggccaaaactaagaatctagattcttcaaaagagggccaaaatggcatttttcattcaaaaatcatttttcttgcaatgtgaggcttggaaaacatataggaaaccttttgaaacatttttcaagagatagttttcaaattacattgattttgcaaaagctttgacttatgttgacttgggcattttgaaaatactactagcaccactagttgatttgctcacatataaagagaggtagagcacatgcaagagtgcaaaactctcccttaatgtgacatgctccattttcgcaatgaagaaccaaatggcaacaaatccaaagcataggagcaaatgagagcaaatatacataatgcaaaagaagcaaccatggtgcaccatctcaagccacattagagaaatctatgacatttaactcattcctcaacttgcaaaagcgggtttcatcaagaggcttggtaaatatgtcggctagttgatcctcggttcttatgtggctaatgactatgtcactcttggcaacatggtctcttaggaagtgatggcgaatatcaatatgcttggttctagaatgttggaccgggttattggctatctttatggcactatcattgtcacatagaagtgtgattttggtgaaggatatgccatagtccaacaaggtttgtttcatccaaagcaattgggcacaacaactacccgccgaaacatattccgcctcagcggtagagagggctacggagttttgtttcttggatgaccatgacacaagggatctactaagcatttggcaactaccggatgtgctctttctatccactttgcaaccggtataatccgaatcggaatagccaacaagcttaaacttagcaccttttgggtaccacaagccaatagtagaggaatgctttaaatatcttagaatccttttcacggccaccaagtgacattccttaggagcggcttgaaaccgtgcacacatgcaaacactaaacatgctatccggcctagatgcgataaggtaaagcaaactaccaatcatggaacgataaagctttaaatctaccagtttacctccctcatcaaggtcgagatgcccgttggttgccataggtgtcttgatgggcttcgcatcctccaagccaaacctcttcagtaaatccttgatgtacttggtttggctcacaaacgtcccatccttgagttggttgatttgaagtccaaggaagaagctcaactctccaatcatggacatctcaaattccctagacatcatatcaccaaattccttgcaaaatacctcattagtagaaccgaatatgatgtcatcaacataaatttgacacacaaagaaatcatcaccaatgatttttgtgaaaagggtggtgtcaacttttccaattttgaaatcctttgacaaaagaaaatctctcaatctttcatatcaagccctaggagcttgttttagaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaaacatgatgcaaatgcaagaaggatgcgaatagcctcaagtcttgccacgggggcaaaagtttcaccgaagtccaaaccttcaacttgtgtgaaaccttgtgccaccaaccttgccttgtttctcaccaccaacccgttctcatcttgtttgtttctaaagacccactttgtccctatgacattgtggtctctaggtctttcaaccaaagtccacaccttgtttcttgcaaagttgttgagctcttcatgcatagcattcatccatccggatcacaaagagcttcatttacatgtttgggggatccac

SEQ ID NO: 64683 - DNA, 27034 bp, Oryza sativa
gtggatcccccacatgttttggctcaagacaagaaacaaacgagtaatgttcacaaatcgaagcgacacgagatcgagtttgaacacccttacttatgtcacccaacacttggtcaattgggtgatccttggaaagagcggtgtgtatccttggaggcataggtggatcttgtgctttctcctcctccacctcaacttgagcttgacttggcgtagcggaagtagatggcttatcttgagtggaggtggatggcttgtcttccacttcaataggcttgacatctccaatagacatgttcttcatagctctcatcaagccttcatcacctacatcatccaaattctcgtgcccctcttgggagccattagtttcatcaaattgaatatcgacgatttcttccacaatacctttattcttgttgtagacccggtatgccttgctatttgaagcataacctagaagaaacccttcatcacaccgactttcaaatttggttagtctaacaccctttcggtaaatataacacttgcaaccaaaaactcgaaaataggcaacatttggcttcctcccaacaattagctcataggaagtctttttcaagagacgatgcaaataaagccaattggttgcatggcaagcggtgtttatggcttccgcccaaaaggaatcggaaacaccatattcatcaagcatagtccttgccatctcaatcaatgtacgatttttcctctccactacaccattttgttagggtgagtaggtagcggaaagttcgtgtttaataccaagatcatcacaatagtcctcgatattggtattcttaaactcggaaccattgtcacttctaattttcacaagagtgcaattaaattcattttaatccctttttgcaaactttttgaaaaactcggcaacaatagacttgtcatgcaaaaagaacacccaagtataacgagaataattatcaacaatcacaagacaatgactattaccaccgatgctcttataggttgttgggccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgggctagcctcctatgctaaagccaacccaatgaagtttttgcaactaaacaagttttcaaatttgctttactagaattgaaatcaaccaaataaagatttccatatctaaaacctttgaacacacaagacttgtcaagaaggctagaaacaataacttcttgcgggaagaaagcatatgacaagccaagatcacaaatttgagcaactgaaagcaaattgaaatttagagatttaacaagagagacattatcaattgacaaatcattggagatagcaattttacctaacccaattacctttcctttgctattgtctccaaaagtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtacccaaacttgtttgggtccttggaggttagagaccaaaactttgggcacccaaatgacattctttttaccaccgagtataggggaacccacatatctagcaacaatgctaccatcatgagtcttccaaagcatataatgagaatcaaacatgcatatctaaatacatatcattgctcttgacaaaacgagtggcacggtgagaaggtttcttacccttctttggaatgaatccaagtccctccttgttaaggatgcaccgttgctcactcaaaatcttatcaagagtgttcttacccttgaagcacctctccaaactcttgttgagcttggccacttgctccttaagctcattgttctcaacaacaagtgaggcatcacaaatagaaatacaagagctagagctagagctaggcatatccacaagaccatcacaagaggtagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatagtgagtctctcatgagaggtctttagttcctcatacaagacctctaaagaagcatgatccttttttagggccttgaacttgacaatctccttctcactataagcatggagctcctcaaacatactcacaagctcatcataggaaacatcatcacaatcatcatcactctcactatcactaagagatgttaccttagaggagccctttgccatgagacaaagtggagcgaagagtgatagagcctccttgatggcaacaacggccatcttcttcttcttggagcttgcatcctcaccaccttcttcctcggacccggatgaggcggagctctcctcatttgagtcccattccccgatgaatgcctcaatcttcttgccttccttcttgagcttcttcatgagcttatagcctccactcttcttcttggatgacttgtctccatcatccttggaagggcacttggaagtaaagtgtcccttctcaccacactcaaagcacttcaagttggagagagtcttgttgggtcttctatttcttctcctactggagttggagccccttcctctctcctttctccttcccaagagatcattgaaccttctagtaagaagggcaatctcttcctccaagtcctcattggcttcattcactttgcccttgcccttgtcttcaacttcggcttggagagcaatgcacttcttggaaggtgaggcttcctccatctccttcttcttcaacttgtacatgtcattggtgttgatcttccccaagaggcttgcgggtgtcatccttgacatgtcggagttgatgagcatggtgacaagggtctcatacttccccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcgcttgtgccctcatggatcttcgccaacttgccaacttgttccaaatctcatatgcggtctcaaggtggctcactctatcaaactcctcttggctcaaagagttgaacaaaacattcattgcttgggcattgagttggaggttgcggtgatcaatctccgtcaagggcgtgccggtgatagcaaagcctacatccacaatactccaaatatggaagctcatagctttgaggtgagtagacattttaattttccaagtggaatagtttgtgccattaaatatgggagccttccctacatggttcacctcgttcgacatcttctctctaggcagtgaaacccaatcaagagagaccaagctctgataccacttgtaggatcgagatgtcgactagagaggggggtgaatagacaatttaaaactaaatgacacctaatcaaaactaacctaagttgctaggcttggtgagggtcaactctaactaagcaactaagttatattttgcaaacctagggtgatagtggctcaattatatctctaggaaagtaaatcacactcctatgtcaatatttagcaatcctagggtgatatgatctcaaatatgtctctagaaatgtaaattgcacaaatgtaaatgcgacaatcaaatgagacaaggagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggtgtggagatgatcaatcaagtgccacactagctctacaatggaagcaatgcacttgactcttggctaattaaccctctaacacactagatggatgaacacaaagctcaagtgggtgtgagagaggtgcaaggggtgtatgcaattgaattgggtgccaagagagcccacttgctgctggagggggagtatttatactcccaccaaccaaaactagccgttgggggcgaaatcccccaactttgtgctctaccggtctgaccggaggtatgtggccggtcagaccgtgctactctgcaacggctagaaaattagccgttgtagtgctgtcagagggccccatcggcctggccggtcagaccgaggttgagtggccggtcagaccggccttggctcggtcagaccgccatcggctcggtctgaccgactacggctcagtcggctttgtatcggccatcccgagcagcaccatcccggcctccacggggccggtctgaccgcgcatgtgccgccggtcagaccggccttatgcgctggtcagaccgccgttgtgtgttcggtcagaccggccaggacacgacagtcagaccgccactatgtggccggtctgaccgcccctgatcaggccgaacccagtgaatacaaaggtgattgtgtgtgtgtgtgtgatgaaaatgtgagcacaagtgaaaatgcaatgacctaatgtggcaatttaatcatctctttgctaggtcattaccccccttgatagtacgcgaaactaacaaataaactagcaaatttgatcgcccttcacctcgatcaattttaaaactaaaactctagttttaccgttttcttttcttcgctccgcgccatcaaatcttaatccatcgatagtcatccatgcgcacacatgacgtggacctaacttaaaatatgtctcaatagcaacggttagtccacaattagtgtttgtcattaattaccaaaattaacaacgggggtctagatgctttactatcgcccgccacatccactacatttttgcaaagaaccccctggcgaggctttcctcttctcccattgaggggtcagggccatcaggcacacaaaacattttcctgtcgctgcaattgaaggggatgccctcaacggccgcggcagcgacgccttctcgccgtcaaatttgaaacatacaacaatgaatcaagtaacgagtggcgtttcaggttctctccaaaaccaaatctttaaattttttcgctccccctaacttggtcctcaactaggcttgtagatcgcggcggctgatagcggtcgcatcggtagcacgatggcagaagcagcggcagcggcggaggcacaggcagccagaaatggaggctaactctgtgatgtgcccccttgctcccgtgccctcctgcatcgatccagccccatgagctcacttttttgatgaagttttcccagagcagccaatttgttgaagcacactactagatgatgtgcaagaacaagattttttataacaaccattgctacttctaggtggttcgcaagaacagtaattagcaataacaagaatcaagaaacatgttgacaagaatttcttattttgaaccattctgaattttgagaagaaatatggttaaggctgccaatttgtcctagttgtgaagctagatgtattgaagaatcttgctgtataagttgtaaattcatccaataagcagctggtgattgacaacatgcatcttttattacttttgtttttccttttttctatatttgagagatgtgccagcaagcaatacactggatgaaaaatcttctaaacccctgaaactgaatgcaatggtttctgaaagactgttgatatgaatataatagattttgtttgcttatccattcaagtaatagcacgagcatcatgtttaattatatgaacgtgctagtcatcttaattaatatgcatgttctgaaggctgaacgcctgaacacactgatatactttgcactaggatcacctaggttagatttagtcgggtggttctatttgggattgatgaacgacattgtagatgaaagggagaggggtttagataccgaccggttgaggtgttcgtggaggaagaagcgccggacatcgtcgttgtcgtcgcagcttgacgtggacggcggcgacggtgtgcttgacggcggcggttgtcgttgcagcggtggtcgtgggcaatcccggcgaggtcgtggcgcggcggtggcgtttcccgtcactagctgcgccccctcgatcggattagagtttgtagggcggagttggcggcggcgacgaatctcgtaccttgtgccgtgccgacctccacccctcttttatatggcgcagtgtgacggggacccaccagccattaggctgggcgcccccgatcagggcgcggtcaaggtccgttgtgccgttgggcccgacgggtgggagatctatctaacacacatcaacaaagaaaacgaggtaagcaaaagaactgggaaatcataacatttactttaaaatgaactgaattatcctgtcaaatactaagttcttgtgttgaactgaattatttttcagctgctagccgcttccatattcttttgcccccatcatcatttaaattgcttgcatatattgcacaagcgtacgtgttgttttaaactcttccctgctaggatgacaagctcctccagagtctccgtttttgcttcaggcaagaagaatcgagggagaatgaacgtgtggggaaaggaatttttggaaaacgatgagggccttgagccgccgctggaagacgatctggttgatctgaataatcgtgggatggataaccaagggtcagggggttctttgcaaaaagtagtgtatgtggcgggcggtttttttttttttaaattgctgcatccggttggcagcccttggattgagatcgagaggaccccattgcacgagtgcatgtgtgcatatgatggctcgtgtgcacctgatacgctgccgtgctaagcagctgcttggcgcaatatatatgtaacaatttgagtggtttaggccaactcaatttgtgaaaccatacttaccttgcaagctttcatatcagcatttcttaaaagtttaaactcggtgaatagtcattgggattcgagcataaggtcatattcgtttggacacttttctaacttttcctccctcgtacgtatttatagagttgatgaaatgccgagatgctaattctgcattaatcgtcactgccctataacaataatataaatacgaaacccccatgcctcatcatgacgattctcaaacccgttcgtgcacggaccataagcgcgtgttggccaaattaatagggtttgcattatgcaaagtctaaagacaaagcatttgcagcctacttccagctaaggatgcaaacaggtcaacccacgaacccatttatagacgaaattagtggataacccactgattgattcacaggttacctactaatttaatctataaattaatttattatatattgaccacttactccctccgtctcaaaataagtgcagttttgacaattcatgtctaacctttgaccgttcgttttatttgatttttttaaataattagtatttttattgttattagatgataaaacatgaatagtacattatatgggactaattttttttatttttttcataattttttcaaataagacggacggtcaaacgttggacacggatacccacgactgcatttattttaggacggatgtagtatatctctaggtgtgacaaaccaaaccaccacgtgaaaatttacatgttaccatttacatgtaagtaaattcgtggatccgcttgctattttagcaggtcagcactccgcacttcagtactctctccgtttcataatgtaagttattctagtatttttcacattcatattgatgttaatgaattagattctataatgacttatgctgtgaaacagacaaagtactcagcacacgccgccttcgtatgcgtgccgcgacgtccgtcgggacagggacgacgaccgggtgtatggaggcaacgtgccgcacccgcccccaccgtccggacgatcgagatccacgtggaccggaagactttcccgcttcgcgtgaggcggacggccgcgggccgcccggccggcctgcagccctgcacacgcgctggacgaagcggccgatctctccacgcgcgctaatccgcgcgccgcggcgttgcaaaatggcagcctcgatcgctctcccgtaccacgtcgcgtacgtacgcgcgccacggtaacacgatacgggagctcaccgatcggccggttggtgggggtggggtggatggatgtcacggtgaaagtagcagtggacaagttgatgttgatttggctgatgcgcaaaaccaagggttggtttggcttgaggcctatattggccttaccaatatttagcaattttaatagtgtttattgtctatttgttttggagccaaattttagcatgcctaagaaaatataccatttcaacagttaatttaggctattttggcttcaatccaaacacaattttatttttgccaaaattagccatgctaaaagttaccaaaatttgatattgataaaaattggtaaggctaatttaggccaccaaccaaaccagccccaagtcaacactcgagactagcgtgcacatcggttcggttcaggaatcaggacaggagggttcactttggttgtatcgcacgttctggaagcggatgtacttagtattactgtgagtacgctctagtgctctacacactggaagagccacttgtggagatcaattacaaagagccaatgtgccatgttcttgacttgaggacgtcaccacaaaccgttatcaacttgtcgacttgtgagttgtggcgaccttcacaaaatgcagtacaaaccggccgaagtccacccacctgcacagcagaaataaatatactactagcacttatatttaagcatcctttaaagcacagaattttgcaggaatcagtcacattcccaacaagtctttaaccccataggtacggagtgagtactccgtagcttgatatacacctttcgtttaaaaaaacaatatttactataaaactgaacaggtatatttccagcttcagtttgtatcaggttatttccggacctcataatttgcaggacagtcgggacagacagacaatcgacgcgtgcacactgtccgtcaagcctacagctgcgtgcgttctccccagccacgcacgacacgaggttcgcaagtccaacccacgcgccgacgcgagacctactcgaaacacctggacggcccggatcccccgcccgcgcccggtcacggacgccaagacgccatctcgtctcgtccattccaacccctccaaacccaaaccccccaattctgaccgcgcgaaccgcgactcgcgccaccaccagaccagacgacacgacacgctgcgccccaagtcatataccgcccgccgcgacctcgtccaacaaacgcaacgcaaacactcgctcgatcgccacatgccgacgcctcgtcctcgccaccgccaccatgcgctcccgctcgcgctcgcgctcgccgcgccgctgctgctgctagccgcggcggacgggcagccgaacgagtcgagggacaagaacaacggcggcgggggaggtgggttcatggcgcccagcggcggaggcggcggcatgggctctcagtcgccgagcttcagcgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcggtgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtttgagctcgcgccatgcgcggtggcggcgccagtgcatgcatcatctgatcagaaaaccaatccgcggcggcttctcgcagcgatccgccatggctggaccttcgatgaatcagctcgtgcacggacacagatcactagaaaagatcatcaatttgagttgaaaataccactcctaaattagtactagattgttaattatacatttttctctccattgcttctttggatagagaagtggcgtggaaacgttcaaagatccaatttttcttcccctccgttgaaaaactggagcggggttgtacttgtaccggcactgtattcaaatattcatgtgattattcgtatccttcaaacgagcttaggttgctggacttatcaaacactcagctcaagcatgccagaatttgtttttttttgtttttataaaaaaaaacactgatactagcagtgttccctccaaatggaaattctttagcacgttttccctccacatggggattcgttcttctgatcttgagttagttgggggagtatgattgatggcctagttgaagaagaaattacgcatgcagtgacatggtcatggtctgcaactccgcatcagctcagacgatgcaattggaacgtgtcgtcagtcaaatgatgcacttcccaactgaattctcaacgccgtacctgtacagtatcaacttattacatgtcatcctcatttataattattcgttatgaattatgatatcaggagctgcctagcagtacttcgtttcccaaacggcatagcataaggtcggaaaaataaactatgatgaaaaaactctaaaatcaactacaaattttagattaaaaatttaaattttgacttacaagcataagcgaaaagatgaggatgttctcttctcctggctaggaattcaggcccagtttgagattgatgagattaagattaagtaaacataaaatgagagagccattagtgaatcattaatttactaatcattaattgagttttaataactattgcaaagttaaaaaaattgatttgtcgtgaccttacgtcacggacaagttcggggataaacagaaaaattcatttttcctgcctatcctaagaaataagctcaaacacaaaatgcacaactttggtgattgatattcctctattaaattatgtccccccttgctacaagatttcggcaagcttatatagcctatagccccgtatatgtgagattacaactttgcccctatgggcccttgtgagtttatatccttaccatgtcagcaaccctaagggcattttgctatattttggaggtcattatggtcttttgacgtcagctagcacgagtggttgcgagtggtccccgtggaatcttcttttggcatctttcttgtccaagtagtgttttccctcgagttattacattgagcgtatttcccatcttgagtcgtcttttttatctcgagggttcgaacacttcttcccacctacctggctctcggaattttttttgtcactagttagaaatctatctaaacaggacaagttgtttcagtagcacaaaacctttcgaatagaactttccgactcgaatagtactttaccgttcgagtagtattttaccactcgaatagtattttaccgtttgaacacttagggtgtgttcgctagtacaggttcccaactgggaacagcacgtgcaaaaaacagagcgatccattagcgcatgattaattaagtattagctattttttttcaaaaatagattaatttgatttttttaagcaactttcgtatagaaactttttgtaaaaaacacatcatttagcagtttgaaaaacgtgcgcgtggaaacgaggaagagaggttgggaaaaggaggtgccgaacacatccttagagttttcaagacctccttttctttagtattttgaccaaatagggaggatggtgttgaccccgtgctacaacatgatttatttgatattttaaatcaacttctatataaaagtcttttgtacgaaagacaccatttagcagtttaaaaagcatgttaacgaaaatcaagatagaatctatatctgaattagaaaaaaaagaggatggatggtgaacactgcttttctttttctttacacgcctttcaaagtggacacaaaatgaagtatacttagataagaaactattccctctgttcccaatatttatcactatgcactatttaaatttcaactttgatcgctcagtcttttttacaaaaaatttaagaaacactcaaacaccgtttaaaaagtattaccatatttgtgtcctaaacataagaattaatcttccgtttatcgcaatctaaccatttaaaaattattagcggaagtattgataaacagagggaatataagctgatttaaccctaaaaaatgcgattatatatgtcgtgtctgcttttacccttcccccttttgtttcctctgtatcatatataccaattttatcatgtgactttgaagagaatttctctgctgatcgtgcaaacgctaatcacagttctacaacaacaaaaggaaaaccagttgtgcacaattgtcatcgtaccacaacatttcatgatgtactccatggccaaacgcccaaacggtacatgacagtataggagtactgaacatgttggtttcactataatacctgaggagatgttgacctcgatcttctagaggcgagaaaacgactcttttgactcttgaggtgagtgttagctcctccaagcctacaattaaacaacgggggaccctagactctgaaaattcatgtccttctagatactgatgcgggtgaagtgtgaactgagtgataagaaataattaagactcggcacatggtcagttggggcagctggttatgtgcaaactcttgtcattttcttccccatttcagtaacgctaggtcatttttcagttttcacgaagcttttcttctgaagaacttggtctttctttctttctttctttttttattctgaacgtatgttttcacaaagcatggtgattctcgcacttatgtcgatactccctccgtcccacaatataagggattttttgagtttttgattgcaacttttgatcactcgtcttattcaaattttttttgtaaatataaaaaacgaaaagttgtgcttaaagtactgtagataataaagtaagtcacaaataaaataaataataatttcaaataaatttgaataagacgagtggtcaaacgttgcaagtaaaaattcaaaatccattatattatgggacggagggagtatttttctataggaaaggtccaacttatacgaccttacacacttgtggttgtaggaaaatcaatgctaaactacataactgaatattttacagccttagacccataaaattctactttaaagactttactttgggggttgctatgtcaactggaaaattgtgatgttgccaatgccaaaaatttaagagtaaaaagtgaacaacaataagaaagggaccaggcacttttatgaaaactagtaatatatccgtactttgtaacggattagaccaatataattagggaattgcctggctgggtggattgagaataaattattggatcagtggttatgtacatgcgaaggagcggacctcttacgataaaagggacatggaaaaaagatgactgcacttttaaagtaatagaaaaaaaaagagaataataggcaaatacatttctgggtttgtctatagagcatttggcttggtagtattgctcaaggttctgaccgattgaaccacggttataaaccttagaaaaataatttaaaaaacccttagaaagatgaaagaagtttggagaagtggagaactaacgcaaagaaaacgtgcgctatagtatccggctcgttttctttgctgcgttccctagttgctcgtgcctgctcgcgccagaggtagcgaggcaaagtttcttgctacctcatcctcttcttgccgttcagaaggagcctcccatgcgacgagcacgtacatcttcagccagacatacaaataagggccccgtttagttcgtgaaaagaaaatttttaggtgtcacatcggatgtttgaccggatgtcggaagggttttttggacacgaatgaaaaaaataatttcataatttgcatggaaaccgcgagacgaatcttttgagcctaattaatccatcattagtacatgtggttactatagcacttatggctaatcatggactaattaggctcaaaagattcgtctcgtgattttctctctaactgtgcaattagttttttcatttatctatatttaatgtttcatgcatgtgttaaagattcaatataatgtttttgagaaaaaaatttgaggaagtaaacggggcctaagtcgacccacgaacccacttatacacacctaccttcacggcttcgcatgagccccttccgttgtttcgtgggctatagctccacctgtttctcttttgggcttggctctagcgccctctgctcttcctcctccaccacgcaactacgaccaccacctagtaaggcctgccagcgacgctgcgccctggtgtgagtggcgccacctagatccacctcctattctccaatgcaagggccactcgagcccactggaattgatcttacatttcttctctcactgattttgaaaactttaagttgaaattttttaaatcttgatttgaaaacttttaaatcttaacttaaaaactttcaaatttggacttgaaagttttcaaatctcgagttgaaagtttttaaatttcgagttgaaagttttcaattttttccttgcaaattgaaatttcaagttgaaaatttttaaagtttgaattgaaagtttttaaaatttgacttcaaaatttaaatcttaagtcaaaagtttttaaatctaacttaaaaattttcattttgttagtaaaaaaaatctcaggaaaaaaatatttcctaattactctcattatcgttaacaaacagagttagttacgtgtaacaaccctccctccagaaccgtgtagccagcccatccgacgagcggacccacttacactttcgtcatcgcttcatgtaaaagggttaacccgagagcagtgttgtggaaaacggtgttaacggccgttaatacgtccgataatacggatacggagatcagtccgtcacgtcacgccgatgcggtcatcattagtcggtaacgaacgcataaatccgatcattaccgattaaatcgtccgtctccgtctaatcagccgtataatcggcgtgatgacaaaggtcgattccacaatccagctcattagctgtgccctttactactattgactagaagtttgctcttccgaaattctcacaaggcagcaagatgtaaaatgacaaggaactgacttcctctaaagtttgaacatgagttccttgattttgacgatgatcaggttattggagtttgtatttgatgcagccgatacatatgctatttgggaccttgattacggtcatttatgctatgtactacattctcttgataattcatttcatgcattatgaacaaaacccatcactacgtcagaattgagatatacagtaacagctatccattatgaacttatttaaatatcatatatggttattctatttaaggatatatagaaggaatatattaagttatatgcatttgtttatcaaaaagggaaaactattatcaactatgtacatatattttcaaaatgttatatttccgccaaattccgattaatcgtccgcattccgattaatcgtttagcggtaccctctccgtccgatatccgtataccgtcttccacaacactgcccgagagtgctatgtttaaagggacaagatcttataagttggtttcacccttgctaaactagcagggtgatactaaacatgcgcatacagcttacatgagccacacatgccttatccaaattgtaccaggatatcacataccatatccacaaccgcccccgctctagcggctacaccaaatgttgtgccgcccatcgccatttcaattaggagtgggcatttagtctaaccgaaaatttcggtctcggtcttcggtcttttcggtctttgaaaagtgaagaccgaatttcagcgaaaaaagttaggaccgacaaattcggtctcggtcccggtcctgaccgaaattcaacaacattttcatatatacaaagaaataatagaaattttcaacacaaaaatcacaaaaaaaattcgtaaacacttatgagtaaagactcttattaggttgcatgcctagaaaaagtagggatgtgaaaattagagtttaatcctattaaacatagtagattgtaggttgtatttagacattttttgaaatttggtcttttcggtatattcggttacccgaggagactaaccgaattgaccgaataaaattcggtctttcactacctaggaccgaattgatgaccaaatttctcagtcttggtcttttcggttcggttttttttctgcccacccctagtttcaatgcatatgcgacctttctctaatctttatgaccagtgaacttttttcttcctccattttactttcctcacctaccctgaaactattgtcctcaaccaatcctaccaatctagcacctgaggtcctgggttcgactccccgtgggagcgaatttttcaggatttaacggcgttgtgctttcagtggtagtcgacgtacccgtcgacagcgaggcgcctgtggtgacttcgttaatctctccaggatttgccgggccagtctttgaagatgctcataggggtagggtttacatgcgtgtgttcataggggtgagtgcgcgtgtgttgtgagtgtctgcgttgtactgtgtaattctcaaaaaaaaaatctagctatctcgttggaggcgcttttgcagccgctcgctctttagagattgattgccaactcataatggaaaaactcatttatctttttattagcttatttaccagattattgaaacgagttatttgttccacttttttaaaaaaactttcttctattgcacttcttagataacttattttgagctatttattaattttttttgaaatatttaatttaccattataattaacttaaaaaatccgtgacaataattcgcttgataatataaatcattttgagttcaactggtagtagggatggcaatttctctcacttcatgtggggccagggccgaggctgcaacggggccccgaaatattgagcaagagcaacctgcttgctatcaaaagccatgtagcccacttaaattcgtaacaaatgcagcccaagtacttgccattagaagcccatcaagcaagaagcttatgcaggaagttttggtgcagatatagggctggttcactttgataccattttcaaccttatcaagttttgacattgctaaattttgataagattgccaaaattttgataaggttgtcaaaattttaacaaggttgccaaattttagcaagatttcatatgtacttagggctggtttggtttgtgacctaaattagccttaccaatttttgtcaatgctaaattttagcaagttttagcatgactaattttaggaagacaaaattgtgtttggattgaagccaaaatagcctaagctaactattgaaatgaactattttcttaggcatgccaaaatttggcttcaaaccaaatagacactaaacactattgaaattaccaaatattgataaaccgaatttaggcctcaaaccaaaccagcccttattaaaatttggcaacaaactaaacgtagccaaaatttttgtaactttgcttaaaaaaataatatggttaaaaatgatatctaagtgaacagccccataaacacaccagcaaaccctggcccatcaccacagtgcatcgacgccggcggcgaacaatcatgtgagctgaaaatagtcccttgctcgccgccacacgccgcaacgcgcgattcgctccctttccgcccgctcgccgccctgtgcttaaagtgctttggttggtttccgcccgcccgccactagcgccatcgagctttccctccatcccgatgaagcgatccatactgggccgccagcccacctacgccgttgaaacccaaaacctctttcttctccggggaatttaactatttgccacttttacgtttgccaattgttcaaatatcccttttaggtttgcagttaactatatgccattggagagagaagtttttctaattttttgccacttttcgcactgtacaccgccacatgggcttgctagcgtggaatgggcacctgaaatgactagtatacccctgcatctgaaaccctaaatcaggggatcctctctctcccgattccgttcgaccgccagccaccatcgacgggcgacgccgtgccgtcgacccctgcccgccccgcgtcggccccgcgccgtcgacgccggcccggcgcgcgacatcgacgcccgtcccgcgccatcggcccctgctcgcccagcgtcggccccgggccgtcgacgcgccgcccggcccgccggctcaccgccccacgccggtcctgacgttctccacccgcagtccgccgtcgacgcatttgtcagatccgcagctccggcatcatcccggcatttgttcttccccaacagcacatcgtgacctggtagggcatcgtcgccatcgtcctccggcggcgatgaagccctcagtttgtccttcttggtaagttcattttctcccttgccctccctgcttgtattgtgttgcatgcatggagttagatgtgttctaactccattttttttatgaatctgtttatgtcaggattgatcctggcaatgcgcttagatttcttgttagggttgctaagtatgttgcgaatctagagtatggaatgctaccaatgtcagagcaagactatgattggtgggttgatattagcagtgggtataatttggataaatttcatgatgaaatggctagcaagataatctgggggccaagccaagaaattagagtttggggtttggacactgaaattggcactgaatgtaagttgacaaccaatgaagaatttggccagtggatgaattctatgttggatgataagctggtagagtttggtgttgaagttatttataaaaagggatatgaacctattgaaggcattgcaaatccagttgattcagctattcaaggtgtctctggtgtggtaactgcagatccaattgatcagtcaagtgctcaagttctctctgctatgattagtgctgaagtttcttctcctggtcatgaagaagggacgggtgatacctctagccatccacaaaatgcagaagaggctaatgctgttgtagattggagtaagttggctatacttgttgaacctgagcaagattgtgatgttaatttattgttggatgaggatcaagtttttgaggccatgggcttcaaagcagcagatcagagagcagcagctgctgcagcagctatggaagaaactgcaattcctattattccaaccgagattcagcaagacatgttagatgcagccattgtagtggacgatgaagtacccattgatgtgttggattgggacagggatgacccagatatgtcagtggggacattttacccttctatggatgagttcagaatggcaatgaagcaatatgccattgttcatgagtttgaactagagactgaaaattctgacaaagaaaggtttagagggaaatgccatgcaattggttgcccatggataattagagcaaagacccaacctaataagagtgtcagggtattatactaaccatttaaattacctttgcaatttgacaccttgcttgctgaattcagattggagtaacttttgcatagttgctaatattgtttgcttttgcaggtccaaataaacaaatatgatcacaagtgtgcttcaagaagcagagttcgtggaaggatggcatctcaagcttgggttgctgagagggcaattccatttctcaacaagaagaatgggatgggtccaaaggaacttcagaaggagctgcaggacacctacaagataaccataccttatcatacagtttatcatggtaggaagagggcaacagacaaattatttggtaagtggtctgattcatttgattggttgtataggttcaaggcagaggtggaaatgaggtccccaggtagtgtagttgagatagacacagttaaaattggagataaggttcacttcaatagattcttttgtgcatttaaagcatcaattgatggtttcttaggggggctgtagaccctacattagcatagattctactgcccttaatggatattggaatggacacatgcctgcagccaatgcattagatggacacaattggatgtttcctttggcatttggtttttttgattcagagaccaaagagaactgggtttggtttatggagcagctagccaatgcaattggtccagttccaaaattagctatccacactgatgcatgtaaagggttggaaactgcagttcacaaggtatttccatgggcagaacagagggagtgtatgaggcatttgatggagaacatgaagaaattatttcatgggtctatctatgcgaggaagatgtggcctgcagctaagacttacatgcttgagaagcatgacaagtggatggatgaagtgacaacagctagtccagaggtgaaacaatggcttaaagaatatcacaacctactgtgggccagaagcaagtttgattgtgctataaagtgtgactacatcaacaataacctggcagagtcatggaacagttggatcaaagacttgaaggatttgcctgttgatgctcttgcagatgccattagggagaaaactttgatcttgtttgagaagaggaggaggatctctacagctctcaatggagtgattcttcctgttgtcatccatcagttgaatgaagcctcaaaaggtttaggccatctgaaggttactaaaggaaatcctgaccaagcagaagttacagagacatacaaggatgaggaagtgactaggcatgtggtgtaccttgataagtggacatgtacatgcagggaatggcaggtcactgggaagccctgcccacatgcattggcactgatcacaacaattaggcagccaaatatggagaaatatgttgacacagcttactctgtgcacagatttcaggtagcatatgcaagtgttatccctaacatcacagacaagaagcagtggccaaaagttgataaaggtttcaagctcctgccacccgttcccaagaagagaggagtgggtaggcagagaaagaataggatcccatctgctcttgaaaagggcaaaggaaaggccacaaggcaagttcaatgtccagactaccaacggtttggacataggaagggtagtataagatgtgaactgactggaactaggaagaggttagttcagctatgatttactttcttttagttattgtacaatgtattgcttaagctaaccaatgttttgcaggaagaaaaacaacaagacaaaaacaaatgtgggaaggaagaaagcaaagggtgccattgatgcccaagctgctgcagttgatgttcaagcgaatacgccaagaacaagagctgctgcagttgatgttcaagcgaatacaccaagaacaagagcagctgtagcaaaagaagcagctgcagaatcacaagtgcatgcaacacaaacaagcagtcctggaccaatcactaggaggtaaggcataattgtgttgtttttcatttcatttcacttaactttggttcatgtcttgcttacacccatcaaaaacaacaggaggctggcattagaggttggtcaaagctccgttgaagtagcacttgtacccgtgcaggtgcaagcggcagtacagccaaccaagaaattcacaccaaggaaaaaactagctagcaagccaaaaaggcatcaccaccaaagcttctgaaataaaatgtgtcaatctgctatcaatctgcaagtattttgctatgtatggctgaaatgcgtcaatctgcaagtattttgctatttatgtctgaaatcgtcaatctcgaagtaatatgaacttctaatgtgcatggcctgatgatgtatttttgcttttgtaatgatgtatgccatgatgaacctgttatatggcaccctaaacctgttatatatagaccattgtatggtctgatggccctgatggacctgttatatgtatagaccaatgtatggtctgatggacctgttatgcatggcctgcttttgtaatgatgtgtggcctacaatgaacctatgaattgtatggttgatgaattaagatatttggatgggacgtgatgaattaaggcacttctgctattgtgtgcatgttcagtttgttgagatatatgtctggatatgtatgctgacaaatattaatccttgtacatatatgtgttgtcatgaagttgtatattatgttatatattgccaaaaaaaatgctattgttcttgcaatcctatatatatgtatggtttcagtcaaatgaactatacatttagctagtagtaataagttgtatcattttacctaaatattgtttcagattcggctctatattgcagccaatggctattaagggtatactagtcatttcaggtgtccattccacgctggcaagcccatgtggcggtgtacagtgcgaaaagtggcaaaaaattagaaaaacttctctctccaatggcatatagttaactgcaaacctaaaaggggtatttgaacaattgccaaacgtaaaagtggcaaatagttaaattccccttcttctccccaatccacgatccccctcccctctctcccgaggcgactgtcgaggcagctcgagctgcttctggaatcttctcgaaccctccgcttcttccgcgatcctcctcctcctcctcgtcctcccactctctcgcgctcgggacctctgcccctcgcgcttcttccacgaggctccacgggccacgggcaagaccagccgcccgttcgccgcgtgcgccgccgccgccgtggatgggacggctggggtggctccggctcgcgtcgaggtctctcgcgctacgctccggcgaggtgaggcgatttcgtctcgtgcgatgcttgtttccatttccccgatttggtattggggggctttgggaaggtttagctgttcattttgattggagtttgtgcctgcaggtggctgcgcaggggagcaaatggattcggcattccacgcgtaatttccttcgtcctgataagctttgttctatctcgcgttggtttggttttgcggaatgatttatcggttcgttcctccgccaccgcgggcgagctacagctaacagctagatccaaatgttcttttctttctctgttttttcctttcctcttatgtgatttggggatttttgactgaaagagacaaattaatgttcagattgtatgtattcttcaattgaacgctaatcaacaatgcataaaaattgtcggtgtgtttcctcttgaacagaaattgggtggcaacaatgtgcatcttttcattaagaaaggcaatgctacaataatctgtagaagaattgaaattcaataatgttacaatttttttctcagatgggtcatgctacattctattggcatgcatctcttttgcctaggagaatttatttgtcaacaaagtggtgaaaaaaattctgaataggggcattctagtctttatacacttagttcagataatgagcctatcaacaatcaggacataaattggcaaattattcaaccaacagattctttagatagttccataatctataagttgattataatctataatctgtataatcataagctgtcccaaaaggggccataaactgattttctgctgtcgatgtgtctgtttgggatttagcacataattctttaatctctacttgcaaatgttgttcgaggttgaatcttatggatccgtaagatggtgacaaaggcacatgattttaaggttgttgtttgcattattcaggttctatttagactatatgtgacttctttcttcttaacttgtggtgaacagtgaacttgactacatggctgcagaataatagcttccgtatcgtacaatacattttaggaaaatgtgttggtgatattgattactattgggatgttaatgtagtatgggattagagaataatttgatatgctatgaggactatctcatgagtcgttctccagaaagagaattaagattttttgtctctgcaggggtacgatgctgatttaaatcaaacatatcgtctattggctaaattgaggccatgggaattgaactgtttcaaatagtgtggtttatgtaatcaagttgatgttgtttgtaaacataatcctgtaaaattcatgtgttccaaatgggccccgtcttttttttcctcctgtcattctctgctcgttaacacttcccacttttttttgtttcatctggcgatgcagcttgcagctccagtggcatctatattggtgataaatgctatggacggttcatgttgacatcatttacattgagcaggtcttttcatgctacaggttgctgtcctggtgttacatgaatctcggtaatcatattatcttgttatttcaaacacaaaggccaatcaagcattttctgtcgcatctgccaggtcaacacagttcaccagagaaggactattacaagattcttggtgttcctaaagatgcttcgcaggaagaaatcaagagggcttttcattcagtgagtgtcacattatagttctctttaagtccacaaggcttgctcagtttttttttttggcatgggcatgagcatgccataaagttaatataatttctcaggtggtaatattttccatttctagcattcttgtgtgttgcagtttactttggaggaaaaaacacattgccgtgttattttcgtctgtctctgtgaagaatcaaagtattgtcttgagttgtttctgatgtatatcttgttgatcataccaacaatcagtccaacagcttaaaaccatttcttttattatacagaaaatgccgccatacctccataggtagatgttttaagaagtggtttcagactaggattaagataagataaactagatgcactggtagttgacttgcgttagattttgatgatgttctacttgaattaattacagattactacttgtatgtagcttgcaaaaaggtaccatccagacacaaacagggggaatactgctgcaaaaaggacatttcaggaaataagagatgcatacgaggcaagtaagttaccacatctattttgctttgtaatgttttaatctttgtgccaaattaacagtatcataagtttgataatgctggactctagacattgcgcgacccttcgaagagagagcagtatgatatggtaataaatccctacctgctgtacgctatttctttatcatcttccccttttttagggaatgtggtatctttggaaatacatcatttgataaacatctcaagttaatagtttatggaccattgttttgcaagatctttaaatagcatgttaatatttgaggtctggtagtatgtccgtgaagttcatggtctgttgtaatactgcagctattttatagagggtctgagacaaattcctcaaagagtgggatggattttgatggggcctatcaagatccattttcaggattccacaagcagggtcataatccctttgcagaattctacagacaagggggatc

SEQ ID NO: 64684 - DNA, 3706 bp, Oryza sativa
gactggtagtgtccatgtatctcatctatctagatagtttgtctgagcattcagtcctgtggaaaaggcactagtttaagcggtaccattagttagattagctgttttctgtagcttaagcaaatgagaaatcctattccattagattttccttcagttatcatgccacatgatatcacaaatatggtaccatcaatgatgctcatgtaatttctccctccaactactgccaagcatgttctggggtgtcagttgtatctgagttaataattattgggtatgactggtagtataggatatgtcagcattttatatgatcgcttatgaaactactaccatgtacttttgcaaaatttaattaaagcttttctaaaaatcaataactgaatctagatcatgtcctagtgtcgtaaataaggtgagcagacaataccttttttttaatatatatatatatatatatatatatatatataactttaaatgcttgatttttttagagtatgcaggagaatatatgcttgttttttatgatgacttgctgaataaatacactacacaaagctttaaggttgattgccctgatctagcatatactgccatatgtacggtcgtccactagttctcatttggcatgcattgccctttctttttgacccgatctagcatatactgtaatatatacagtagtccactagttctcatttgccatgcattgtcctttctttttgagtaaagctctcatggtattgtttgatgtcagatgggagagggtacttggccaatgcaaagatgtatgtttgcccttcatgtagaggtgcaggaagagtaagtatttgcttttatattcaattttccctttctaacatgaatgctggatatgctttctaaacatatccactggtggtttgtgcaggtttccattaacccattcacatccatttgtacttcttgcagaggcttgggaaagtaattaaggtaagggttctgtgagtaacatgtcagatttttctttttttaccctatctcatttgtgactattttcacaggattactgcctgacatgcaaaggttcaggggtggtagatggcatgaaatatgtaaatgtgaccattccagcaggtgctgtgcagctaaccttaaattatcgttgttagccagctcctttccctgaaacggctacaattgtcaaaatgatttacattttttctattccacttaaaaaaacttcaaataaatttcacaaaaccccaggtttgcgggtatgcataacacgacttttaccagtcattgtagctatattacagacacacgtcaggctaacacatgccaaaacctagctctattactgcgccttatccacatatattgcacatgcattctcgtgaaaaatgtaaaatctaagttagcttgcatatatattgctccatctctttgcgttgacaggttcattcaaggaacatctggcatctgggctgctatgttgtcattctagtttctagttttttcttttctcaattgtaaaaaggatgttgcttcctagtttgctaaggttgttttgaaactctttataggtatgacatgttgcttacaattaaacttaagttgagactgtgaattgtgttttcatgttaattactccttgtttcactcaacataggggttgattctggcgatacaattcatgtaccagaggctggacatagtggtggacgtggaaccctacctggaagtttgtacattaagcttcaagtgagaaaacacctacatgaatgcttgacctttttttttatgaacttacaagttctgtgaatatattggtgcacatagttatttattattgctgacataagccttatttgacttgtcaatgttaaaagtttgttgcttagtactgaggtgctaatgaggataaggaagataggaaaacatgaggattacaatatttcgatttgtcttggcgtatttgaagtttagaatgaaaataatatattaatcagtttaaacaattgtgcttgtagattttactcattccatttttgttcggtactatgttgaaggaaaagaacaatattttctataaatattgtagcaaagtcatgaaatcatgcattagctgagatgattcataggtatagagagtcttgcatttctatgtaagcaccttaagtccttaacagggttttcatgatttttgctgcaaattacggggtcctggctctcactatgtagcttgttatggattagtttgcatgtatatgtattaggacagactagtttccatcctttggttcatccaaatatgtgcgttaaagaatctatgactctgaccaaaatataatggccacttgttgcactataggattcctcatctttatgcaagtttgacaccatgggacttcataagtctctctatgttgtttcattgtctttcagtcatggtcatgttctctgttattccggatgaccctccaagtagtttgttttgccgtttatcctggttagttagatctatgtagtataaatacatgcaatgtactggcttgtgccatgtgtgagcagtacgctattagcctcagcttatctcaattctcaagcaacccagctgctgattcttccatcaactatgtatatcataggtagcaagtgatccagtgtttgttcgtgatggtgctgatatccatgtagacaaaaagattagcttcacacaggtagtaacaaatattccttctgttattaatatttaatatagagtaagcatttgtaagaaatacactacttttcaggaatattttcctactgctaacatatgtacttcgtagcttgcttccctcctaatatagactgcaagttatgcgaatcatcattctaattacaattcaagaaaaatctagtccattcaggcaataaaaactctccatttttcactataaatactatcttgagagatgtagaagccttcagaggttgacgatgctgtcttggtgaacctatagaggtggtgaaatcagatgtgatagtttgttagatttggggaacactattattgtgattattctctgttgaaaactcttgtatcaaactgcacttgatgaatatctgtgcctctgtggaggcccttcgaatttgtgctattaattaatggtgattgtgaattgtgatgatattgttgcttattgttttcttccttgaaaaaaatgacaggcaatgcttggtggaaaagttgaagtgccgactttagatggcacagcagaagttaaggtaacaaattagcaatcctcatatactactactaaagattaggcacttctgtcatagtaacattttatataattttgactatttgctaatcttgtctatatacatgtacacacgtataaagaactagtaggataaaaaacaccatccttcaatttaagggctcgaagttccaactgtaaatcctaaaatggaacatagatgttacaatctctccttattgagatataaatatataaagagagagatgatgagagagaaggatataaacggcttatttttggttgggggctggttataccggttgacataattgatggattagatactagaactttacagttgtataacaaatacaactattgtagttttccataaagaccttgatattgtataacaaatacgacaggaaaaggtccatcttttgtcccttaactctcatcagagt

SEQ ID NO: 64685 - DNA, 18631 bp, Oryza sativa
tgttgttgataatcccaaacatgggggcaactagtcagtgcatgaaattttacagataacagcgtcagcatctcatacttcattttgatttacgctgagctgacgtttaatattctatgaccttttgaccttacttttgctccattgtggataaatctcaagtcatcaatacctttctattcaatttggttcatctaaagggatttacactggtctttcgcaatttcatctaaagagatttacacagtgcatcacacttcaatttgatttctgatcaacacaatttaatctgcagaatggttaatgaacgtcaacgtgccctgttagaagaatttgcagtagaggaagccacgaaggaacagagttccttttcagctggaaactggtaagcaaccctcacatcattatgtgaacctatattggaatagaatggtaatcgcaggatcaatcattgaaagatgcatgatttattaatgtccatctattgatcaatttattcacttgaagaaaatgtaacgatcaatgtgtttgctttattctggtctttttagtttgttggacctggcaagcaagcgattcacctgacctaccgaactttcattgctaatatttgttgtttttatttactgcttgcatcgtctggtagtaataaagatgaaatttcaaacaggctttaccagcagctgtctactggttgatacttacaggtgggagctagttgaaaatatgaaggggcaaactttcttgcttgggcttggcttcctcgtactggttcacctgctactgaccaagactgtgaactaggcttcacaaggaacatctggcgacatcacatcgtataaattctctggagatttaaaacctggacatcggtcatcatgattattcagctgcagggatccgtgattttggaggcgcagggcagaagattgctcgttccattggaagagatactcatactagtttgaattttgattcccattacagtcgaatcacaagctgtacggagttttattttgtaatgctccaataatgggagaacaatggggatgctaggtttcaattcctagtttttgctgtgttttttgtttttaccagcatataatttgggtgcttaatagggaggatagctacaaccagcagaaagtgactttttcctacgcccgtgctgcgtggagtgttgtcttgtaaattcatgctgtcatgtaggagtaggtcttcatggaggcctaaaaactcagccaaaaatggcccacatattgaatgttacgttgtacaagtttgatcttgaattttgcatggcagatgagaagagcatgctcttattcaaattccttagtatcaacaaatttcaaattcgagtttctgttgtgtcatcctttcaaaaaaaaattctaagtttgactagtggatttggcaactactccatttctctgttttaaaataaatcaatctagcatatgaagggatatattacttgatggtacaacaaaaaatttgaactaagtaccatgagaatctagacagcaaatttgaacattagtacaatgagaatctagacagatactttatccgtcctaaaaaaacttaacttctagagtatgaattttatctaaaaaatcaacttctatcattctatcttacttttttttaatgattatggacatttcagtcattcttcatctctatttttttaatgattatggacatttcagtcatttttcatctctatttttttgtcttgagatactaggattggctttttttataggacagagggagtatgtctcatttaatattagtttattttgtataaagagagaattcccttcatcccataaaaaaccaacctagtattaagtgtggcatattctagtactaaaaatttagacatatctctgttagattcgttgtattagaatatgtcatatttttagattcgttttttgttttttttgagacggatggtgtattgttttgcagcacgggtaagaagacgttgaccaccgtacgccatggccccgccgcatgacatctgtgccactcgtcgtctgtccaggcgctgcgcctctccagacatcggtgcatcgcaggaccgagggctcctgcctcctggactttttgagagggaaccacccaattgtatagtggggacgaaaacttttttttttaggggaaatcaggatttccattactatgacactgctaaatcatcagcaaccaggtacatgatttgtgccggagtaggagccaaaacaggggcctccgccggatcgcagacactacccatagctgccagttcatgagctactctgttatatagccgaggtacatgactaacactccaggaaatgaaattcaggcgcagtaaggattgaagctctgccaccaggaacgacacgtcgctcagctcgaaatcgtttgtgtagaccgcttggatcacagccgtcgcgtctgtctcaatcatcccccgccctattcccatctccactgctgcctggactccctgtaagcatgcaataagctcaccatggagaggatgcatcagattattcactctcccccggtaagcagccaccacatcaccatccgtatcacggataactttggctgtatatacatgtatagttctttttttttttggagagattcgttcccataaacatccatccgatactgccacattttcaagtgttgataataaaagcattcaaaatggacagctccagtgttttcccatacatcccatcattacaacacgcggaaggccacaacaaaaagaacacatttcgaacacgtatagaagctagtgagtgtatcgtctcaaatggctccgaagcacacagccgcgaaggatctgaaacaggagacactcagaagcgaaggaatcgatcgcggaaatagagatgcccccccaggattgctacacaggatcaggatgactctcgactgaaacttctgctttggtatctacggttgcatctcgcgggcactattcatggcttcttggaggctacacacggctttgtcatacatcagaaaacccatgaaccagaactcgtggccttcaactgaaacaacctgaatatacttttcagcagggtttactttgctcactgaaggattagccgctcttagctggtgcagaggaatgaccacctgtttatccaaaaagaacatatgagataaatatggacgatgcccctacgtttagaagtatttaaacatcaaattggatcaagctcgttttgccctttgatccaaaaaaaaaaaaggatcaagctgctactacaaaagttatgaactactaggtattagtatgtagcaaaaagcatcaccaagctacaggaatgactataagcattatgaacatgccagattcaactggtagctatctaggcaaaaattctgttcttcaggagtagaagtgttcataaatgagtcatgcttgaaaagtaatggaactttgattctctaattttgttccatctttccatggtgcaaaattaagagctgataactgttcttatcatgctaactatccaacagtaaactacagttcacggttcacaaaataaaggaataatcaaacacacaatcatgggacttaggcataaactaagcacgtaaaattaaaagaaaaggtgaagcatggaaataagatgaaggtctcataagcactgcatagagtctacaaggaaatgaacaattcttgccttgtagtaactccattcagttttatttccagctttgtaagagagaggattgtcgctgcagaatgcaattttagctgtagaaatgtacatgactcccatgacaggaccagcagatgttgatagatagcatgcataagatattttcagctgctcctcaggaagaacctcaaaagtttgcctgaatattttttcatagccaccttctgctaagactttagttccttgagcaagccgtcccatagcagcttcagtaaaactaggtcctgtcttgactgattaagaggcaaagagtgtagtcagacatctagtagatattctacatctgtgcaaaaatatagttcatgtaatatcctgcatagcaccgggttgaccatgtacaaaataacgtttgggtctctcagccttttgcataagaaaagtgaattattcgcagactgcccatcatttgaccacaataactattctaaagtaattaaagtgtgaaaattgttcatggggcagatgatcattgctttgaaggataattcacccaaatgtgtgacttctttggatgttcatctatatgcacagttgatatttacaaggtttgctagttcaaggacaagttgacataagaatttatacctggctccctaccccactggctcctaggagccagctatttagccctaaccagttatcatcagtattttgcaaaattattatcattcttcctaagaggttcatcgtatattataattgcaagagaacaacagcatagacatgcatttgctggtttgtatagaaaaactggccggtcaagtctctaattattaatgctgtcatgatcattcaatcagttcaaattcacacggaaaacaaacaatggaattaaccaaacagaagggacacaaaacaagtttcttcatcactaactctccaagatcaattcgtcctactacacaattaccagttcctttggatattcaattatttgagaaagatgaagaacgtcgttagcagaacaaagctttctggggaactgagcacagcactgaagctttaaaaacaacttacaaaacatgcccgtaaaatagagggtataaagcatagaaagctacgccaaatgttttcacaagcttcaaaagatgctgatacttccaaaccaatttctataaccatcatctaactgttgaaggaatctaccttaagttttcactttccaactttatctactcccacattccttccttcgatcattacaaagccaaaagagcctagtgcctacgcgacgcaatccgtggacctcaagaaatgaatcttgcaaacaatggaacaaaaaaaagctaggctccggtaaaattgggagagctgaagtgggctcagagatctcacagtgctgccacgtgtcccggctgaggctctcgaccatcttggtcgtctcccccaccgacttcccccacctggacagcgtctccttcatggcctccaccgcgcctgcgggctcacaaagcaccagagcaaagatcagaaccgaaacaatcccccccttcctgagacagcatcagaacgaaccccagcggcggcgttaagcgttacccttggaggacgaggaggcggggccgcgggagacgtactggctggactcggcggcctcggcggtggcggccgccacataggtgggcgactccgacgtcagcttctcgctccacgtgacggtcttctgcccctgcggctgcgcggggggaggcggatcggcggtggcggcggccacggcgacggggggcggcggcggcggaggggaggaggggtcggaggcggcgggggggtcgtcggatctgggcaccgcgggcgcctcggcggcggcggcggcggccggcggaatctcggcgggcgtctgcatctgggccgccgcctcctctccccgactccgcgcgaggaaaccgaggagaaaatgggtcgcgcgtttcgggtcggagcggagtggaggcgtggcgatgggctggagtggtggtggtggtcggggtcaaaccttttgtctttgttggtgggtaaggaggagtagtgcaggagagggagagggcgggtcgcacgcgattccgcaaccgcaacggccaaagtaggggatttcgggtcgtcggcgcaccgcagcttccaatggaaggatgcgtagacgacgtggcacgtggccacgtgggtagcaaaattgggctgcatggaccaaaatcccggtccgtttcttgggagtaaataagtccatattgcctccctaatgtaggtagaatttgaagctatgcttggggagcttcagattataagaatctattggttggtagccagcttctaataatctggagaagttcgatttttcagcttctgggttctagttcattttctagattctacaactacaaattcttagaatctatgtgacaatttgcactgtttagggagctgaagattttgggagaagctgcagcagctagaagctccccaaacaagccctcaattcacccttagccgctatattgccgccttcaattaaaccagtgttttttaaggtatgtaacgtgtaaggctgagtttccaactcacttttcttgtttttcgtgtgcatgattttcaaactactaaacggtgttttttttaaaaaaaactaacttttacaagaaagttgcttaagaaaatcatatttgtaaaatcaaagtgtttgtattcttattctgtgatgaacaattggcatctgcaattattggttttgatatttgaagattattggcgaagtggtttttgagatgattggatttacaggtgttatacagatactgttgtgatttgggtccggtcagatcgggcagtggttgccggtcagaccagtgtgtatcgcgcggtcagatcggcttagcccgagatctgaccggccgactctgtgtcggtttcgggttgtttgttcggatatccatgattatttcgtgtttctggcttctagacggatactatacgtatgtaatactgttgtttgctaacaataagtcaagttggagatagcttggtctcggaatatggtttctttgtttgattcatgtgtaagtaacttgatgcctcgggagagtattgccggtgatggattgggagtcgacttggggataaggcgatgtccgtgacggttagatatcatgcgggatacttaggctagagttcaatgcacgtggttggtgaagatttcatatggcatacgatggaggtattgtgtgcatatgggatgtggagtcgaatttagaaggagtccaaatttggtatgattagagtttgtaaagtttgtttcttgtacgggaaggtttcctacgtggattaggacttcttgtataagttcggttcgtggctttaggctgcctacctcatgtataaataaagatggagcgtgaggcttcccggtatcgcttttgagagcattgtgttgagagttgagttagggtttcgagtttagtcgagattttcgtgaggagtgctgttgttgcactctgtaaacacagagataagtaataaagttgtcatcaactttgagagttctttaatttgtgtttgttcgggttcgacggtctaaccggtgagatactggcggtcagaccggcgatatcgcggcggtcagaccggcggcatacctacggtcagaccggcggcgactacagcagcatctgctgatcttgacggtccaaccggacgatctactccggtaagaccgacggcttccagacggtcagaccggcaggactacttcggtcagaccacgatccatcgaatttgagggtaacttttatttccgctaaaagttttagtttttaggtacaccaactattcacccccctctagttggcttagttcttgtgtttcgatcctacaatattaattcattttaaaaaacagatacttcctccgttttatattataagactttctagcattgctcatattcatataaatattaatgaatctagacatatatgtgtgcctagattcattaacatctatatgaatgtgggaaatactagaaagtcttataacataaaacggaggtagtacttgattaatcatgagctaataggtcactccactttacgtgtgggagtaattagggtgtgttttgttgctcgaatgccaggagtaattagagtgtgttttgttgctcgaatgccctcagcctggctcgtatgcctcatccaggctgggtttagcctggttagaatgatgcaatgggagttgtttggttgtatacattagatgagcccggctcctaacaccaggcaaagaacaccgcctaaggctgtgtttagttccacgtcaaaattgaaagtttaaagaaattgaaacgatgtgacggaaatattgaatgtttaaagaaaaacgttggaatctaaacaggccttaagtggcattatagtccacgctggtttggtccacctacactgcattctgcaacgcctagttggcctgcatcaaccagcaggaaggaaagcccgactgacttgaggtggtccgcatcctcgtttctcaggttctgaagacccttgatgcagatagagattatatacaactaaaattaaccttgaacgtatctgactgtaatggtgataattcattccacgagtattgagagttcatgtattgcattatttgtgctgctttctagttatatctaacgtacgtcttagtgtttattaaccgccattgagaattgagatatgtagagaacccaaacgagaaaatctgaaggcaatttattaactgataattcacccttggccatatgagaaaattcacaaacaaaacgaaatacaaagaagatgagatcaaagttcttgcttacaaggacagtataccatcttgttggtcactgatgcttccccttcttcatctgagtcaagaactgatcaaggtggaacggatcctcctccatctccggcccgtcaaactcgacgggcctctccctcttgccggcggccacgctcgccggagctccggtgaacgccttgtcgggcacgaacctgcgtgtcttggcaatcttcccgaggtgctcgtcggcgtcgccgtaggcgtcagggtcctcctcgccgtgcttgctcggcttgtagagcgtcgacagcgccggctgcgccgcgaagagcctcccggagtagacgttgtactggtcgtcgccggcgaacccggagcccattcccttctcctggttgaacagccgctggtcgtaggtgacctcgccgccgccgccgccggtgttcgccatgcccagggcgatcctctcgctgacgtcgcggtccctgtcccgggtggccgcgctcttcttgctcgccgcggcggcggcggccctcgcctcgagccgcctctcgcgcctccgctcctcgcgtatcgcgtcgcgctctgctgccgccttcgaccgctcgctcggcgccggaggagcggcgccgagcatctccgcgcgcgccttcgtggcgagctggaggagatgctgctcggccttctccttctccctcatcttcatctcggtgtgtaccttggcgcgcgtctcgacggcctcccgggccttctgctcggcggcgtacagcgcctcggcgagcgcggcgaaggcgtcgctcacctggacgtcgtgcaggccgcggccgtccaacgccgcacgcttgtcgagcgggatggagtagcccttggggttcttccagctcgagatgctgggcggcaccttccagtcgtcgtggtccttctgcgacggtggccgcggcggcgagcgcagcactggcaccggcggcgacccggcgggggcgggcactcgcttgtgcttgaacttgggcggctcgagcgggtcctgctgggtctcccccatccggatgatcctctccgccgcgccggagttgaacgccgatgtctgccgcgcaggcgtgtacttgatgaattccgggtcgtggttgctggccagggtgttcgacggctgcacggcggagaggcgtttctcgacgatcgcacgcagcgcggcgctcgtccgcgccgtggtctcctccacggccgcctgctcgtcatcgtcggcgtcggcggcggcggcgttgatcttgggcaagacgtcgccggggctggagtacacggtcttcccggcgttctccccctgtctcacgacggcgtcgaactcgacgcggccgccgctcccatcgacggtgaggctgagcacgccgccggaagacccccgctgctccccgtcgccgtcgccgccgcggcggcccatgtcgagcgggtactgcgcgacgtggacctcggggaaggcgccgccgtcgccgaagtcctccttcctccgaggcgcgagcgccgatcgcctcccgtagggcggcacgggattcaccgccctcgacgacctcggcgcgtcccctccgccgccgccgccgccgtaccgctccttgaaccactcgtcctcggtgtggtcgtgcggcggcgcgccgccgccgtgcgaggggtcaggcagccggagaaccatcacgaatcacgaggcaaatcaatccactacgaccggagatgcgcgtgtgggtgatggacgtccggggcccgcctcggcctcgacgtcttgtaggcgatcgagacgccgactccgtcaccgactcgagctccgaattcttcgtggcgttggacccgctcgcgcctgtgtcagcggcccatgcaggcccaatcatatgggctgcacgtaagtagtaatctggcctactctaatccgttccggcccaacagcatgggccgcacataagttgcagtctattctggcctagaatattttaagtccctcaataaaatggaaacaattttgatccatcgagggaatgttctcatattttttttttcatgtccctcaaatggtcatgaaaaaatttaaaaacattaaagaagatgtattaacatgtgatatattactccacaaacatgcaagttcaaattcaatctctacatctcacaacgaaaaaaacaaattaaacaaattaaactatagctagttaacgcatattcacagtaattttttttcgttgtgaaatatagaagttgaatttgaacttgcatgtttgtggagtgatatattacatgttaatatatcttcttaattttttttcataactatttaagtgacatgcaaacaacgagggaacatcccctcgagagatcataatccactctccttaatataggtccaatttcctatagttaggtctagagtatgcatactactccctctgtcccaaaatataataacctagtatcggatgagacatgactattataaatctgaatatgaatatgtccagattcgtattctaagatatatcacatccagtattaaattactaatatgtataatgagtagagatcaatttgatttggaagaatgcatgcagcgttagtgcgttaccgacctactggaaacaggataggtcttttgagctgtaatagaacttttgagatgtaatcttgtaactagaaaccactttacagggtgaattggtatccctcgacgtagtctgtatctgccatcgccctggcgcaattggcctggcagctggccagctgccggttgaggaggaaggatagagggaatgacaaggagagacaggatgatatgtgagtaccacgtaatgattctgtcaagtggattaggtcaataaataacatcagcaaatacgtctctaaaattaaattgcaccgattaatacgtctcgaaaattaaattgtaccgattttagtaattagatgtttagatattcgatattgcgatcaaatgatacgcatcagattgtatagtaattaaagtggactttattccttctagcctatccatgatggaccgcgagcgtacgtgtactagatcgctcgattttcccttctttcttcttgcgaataaaatttaaacaccggatgctgtcatgctcgcttccttcttcccgccacagaaacattgggagaaaattccaattcccatggtccctgaacccccaaaacaaaacagatcgtaaactcacatgcaaatctcgccgccgcggcgtcgccgaccggaggagctttgtcgtctgtatcttctccggtggttatgactcatgcgtgcgtacgcacgctacgacggtggggggccctgggccgcggctacgccatggtcgcggcgagctggagatggagaattttttttttttttgcctcccggcctccgaacagcttcagatctgttcttttgctatcattgttcttcgctcgtccggatgcccgacgcttccgaccgaggaatcctcggctccttgcagcggtccacggaaactggtgatgatagacggtaattaattcagcctccagtgtacgagggccagggccaccggtagatcgatcgcaacacgcatcgacacaggtatttctcgtgattttagtacaactaatgactgttttttcaccggtttttcacgtactctgctttcgttgccgcagattgagagaaatgattctacatggttctacatcgattttcagcataatgtttttcacgcacacatttttcgaactactgcaccatactccctccgtcaaaaaataaacaaacttctagatttaaaatttgtcaaaaaaaaaatctaacttctaccttctcatctacaatcggtttgaaaatcgataagttttatctattcaatacccctcatctaccaacccatcgatataactttgctattaattaggagtattttggtcttttgtctctacccttatattcaccttgggaagctatagttgaatattttgtgggacagtgggagtttgctttttcaaagaatctaatctaatataaaaattgttttaaaaaacatattaaaaataatcattttattaattgtatgctaatggttcaccaatctactcctatcaaccacgtatatgttatcactatgttataagtggccaacttatcgtctcattgggttaactaacgatttgcccagcgaattagatggagctcaataaacatttcagtaaaattgaaggtgtcaatgtatgaagaggtgaaacgaaattaaagaaattaagggcatgttcactttgatgtcattttcaaccataccatttttttaaagtaaagttgtcaaaaaaatctatgtttaatttgttaccaaatttggtaaatacataaaaaatcctgttaaaattttggtaatattatcatcttgctaaaattttaacattactaaaatttggtaaggtttattttagccacaatttaaatggtaagatttattttagctacaatctgaagagggctaactcgcggtggttaatcaagtttcacgtactgctgcagcaaaggacaccgctgttgcgtgcataattgcacgcgctgcaagatctaagaggccgttcagctacaggtcaagcgcatatgtcacgtccactaagatccacagggccagacaaaatcctcacctgacagcgacaccgtgaacctgtcctccgccgcccccgtccatcggacggcggccaccaccgccgccgccgcctcgtcgccatcatcgtcgtcgtttccaagaaactgaaatcccagtagcctcaattccattagtgttcttttatggtagcgtgattgaatattagcagtgacggagccagaaacaataaaattcatttgttggtgaagggtgctaataatgctaatcttctaaaatctcaagaagaaaaacagtaaagataatatgtttttttttttgccaaatttgagataggccaggccgaaactgattggtgcaggtaactcaataagccgaacaatggcttcggtatttcgcctttacagagtgccacagaagaattggaatcaactgtgtgagggctggattgtagagggatggagcagctgctgagcattttcctgagggtgctgagcaaattattgccttctgcgagtctttgccatttgtttggagtggcaagcatcagcagaagcagcagcatttgcttgcgtacagactgacagacaaatgctgggctaaaggtgcagacgtggtgaattattattagcatgcatacatctggtcgttggatcggccggtgtgtgatgggatgctactatctgaattctgaaagattgagatagataagctctgaatggcaggcaatgcctctcactgccttgcctggtacagtggtactacatgaactgattacttgatgagtcgccagcaagatcataagctggaggactaacggttttggctgctcgacagcccaatcaggggcatttcagttcttttttttgcatgtttatttacaaagattatcaagtgcagcagcttagtacgtttttattactgtaatatgcatctgaatgatccatgtgcattactactgtgctaggcactgttaaatcttcagaaaaggaaaaggagagagatgtctctgcagactgcaattatgcagccaaattccaatctcgtaaggctccaagaaagaatctgagaattttctcgtctgcctgaaacagagacccttcgagatcagctctgcaaaagattagtgaaactgtcatgccgacagtgcagcgtcagaaaatgttaccgctaactttactacaggccgaagagcatgttattcagttactggcagtggcagatactcctatcagaatgctggatctgaaattacttctgccgcgccaaatcaccagtggtttgacttacccagaagactggcatcaagtggactaatagctaattagcagagtagcaggtgatcactaacccattacccatagcagcatgttcaatttaggtaaaatttgcaatgtctttttttttaataatggagagataaactgtttgaaaacggtagtagggacgaagctctgattataattgagatgtagcagcaaatctgggatctcgagtattatcttcttaactttcgcaagttgttgcttgctgcccagaaggccagaacaatgccatcaagtggccttgcagcacagtagcagaactgtgtggtgccactgtaccatcctagaagatgaccaagagttttacccatagaagaatgcccaatattttttatttttttctaaggacttgttcagttcatttccaaaaaaacaaaaaaaaacttgcaatttgttagtaaagctaaattttggcaagatcaagaaagatatgaaggtgatgtttagttcgacacattaccaaattttagtatagttttatgagcataagtttttatagttaccaaatgttggtaggaattgagaagagttcgacacattaccaaattttagtatagttttatgaacagaagtttttataattaccaaatgttggtaggaattgagaagattacgatggtaaagccttgtttagtttggtattgctaaaatttgatatgattcattttagcaacaaactaaacagggtctaagataagattgcataatagacaaatgggccttgtttggagtacaggaatttcgttgcattcaattgagaagtattctatcaaattcattggttcctaacaagcccttagtaagggatcaatgcctaacagttagattctcacctttagattttcgcttagattttgaggatatgtggttatagaatccgaaaattaactagaagctagaaacaaaacaaactcggtttttctatattatcattagttggctcccaatcacctgtttctctcagaattttccctcaaacaagagccaaagacatgtttcagtgacaagaccacaattaatctctaatgtgataaatgataatgttgttggtcgtacaaagctggcaaagtggggatgaacaaatggtacattggtccagcaacaacgacagtagcagcattcaagatcaaaagagtgaagggccccggaaatctcagagctatccataagtgtcaaaccatcaaggcatcaactaggagcctggactacaaaaactacacaataatagtactagtaattataaatacacttggatatgaaatgtacatgagcatgatggtagttggatcaaggcttttcttatagattgcaatgtttaacattgcaatgttcaactaccgcagtacttaagtacatgtaaaaaaaatacatttttagaatttcacatctggttatatagtattatcccgcctattgaccatttccagactgttgcattcacagagttacttaaatcaggctcctagaatcttcagcaagaacatataactaggaaaaaacataatgttttaggtaaagttatataacaatttgtgtgtccgatttcattttcaatgggatattttattcagcagggcataatggatgcaagttaatcatgctaagccatgtagcatcaaggataataacatattgtgacaaataaactgaaaatggaccagtgaataagtgtgggcaaatccaggactagaaaagaaatcaatagacacattttctttctcagattgtttccttttcctctgtttttatattttctttagaatcatcaaagcatatccattctccaaggttctctcaaaaatgaatatggaagcatgaatgcgaaataacaagagattgctcgtctctacaaaaacctgtcctaatgaccatgttcttgggtccattaaaacaaatgggtgagcaacatacttgaaggctacaaatgtacaacgaaaacaatcatctgcaaattctcctccttttgcttgacgccgagctctcataatttgttgcaggtgatccaacaaaagtgtcctcactttgttggcttatacatgcagctgcatccaatacacctatggggctttttggaatggagaaaacggagccggctgattggcgcataatgtttctcataataatcttatcttgaatcatttcatagcaccgtaataccctctcctacaacattcaagtaacattctattaaaatttgaaaagcacccgatcacagatgaatgcctcttaatgcaagcaagacaaactaacagagttactaagaaattagtgtcatccaacaaaagacagaatcttttgtcagtttaagaacagtgtattgaaagatcaagagattcagtaccttctttaaatttttgtaacaagttgccaccctctcaaacatggaagtttcatgttcctccgatgctcctagagctacactggccgcgatctctgatggtctgaaaaccaagaattcagcaactgcagaccaagattcccagatttaagagttcatcaccataacaatctattatattgatggaggcatggagtggaactacaaacatgtctaccaaaattcacacctttacatgtactcaagatgaggtcaactgagcgtgagagtgcggatgtggacggagtatcatcatcattgaacttgtgaaggtaataatcgataaatgagcaagcagtcacagcttgcatcctccactttagggcattaagcactgcaagctccatcctttttatggtcctagtctcaaacacatattttgcatcacacacctacaaaacagaaaatatcaaactgaaagaaatgagaaaagaaaaactttgatagtatttgtgcacaactgttgcatgtatgataattgatttcacctgcaagtccaaggggtgtggaacaacggtttcctccatttttgcagccaaagacaaggaagctactgctaagagttgtgtcatacaagcctcctcttgctgaaactcagaatgcaattgctccatgacttggcatttatctcagaagcataaaaaaatcgagtttgtatgaaatacagtaacaatgcaatgcagagaaagatctttacaggaagatcgaacacggagaggaaccggtccaggtagttcaccgacaggactgcagtcaaaggcccaaacttataaagctcatgtacctgacaagcaacagtttcagtcaaatcgtatacagggcatgacaggtaaaccagcaagaaccaaatcaagaacaggagaacacaaaacaacgcaacaaaaggggacatttttaccgaaatgtataccatcacatctcatcctgaatagtactagcaaggagtgatgaaaaacaacgaacagaagctcaccttccaaatccagtcaatggcgtcgctcctgacggctaccaaatcgagcccatcaggctgcagcagaagccgctggaggtagccctccatggggatgtgctgctgctcctccctccccaggagggcctcgatgcaatcatcggattgcaaggggaaatccatcgacaagtcccctagagaagcatcaaccccaacaacccaagaaatctcctcgctctcttcgccaagatcaagaatggcggtgttgtcctccgcgcaaaggaggattgatgccgcaaaatcaaagctcggtgccatcctagatcactcttcaaggtgcaaactagtagctaatctctaatccactacttggtagaagaaaggaactaataaactagtagctaatccactattatttggaagaggaaaggactaatcttgttctaccactagtaaatttttcagattctgttggtctgtttcgatttgatgcttctcctcccccttcaagcctccccagactattactgcttctcttcttggtattatataggagtactacttgagagctagaaaatgttcttagctttctcttgttcttcttgaaatgagaggaggggtgaggaagagaaggcgagaaggggtcgagagggtgcctgggtgagaggcactgtatacagacacagtagggagatgagggggagccggagaggcggtctcgtctccattaggtaagcttttttctttttctttggaacggtgtgagctaggtttgcagtaaattttggtccgtgtttagatgaccctcaacttctaactttttcatcatatcacatcatatcaaa

SEQ ID NO: 64686 - DNA, 7147 bp, Oryza sativa
  unsure (1)..(7147): unsure at all n locations
tcagaatcttaaaattcatattggaaaataaaatgtaacatcatatgtttaactatgtatggccttataactagagtggattacgagccaactcagctcaactcgttaatgagaaagactagctcagctcgtgtcgtgagttggctcgttaacaagttatatctcttttatatcatattattaagaaaaaattataaaactaaccttaactttaatcgtatgttcacctaccaccttaaactttgaaaccggatatccaaccccctcgaactgtacagtaacattcatattgcaccctaaggtggttttgaaactgagataatccatgaaataccattgacaagcgtctaagtcccagaaatatcatcgacatgtgtgagttccaagaaatgttattgtacaaacaattttatcccaaaaatgccattcccgttagggttccgtccattctgcgccattaagttctatagtatgaacagtgtatttaacggcgtggaatggatagaaccctaacgacgatggtatttttgggacaaaatcgtttgtatgatccatttcttggaattcacacttgtcaatgacatttctgggacttagatgcttgtcaatgacatttcatagattatctctttgaaaattggtttcatctaatttgcatatatgtttgttagatttgactatgtgacatctgcattggatatatatgttaaactctccaaaagaggttctcaaaaagattgattactatagatcacgtttcttttggtaagacgatgatcataagaagaagtatagactcacaagatgggatatgatttgtcaacccaaagatcagggtggtcttggagttcataatttagaaattcaaaatcaatgtcttttgagtgagtggctatttaagttaataaatgagcaaggtgtttggcaagattcgttgaaaaggaaatattttaataatcaatctttaacccaagttgagaggaaatatggagattcccatttttggtcggatcttatgaaagttaagtattcgttcctaactatgggttcctggattgtgaataatggtgaacaagtcagattttaggaggataaatgggttggtaaccattcctttaaatataggtatccatctttatatgctatagtttgagggagaaactcctcggttgcaaatgctatgcattctgttcctttaaatgtttcttttaggagagttttagtagggcagaacttgactaattggcataacttttgtgcttcaattgtgcaaatccatttgacagaaaacaatgatttttttagatggaatcttcatcaaaatggtcaattctcggttcgttctatgtacttagctttaattaataatggctacattgagaggaataagtttaattggaaacttaaaatgcctcttaagattaagatttttatgtggtacctgcttaaaggtgttgtcttaacaaatgataacttggttagaaggaattggcatggtaatttgaaatgttgcttctgtatgaaaaacgagactatccaacatttatttatggaatgtcattatgcaaaatttgtttggagagcattacaattttttttctggtttaaatattccacatagtatatctcatatttttttagaattggttcgtagggattgataaaaaaaccagtaaacttattctggtaggagcttccgctatatgttgggttctatggttgagtagaaataatatggtttttgataaatcaccatctatatcttatatgcaggttcttttcagggcaacacactggctccggtcctgggcacaactacaaaagtgtgaataagatatcaagttaataaaagctgcatgtcgtaatcttaagtcaacggttatgcagttttttgccaacttcggatgaaaatttacaaatagaattcaataatgttatgatcttttcttgcattggtttttagtacttagtgtatgttcctatccttttaggcatgtgtttttatgactttttttgtcatgcgtttttatttgtatgaattggtgtaataattggttgtagctcattgagcaaagactgggattctattcaattatctaaaaaaatatatgttaaactctccacctaattctttcgttattaccccttctttttgctctcgcttacataagaatgttgatatagtaccagtatgatattactacatagtataaatttgtggtcaatgattaacgatatgtgaacaagccatattagttattcaaaaccgttgattcaagttcccagatacacaaaaacactatccaaaaccgttgataaaatggtattgcaaagtttagatgattggttatccagttttaaagtttagggtgctagagggattttgaccgataggttaagggggtatggacttgttcctattaataatttcaaatttactattttatcacaaattaacataataataaacactgactaataaagaactcactaaatatgaatagttttgtcgtaattaaaagactaagcactagttaagaagcactatcttgtagtaacgagctaaacaatcaactcgcgggctagctcggctcgacttattaaaactatgaatccgaaccgatccgagttgagcttgatacaagcctatctgagccacgagcttcgatttcttgtccacccttacatagagcgtcatcctccatacaaacaaatcacataagtatagtcacactacatagctatataatgaattgagaaagcgacgcgtgaaaaggaaacaacgtaacgcagtgacttgaggaggcggccaagggtctcacaggcggatagtcggagagatggagagagacaacgacgagcacagcgcccccaaccccaaccaggttaggatcatgagcatagtaaagatacagggtgaactgatggttgaatcgaaaaaaagaaatccaaaccagccacctttgcggctggttctatgaaaatcatgcactattaagtaaggccatatttgtttcagcataagattattgtgatctagattactgtaaactggattgtaataagccgacataaaataagtttgttgtttgtttatctggattattagttgtttgctagttgttagttacccaataatcttaaaaaacacctttagagtggattaccaattatagggggtgtttgagagagggactttagtccaaagacttattttttggagagagggactaaagtttagtccctcactcccaaacacccctatagtaatatgacttatagattgtaataatctatcataataaactatcagtttgtttaatttcaggttactcgtaataatctagattataataattctaagttggataaaaagggcctaagttgaaatccctaaataacatgcatagaaattttgtagagcttctacagaaattagttgaattccgacaaaaatcatgtattaatccaagcaaagcctctgttttcgctgttttacttccagtcgtccgtacaattcatttactgtagcttctgtacggagtaggtagaaacacatagcgtggtacagagttcagagtttcagcggtgatcgttcagacaattgatgccagtgctacacacaatttgacctgcaggacctgcagactgcagctcatcgcccagtgcctgaggactcaggtcatggagatgcatgcaaaagccgagacttgcttgcaacaagttggggtactgtttgtggcatactcatactaagatctctagacttgattagattagccttaaatttcgtatggttgtgtgagtgaacttgcgatctctagtattgccctgttgtgaacttgcgattatatgggtcgagaaggtgaggccagtgaagtgaagatggtcttcacttctcggtgaagataggaatggctaaatggaaaacgagtccgatcacaaaatctaaacattgggtcgttctggtgcccgaccgactatttggtacctcttgaagccaatgcctttgccaaatcaatacgaattatactatcttactaaaatattgacgaataaattaatagaaagggaaactataatagcccgtactattgatggtgtgtgggcggcagccttcaaacaaaagttacctcatgaagagagtatatctcaactggttattgtaagtttgtaactgaattactggcatatatggcggggaacacggtctatgcacgtaagttttttcgtgtatatcacaaacaattctagaaaaattttattacttttagtggcattacatctatatgtaaaattttattttcaaattcattatatatatgaaaaaaaaaacaaaattctaacatatttatattattaaaactataatattttttacggctaatataataaatttgagctaagactttacataaagtgtaattttattcgacgcggatataaaatatatatttttagattttttttatgaaaatttgttagctgacatggtgtgtacgtattcgtacatatgatatatccctgcatagtgtgtgtcttagactctttgttccactagtattcgtttaaaaaagtaaaggaaaaaagtataccgaagatccctctacttgtcatcgagttataaattcatcctccaaccgtataaaactagatattcggtgtcccttaacttatcaaaaccggtcagaataggtccttcggtggttttagcctcgcttttagcctatgtggcggctgattcagcgtgggacccacatagaccccacatgtcaggatgctaggtcaatctctctccctttctcctctctctctctcacactttccttctcctcatccgatgccacgaggagggcagcgccgcgacgacggccgacgacggcacggtggcggagaagctcatactcttagtgatgccgctgccgccgaggaggaggaggtgaggcgagagcccaggggtggtgggcacgtcgtccatgccgaactgggtgctctcgtcatcgaagtggtggtgctttgcgaggggatgtgccagcggtggtggtggaggaggcgaagtgatgtactccagcatgtgaagcggcggcgtcggcgggctcatggtggcggagtagcggcgtcagtgggtgagcacgactgcggagaggcggcgtaagcaggtgagagcggcggcgacggcgggcgagtgcggcggcggcgagcgagtgcggctgcggatggggagaggcggacgccgacgactccgcagcgctcggctttgtcgtcggcggcggctccgggcacgggcggagcaaggcggggaacgcggagcagaagggcgggtgagcggcggctccgagcggcaaccatctccgagagacgggctcctcccctgtcggctgctggccgccggcgcccatcgctgcggcgcccggccccgcctccacctccgtgcccacctcatgtcgcgcgtcatggagacagacacctcgtcagcgtggttcctaggctcgtcgctccgtgtcgacgcactcgtccaggagggcttctcggcgccgtcgacatagcaacctgataagagtgagagagagagggtgctgacatggcatcctgacatgtgggtcccatgctgactcagccgccacgtagaataaaaccggtgtcaaaaccaccaaaggatctagattgaacggtttttaagttgggagatgtcatatgtctgtttttgtggttgggggacgattttgtaactcaatgacaagttaagggatcttgggtgtactttctcaaaaaaaaaaaagagcccaaatatgcctctctcagaccaggccgtcgtatatacgagcccacccccacagagtccatttcaaacccccaacgtccaaacctaacggaacggatcggcgaatcccatcaagataactctcccacatcctcggcgcgagacgtgaacgaaacgtcccaagcctaccgccgccgcgaggatctctcgaatcgcgcaactcacagcagagggagaggaagaagccgagcgccatggacgccctcgtctgcaccaacgccttcgccaccgccatcgccgccggcaggtttcccctcccgcgaggccgctcgcccccgtacgccgcggcagccgtccccgccctccgctcccgccgctgcctcccgactcgaggtccgggttctcgaaggcaaaatcgatcgggtttatcggaggtttttttttttttgcgtgaatcctgacgggcattttgtgtcgtctttcatcggtgtgtttgtccagggctgctacgcctgcgctgcgccaggggggtggattggactgatccgtcgttcgtggcagtcgcggagaagcccgacgcgggggcggaggcatggaaggcgctcgcatccgcgggcggcggtggcatcgaggaggaggaggatggcccgtttgaggcgatcaacggtgatggaggatactcggtggaggagtctgtggtcttgccgccattcgagcagagcttggtggcggcggtggcggacagtgtcgaggacgatgcgctcagtcaggcgctcagctctaaggtagctttactgttttgcacgtaacccgtttgttctattgcgtctaattacttaatttattagtatgtgattctgtttatgtgggatggtggatttgaggtagaattggatgtagctagactaaatcaaaacactaagtttgatgtttatgtcgaagtgaattaatgtgattgggaataagtagaaatagaaaggtaaattgttatgctggcctgacatggtaagatatgaacaatttaaccttttctaagatccttatgagaacagctctctggtctctgcacatgtattactttttacaggctctattaatactttggcgtggccttttttttttgcgagtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64687 - DNA, 1146 bp, Oryza sativa
atttcggacctaaccaaggtttttcaggaccagaattcttcgaaaaaaaagcgaagcttctcaaatagttttttcccaggaaataaagaaacactatagctccaatttttatcgatatgaaatagagtatatcctaaaacatcactttttactaataagtcatagctgcttaaaaggcaaaaacataatttcataattgcagtgcaagaaaaatctcaatgacacatacagggcaattttctttgacatcccataaccgtaatgtgctatcagttgatgcagacgcaagctcattggtggacaggaacttcacataagaaacagctttcttgtgcccaccaaaaacatggacaggcgcacttggatttcgcaaatcaaaataatgaatatggtgatcagcagaacccacctgcaataatgtaacatctggtaaggaaaaaaaaacttatatttgatatgagccaagaaaatcaaaggaacatactgcaacatagtggctcgacccaggattatatttgacagagcaaatattggccttcatatcaatattgatggcacttgcttcttgctttgtgcaccacactttgacctagcacaaacagcagtaggttccataaggtatactgcaatacagatacttccatctatgcattcaatgaggttgggatagcctaggtagaaaaatgcaccattatagaaaaagggacatgaaaaactgataaataaaataaaatcctagtatgttgcataacatgcgatatatccaagttatgttttactgtattttgagaactacgcaaagttttcttgctttcgggaataacaaaagtagttgtaccattgaaatttgcaaataccttgcaatcatcactcccagatactagcatcgagggttctgttcgagaaaaatcaacactccatgctctcttttcatgttcttcatactccatcacactctaaagaagattgaatacataaatatcatgaatccaagttcagaaaataacacaagtgtgcaaaatgaactgtggaacagagcaagaaatacctggcgggtttggacatcccaaacagttactataccctcatagtcgctgcttgctataacattttttgagtacttgttccagctaaggcagctgagtt

SEQ ID NO: 64688 - DNA, 1493 bp, Oryza sativa
ggtgtcgctgaaaccagcggcccacggcgacgcagcgcaggcggcgcggggcggtggtctggctggacgctggtgggtgggtggggtggggtggtggtggcttggctcgcagctccgttgggtcgggcgcgcaagcgcaaaccccttgcgcgttcgaaaggccacccgcctcttgcagttttgctccttttttctctcccgcgactcggcagccgatacaaaagctgcgatgcggcagccggcctagccaagccgcggcgtctgtgggtgcttcgcagagagcgattcagatgatcagatctgtgggtggaagcagagagcgagaactaggctactccctccatcccataatatattaacattttacactgtttaaccactcgtcttattaaaaaaaatttgtacaaatataaaaaacaaaaagttatgcttaaagtattttagataataaagtaaatcaataaataaataaataataactctaaattttttttgaacaaaacgaatgatcaaacagtaaaaataaaatgtaacaaaatattaatcccttatattatgggacatagggagtatgttttatgcactgtgacaaagatagtggcttggccggtagtaatagatattttcatgcactgtgaacgtggtaacagggtttacaggcagcgaccaacattttcactgcgagagttcaaaaaactgttcttttcagtaaaagagaaaaaaagaaatgaaggtattgggtttgaaatttaagcgatgaaacggcaattgcgtatcctggaaaattttaaatcagtaaaaacaataagaaggcttgggggtgtaatatactgtacttttagccctgcgtaagatcaatgagatatataagttaactatttctgttaggtagcagatgtgtgacaaactggcttgtgttgctgaaatcagcccagtacagcttgtcttcccagttcccaaaatccaatccaatatatgcaaccaaacaagcttatttgatgttcatttctcaattctcacgttacatatgtataatcaattacttgactgctttaaacctatacatgagaattctggactatgcacatttcgagccctcgaaaccctatgtcagctgattaccttcaaaactttgcgccctatgttggagatcagtaatacctccactcccatttggggtataatggcacgaaaaggaaacaactgtatacatcaaatatacaagctatctagggatctcatgaaaaccactgatttcatcaaggagcaagtacaagaactttaatggtgccctgactgttagcagttaacatggtagggctatcgctcttccagcagactgcgctaataaaataagagccaggatcatcatctgcatcatcgagatcagatgatacaaatctgtggttggcagcaggttttgagatagcctgcaattggtacagagttacttgaagttagaatggtatatggtgccacaggagaccaacctg

SEQ ID NO: 64689 - DNA, 42692 bp, Oryza sativa
aatttggcaggtcgggacggacgcgtcgcgaagcgaccgggggagtggttagagtcccaattgtcctcataaatgaaaaccaaaaattaaaatttcaaacttgagaattttaggtcgctaaaacatctctgtaaattactactaccttcatattttaatatatgacgctgttgactttttatctaacgtttgatcattcgtcttattcacaaagtttatgtaattatcgtttattttattgtgacttgatccatcatcaaatgttttttaagcatgacataaatattttcacattatcacaaaaaatttgaataaaacgaatagtcaaatattgataaaaaaagtcaacggcaccatacattaaaatacaatacggagggagtactttaatttaggtaaccgatgagtaaccttagtttcagacgtgctgggtccggttgttatgtgggttacaaaacagcgctgcattgaacaagtgggtgtggtgaaatggatgttctgttagaaaattcttgtaagagaagatcatgcgtgtttctgggatcattctccgtgtaaaaaatgcatcatctccatggccaaattggccactggatgctatcactgacccggtgcgtgagcccgtggccaccacacgaattctgtacggctgtaccgtattacaggcaagggtttatatttccaatcgaggtcccgctcctgaccctgtcagtataacggttttcacgaaaaccgtcaaatttcaaacaaaattaagaagccaaattctcaagttccatttgcccgtcaatgaaaaatgatcaaaatcaccgaattccaaccggaactaccaggatttcagttgattcgaacaggaaaccaccgttccagtgttttggaaaccaaacaaaagcatctaaaactcattggatttgctgaaaagccaaagagtagcgtgggaattaattgtgttttctgaatatttggataataggggaaaatgtttgaaatatgagaaaattcatggagatgataggaacattgcaaactaaaaggatatcaaaatggggaaaccgtggaaacgtgggaaaatgtaagaaattaataaagaaattcagcatgacctttcctacaatttgacaacctcacattgagaataagcgcaatgtatattcatgaacacaaatacaagataatttgaagtccatatcattgacaattaaatatgcataaccaaatatatgttacgccattaacatcaacacgcataatataaagtacatcaacacaatacaaagtacacccacaatcaatacatactgtaaagtgcataaacaacatagtataacaacaatacaaagtccataatataaagtgcatacacaatcaacacatattgtaaacccttctagatgtcttttttcaatttaccaattcagttgttgtccaaagagcattttcattctacgcctatattttttgacatttcatatgcatgtatttactacaaatgtaggactatttacaagttatttttaaaatattcttcataaattttcaattcaaatttgaaaaattctgaaacgattcaaaaattccaacagaatttgctttcgcgctgcgttgaaacgtcagagttgtgaagtgtgaaccctaatctatctgatcaaagccttctttttttttggattgatttcatccaggagagatgtcagctagacagagacgatcactgatcacgcgacaagttgccatatcagagacctcaggctagggcaacacactgccagcactaacccatacttaacgaggactggggttcagtttataaaggagtcaagagttcaggactgattcgatgaccgatttcagtcttgctacattctatcactgtctggaatgataagacaaaccaaaaacgaaatttcaatgttttatactacatcctatcgatctatctgaactgagaagagacgctgactgaattgcctagacaagaacatagaacatccaactccatcactaagaagcaaaattttgcaggtaatgcctgttcacgatatagtttgcaggtaatgaccaggtacactttcttatgccatggtaaggaacgccgagctactactgttcacttcagttcagctcacctagtcactcgaccagctcagcgagcaccttggtcacctccttggtcaggtcgccacggcgcagcaccaccgaaatctcggcaatcctctgcttcttgatcttcatgtccagcgcatgcgccttgtcgtcatcgagcttcccgaagtccctcttgaacaagccagggtgtgccgcctccagcaacttgacctcctcagcgaggtgcgggtacagctcgcacatctcgccgaactccctcggcgcggtggtggtgccgttcaccgccgccgctgccgcctcgctgccccagacgctcttggagaggtcatagagccggcggtcatggcccttgcttgggagatcgcccttcttcttagcggtggattcgtaacggcgcttgagagtgctgaccttcccctggagctccttgcggccgtagccagtgttgtcgaggctgccggcgagggtggcgatgagcgcgtcggtctgtggcagcgacccgtgctcccggcggtgcgccgcgagcgcctcgaggatgcgcacctcgtcctcggtcgaccagatgcggtggaaggcctgcctcttgggcgacgagaccttcgggccattcccctccgccccctgcttcggagccggattcggcggcggcggcggcggcgcctccgccttctcggattcggacgactcgtcctcttcctcatcggacgaatcatcctcctcgcgattctcctgcggtggatccctgctcttggtagcggaggagcgcaccaagtcctcctcctcctcctcctccgattcctcctccccggaagaatcggactccgcgcccttgttagagaccacgggtgcgggctgagcaaggggactctcctcctcctcctcctccgactcgtccgagtccgagccggaggcggtttcctctgaggaggcaaccggaggcggcggcggcggcggagtggggcgcttcggggccatcgccggagctagggtttggagggcggaggcagaggtgggtggcggtcctggcggcgccggtctcgggacttctccgtgcggcgtgatattggattagcttgtagggcttgttggggtcttgggggttacatcgaccgttggatttcggtgcgtagcccgcatccaccgttcattttccgatcgtccattttttgatcgtgatcggatggcttattgggctaaagattttatgggccggcattttagttcaaaatcgaggcctacacatgtacgtgggccgggattaaagcccatctaaacatggtctgagctgggagtgtgtggaccagggtttacaattccgacagacgcttccgtttcgggcaccggtggaattcggaatttcgcgaaatccggtggaaaactggtaaattccgaacaaatttcataaaccaaaatttgaatacaaattccctgagtttgccgacaagttcttgaaaaccgatcggttttggtgaaattccgatcgaaatcatcaaaatttcgataagtaatccggcccatctaagtgttttccttttttaattctttattcttttctttcctgatgtaagtttcagtaaatacacacaatatatcattttttttcaaaaaaattatatcccaataggttctatgaatatcatattatttataagattttatttgattttttccttttttatcaattcaaatttaaatttggatgaaactcttcgaaatctcagacggtttctacttttgagcctcatcgaaacgtcacaatttcgcgaaatccgacaggatttcatcggaatcgtaaaccctggcgtggacgatcgcgggatccgacgggagaacgcgcgaaccagacaggtggccgttgggcctattctctgttcaggctttgatccaaataatctgcaaatttgaatctgaattgtttgtcgccctatcgacttgaactccatgaagatcttatcttgaagtctgaggatgcagtccaatgatgcccttcacttcatgtttttattccttcttgttaagatttccccaggattcatctggactcgatggataatttttccttttttctcctcctaaatttgatgctccttttggctagggctcagaagtcaggacacaggagactggggtagcgagtattcagtgcaatccatcctgttaacaggtaatttttgcaccaaaagaagatcttttgttgttgcacataagcacattcctgtcagatttcaaaacgagtacaagatcctaaatttcagcatctaggaagtaatatgttagcgatgcagtaatttcacgtatccagcttccaaattttgtcagaatctgcgagactgcgactactgtatctctgcagtacaaaaaaaaaagaggaaggccttgtattttgatggatacttttatgaggataatgatggttctaacattattctctgatgaattgtttcaatagcaacattacaatatgttgctaggtagacagcatggttacagatcgggaccggatatgaaaaaacattcggttcggttaacactgtgaggccgtcaggtgcatcaagctggatgtgtcaaacagctccatgaatctctgatcagtacttctcgccttcgccgctgcaaaatgctggtactcgtcgaaaactgaagttaggcaccatttctgcaactttctcaggcacccaacgacgcagccagtccggtgctgaaacatgtggaatatcaggaaaccgtcgaattcccatgtagcaaaaggtttcaagaaaatgggatatcagggatgtgcaatgctaaatagatatagctaccttgcctctcttgcagtggatgagcaccggttgattccttacgtctgaattgatcaaaacgataagagttagatacagatagtgtgatgaaattttgagacattggatatatctttgtagaggcagataccaagaataactttgagtgcttctcggattttttcttcagggatgtttacaagcagctcctgtaacagcaaggttcagattattgtcaggctatgcatcaactttaagagtcaacaggattgaagagaatggtcagttggatgcatactgaattactgatgatatggtatagcaatagaaggatgttttaatttgtttcacagtttcaggctaatgcggtaactgataaggttcacctttatcgaaagttcagatgcaaagatatcgtcatgccactcaagtatgtactacattattggttctagttaacaaagaaacaagcttagaccctgtttagatgggactaaaactttttagtccatatcacatcgtatgtttggacactaattataaatattaaacatagactattaataaaacctattatatgaccccggactaattcgcgagacgaatctattaaacctaattaattcataattagcctatgtgatgctacagtaaacatgcgctaattatggattaattaggcttaaaaattttgtcacgcgaattagctctcatttatgtaattagttttataagtagtctatgtttaatactctaaattcatccgatatgacaggagctaaagtttagtccttgatccaaacaccaccgtacaatccatctagcagtgaccatcctagaatccatctagcagtgacacaattattaccggtgaccctcgtaattcagtggtttcagacacctagcttgagtccggcgaaaaagaagcatcatctccagacaatgtcaaagtgagcactaatttccattcacacacttgtagtaaggtcagccacctgatcagtgtcttttcactcagcgatatatttcttttttgctgggaatgctaaagttggtcagcacatctgtgttgtttatcatcgacagcaacaatcgccaatgaacgatgaaagtttttttttgtttgaaggtcccaacttaactcactcgattttcacatgcacatttttttaattactgaacggtgttttttttaacaaaaatctatatgaaatctatatgaaagttaatttaaattttatattcatattaattttatttttttaaaaaaactaaaacttaattaatcatacgttaatgagttatgtcattttgcatgaactagggatgaatacctaacccaagcaacgacctcagccttaagtcgccgacgctgaccaactttgaccatttgccgtggcagttcatgccttcatgaacccagaactgacagtggaatatgttctcattgttgcagacttgcggtggatgctaccacgcgatgacacgagtactaaagttgcgagatggagtaatataccgacatactccaaggctactatgcgtctatgcctaaatgaacttttaatatggacagcttgacaaaaccgtactaatggctttcagtgaaggactagtaaaatgagaataaatatggcatggcacacagagaaatggtaatcttgggtggctggttaataacggaattaaagtcatggccaacaaatttatgaaagaattacgctggtcagacgtcactcgacagttaaaagacaggtgcgattatactataagtcaacttgatcctctttttttttcacataagttctcttaaaaaaaataatgggcataagtcaacttgatctttgtttaggcacccaattcacagaggagactccacaagcccatcatttctcagctactccctccgtctttctagattcaaatttaggattagttttttttttgatagagggagtagaacttgtgctgtactgcatcactgatcacttaagcttaaggtgttttctttttttttttttacccttaaagcttgcagtattcagtaaaactcagaaccagactggcataatgcagacaaaaatctcctaaccctgaaatgcgtgatgctgaaatagaaaatattttccttagccatgagtctaccaatcagtttgaactagcttctagaaaagtagcacaacgctaccagaataatcataacaaagataagctttactgttgctaatggcagtaggccagtagcaagatacgcttttgcagcattgtaaacaacttctaatcttctatgggtgctgggctgacgcaagaacccgcttaactgacactgttgttttgcattgtaaaaaaaataactcctaccataatgagattttctacactattttgtgagaagggaaaacgaattagtgaaataagaacataaaaatagtagcgcactagatgcattttgctcaaacagggtgttttatagtcaccatgcaccacgtaaccttgtcaatttaggttaacaaaacccaaaaacgataaacattttcagcctgaaagactcaagcaaatgccctaactgaaaggggcaaagataaagcaagaaagggacttttgtttgttctagttgagttgttgtttgccctagttgcgttgcccccaagtgttttgccgaagcaagcagcaatatcagttgtcagttcccatgtttttttaacggaaagtagtcgaacgagctcatggccatacgacacgaggcaacgcgcagaaaacgcaagtgcgtgctcatgtcaaacaggtaaacagcgcgttctacctaaagtaaccctcgcatccactgtaatgcgataccagttgctatttctcggtgcaaattatgtgtgcaaattatttatctccacaagcagaacgcaccaaatcgaccgaaaaaccaaaaaacaattcgatgcgaagatcgactttgccatccgtggaaaataaagcagaaaatcaaaggactcaacgcatatgatttttgacttgttcatttaccttgctgccgtcaataccgaactggtgaagcttgatgccgttctgctccagaaaccgcgtgttctcctccgggtacggctccgggcacaggtacctgcaccgatcaaccacgccaaggcgtcgccgccgccgtcagaacacgtaatcgacgagctcgccgccacggtcgccgtggccgagaaagagatcctaggtataggactcacacgatcgagcgtagcttgagggagaggaggaacgcgaagttgtcggcggcggggaacccggagcggaagatgccgtcgttcacctcggcgaagttaagcggcggcaccagcaccgccgcggcgtccacccacggctcaatgctgaagacggcgcccaccgcctcctcgccggcgcgctgctggtgctcgccttcctcctccttctgctgctggctcctctgtctcggcgaaatctccagctgcatatcctcctcttgggcgcgtgttcgtcgcgtttgtgcttagtagaaacggtgttcgcgcgcgctcgtgtcgtgtcgtgtggtgggatgagagactctcggcgagagtgacggttacttatagaggggaggcggaagttgggggaggataaagaggggcactatgtacgtcaagtacgtgacagtacgcgtcccgttgtaagttgtaaattcgtggatgagcgtgaccgatgtgggttggcacggctctgagagaggaaatttttaggcgagagtgatgcgacgatccatttcacctagtgttgaaacacttagcttgtaaatgcgcaggtttggtcatgtgatagctctggcgaagtgcggcgttttatccgtgctcaaagcctaacgccgcatgctcttgacctcttgtacaaggaccaaggtcacgtgagagtttcatgagacacatatatggaagatttaccaattcctgcaaattcaatacgcgctcttatgtgcaattgttttcgaaacttagatcatatgactttgtgcagtctataattaaattactaatatacagattatactttactatgatacatatatcagtagcacgattataagttacacaaagtcagacaagctgcatctactcttagaaaattttgtcttccatgaaaggtgacttttggtctgagctctctaaccgtaaaatccagcagaaatgcataaaaccatcagcatattgtattgctgtcgtagcatgactcgtctgaaggactgcccagttcactggactatgggccatttcattgtacagttcttattttcctaacccgtccttgaccactgatctgcggtttggtaccgacaagaaagcaaccctcgtggagataacaccacaagcgggagcagagcatcaaagagcagcagcaaacatggtcaatcaatcgatcgatcgggtcaggtcaatcttctatcttggtgttcgtggtgtgcacgctacgaattgcattgtggtttgatcgttcgttgacgctgtgaacgattgatcgagccacatgcaagtccgcagccaggtggcttggtcgacggcagcaagcgccatcctctttgaatctggaaaagaagttacagtacacatttggacccaaccagataatccgtattggatcagaaggtcaatgttagaatcttgatcagtttcattgtcgcgacagatctagatccatgtcaagaaattcagacgtcctagaagattataggtaagtatggattttgaccaaagttgtctgagcacagaatccactacaaagtctacaaggcacggttagtttgtgttttcttactgtatttacaaacacttttttaaaaaaaaggggattttgaaattccaaaatggcaaaaggcagcattatttacacaatacacaggccttagggtacgctcatttcagcttataggattagattctcctcgttttccgttagcacgtttttcaaactgctaaacggtatatttcgtacgaaaactttctataaagaagttatttaaaaaaatccaagaaatttattcatcaaaaatttatatattaatacttaattaattatatgttaatcatatttctcgttttacgtacggctaatcagcctatcctaactactgaaacgagcgcacccttagcccttaagctctcgcacgaccaacgaaaactccccatctgcaagcctagtcaggatgcattatcgcgcgcgtggctctccagtcgcattccagtatagtgcagcagatcagatcagataaaacctgcatgcaacatgcaaactatatatgcaagggcgcaaggctgcatcatcaggccactaataaacaaaggggaaagggatccccccccccccccccccgattctctgaaacccgatttgtcctcctgtcgtagtgttttgcttttgcaatgtgtgtggctctcatttaacagtggatcatcctacctaaaacggtggctgtggattaccggaaagagaaaacaaatcaaatttgggtgcaatgttctgaactattttcagtactttggaaccctgcagatatcattttctgcactccagacaatgaagggcacactgtaacagtcactactgccgctttgccgcagaaggcttcactagtcatcatcgccgtaagctgcaagtgcaagttatcaagtggtttgctccgtatagactccaaatgctggtacaattttggacaaaagaacacaattaacaaggttctgaaaactagaaatgcatgcggcgttcgttacacaaagtcgtcgaacagagaaaccatggttccttttgacgataaaaaacacgaagtcccattgcgtatgaactctagcttcttattgggggtaaaagatactgtatccaaccctgatttatattcagaaacacaaaagtttcagactaaccgtgcattttcagagtatcgtttatccgtttgcaacctttttactttaattttagcaaaaaagactttgagttggttgtaaagtggtaattgccggtgaatagcatgccgttgcccaatcgctcagctacaggcgatctacagcatgcaaaatgccgggcgggccaatggatgggacgcgacgttgctgcagagttgtctcctttgcgaaagcgattcgatatactactcccaagtggccggacggggcaaatcgggcgcgtttgggttgggaaaaaaatgtcacgatatgcaaaggctacagagcaaattatgaaggctagtccatgagagaatataatgattggtaaaagagattacgaaacataccgggacgaagaacatgaaattcaatttccaaaaatagacgctcgagcaaccaaacattcggactactcctaataaactcccaaatgaacaagcaaatgcactgtcagagtggcccgtccgttcgttatcttatatattatctgacgactgccacggcatttccaacaaacctcatccttcatcctccaatggtacagcaacctcgggcactttacaaaggcgcacggtgcacgcacgaaacgaacatcctctccaagattggcgccggtcaggtaccccttttccttttgattaccaaatccatccgcatccagtgtcctgttcggatcgcaaagctgcagggccccgatcgagatgtttggttgcttttgctacatatatatggccttctcctagctgataataaagcaacacacttgttcataaatttgtcggtcactttcggctgatccgggtttcatttcatcacacaaaagctggtgtatcgcaacttcgcaactcgcaaggttgaaaaccgaaaagttcattcgatcggccgtggaacagtcgaaataaagcccgtattcaccgaggcccacatggcaaaactctggatggcattacgaagctgtgggccgtgggcaccgcgactcctacggacgcggcccccgctgcaaaacggaataagttcactttaggtctctctatttgttgaccagtctgattttcgtccctaaccgcaaaaccgggtacgacccgtcccccaacttacgaaaaccggcaaacgagatccctcgacggttttgatagcggttttggctgacgtggctaatttgacttggtcttcatatgacgtggcactgacgtggcgcttatgtggcaatttgatccgggtaaataataaaacccgtgggacccacatgtcagttgcacacataaaataatataaaaaatagtgggacccacatgggtcccacatgtcatcctcactcctcatttcctcctcttctctcggcatcttcatctctatcccatttcctctctctctcctctctccagcagcgccaccaccacggactccgccgccgctcccgccaccgccacatcccttgccggtgatccagatgaggttccgcggtgtacaggtggatctcgtgtacgccggcgtgtgcctcccgtggtgcccgacaacctggagtggacctcagcgcgaccggtcggtgctccgcggccttgacgacctcgccacggcgcgcagcctcacggcatccgcgtggccgacgagatcctgcggcttgtcccggacaccgcggcgttccgcaccatgctgcggtgcgtgaagcactgggctaaggcgcggggcgtctactccaacgtcgcaggcttcctcggcggcatcggctgggctatcctcgtggcgcgcgtgtgccagctctaccccaacacctccccagcatgctgctcccgcgcttcttccgcgtctttgcgcggtagaagtggcccagcccggtgatgctgcgcgccatcgagcacgacgacggcgagctcggcctcagacgccaccctgcgcgtcaccaccgagcagctcgccgtcggcgacgacgtctgccaggagatcgtcaaggccggcgccatgtgggtggtgattagttaagtactgcttagtcttaatgatcggtaactgcatgtgttgtagcttgactaacaaatcactgagtctgagaaataagagtggaagtgtagctagttcgccgcaagctcgtgtttgtcccctgaagtatttgcatcacttgtgtattccttcgtgcgtgtgtgacctcgcgtgtgttttgttgtttctctgggccaaagctcacagggctgggtggagtcgcggttgaggcagctgtcggccagggtggaggcggacacgtccggggtgctgctctgccaccttcacccgcaagcgtacgccaccgagcaccacaaggagccgcggcggcagcgggagcgggaagccgtctccgctgcagccgcctcgacgccaaggatctctgggcggcacgccggcgctgcacggatggccttgaggagagcagctagctcgctcagatggccttgaggtggtcggcagcggcggcggcggcgatgtcctggccgtcggcgtctcagcgagggcgacgatgttggggaagtccatggccacggcgtcctccgtggtgaatcagtcctcgttgcggaggagctccttgctgccggcggcgaccatccccggcgtaggcgtggcagtgcacggagcatgcggcggcgtcgacggcgaggtccgcctcctgagcgccgtcagccttcggccttcccgagccttggcacggcggacctcacgtggtcctctcccaccagggactgagagagaggatagagataacagatacagtaagaggggagaaatagggtgacatatggggcccatcattatttttattattttgtatgtgcaactgatatgtgggtcccacgagtttgttttccagatcaaattgccacgtaagcgccacgtcagtaccatgtcagataaagactgagtcaaatgagccacgtaagcgccacgtcaaccaaaaccgctatcaaaatcgctgagggacctctttcgtaagttgggggacgggttgtacccggttttgtggttcagggacgaaaatcagactggacgacaaatagagagaccaaaagtgaacttattccctgcaaaaccgaaacgcggaaacagcagcggcccgtgcagcggtgcggcctggtagtcaggggacgtcgtccgttggctcggcccttcacgagcgcggccgggtgaatctcgtgttctcgtcgacgccgctgcgtgcgttcgtgcgtgcgtggtgctcagcccgtctgccgtgcactccccgggcgagcgcggcgtgcgtgcgttcgcgtcgatcgtgtccaagtccaatcacgtcgcggtctcggctaactagtgtgttccggcctgctacgacgtgccgtctcgtctccgatctgtaccgcacaagcacagctgtttgcaacaacagtacaccggggaatcgaccgatcgatcgatcgatcgatcgagacgtgacgtactccgtatcaactatcaagagtcccgtcgcgttatccgcttatctgttcagggtgccagccaaagagccaagtccgccgcttcgcgaaacgccacggggatgccggcgagcgaggccaataatttaccacactctcctctactcgtgaatcagtggtagggtctcctcgtcgtcacgacacaggagtagacagcgcgatagtgcaccggtggtggactttgccaatggcagctagtactatatacgcatgcggctgctatttgcaggaagcgagcgtgcgtgactagtgaaagccatatgggctttctatgataggagagcaaagtgcggattgatcttttctttcacttcgcatgcacacacaaaagtatgggaagtactcctgggaatagtaccatgtcgacattctcctcatcggcctgagcctgccactggccagtttatatggagtatatcattatatgtactgtacgatatactctacttcgtatcaaagtgcctaagctagtggatgccagttctgccctagtgtatgttaccatgcaaggacatttgaaattaattaagcaccatcttgattcttttggaataactcatcagaaatatgtatcgctatggctatggtttcgtttgcagagcccataatgcatataatttcatccatcattcactggatatttggatcaggcgagccatgcccatatgccccggatacgcgatggctcgggcctactgcacgtaaacagccgcatgggccgcagattcgctatctatcccttatcgttcactcctcctttcgtcctttttccagctttcccggagaaccggatgaaacatcgaatattttcgatctgcccagttcagatatcgcaagttaggctggttcgtgcaaggataggacaataagattggccaccttcctacgcctagttgtgtgtactggtgcagtagctactgctgcttttgtttttatcataaatcgttttaacttttgccctagtcaaacttatctaagtttgataaagtttatagaaaatataacaacaattctaacacgagacaagcataatattaaatatatttaatataaacataattaaacataaaaagatttgattagaaaaagaagtcaaaaacaactaatgttacgatgaaatggaatagtattagttacttttcttttgtgatgttgcagttgacacgacagagttcagattctggcttctaatttgcttaattagttcgtcagtggtagagaaaggatgcagatatgcaggaaatgctgaagaaattgtgtggctaaagtggtaaagatatgaggtctcaagtgcttagccctcgtccctgtcaccttaaatacagattggcaagcaacagaacagatgctagactttcttcgtgatagtatagttaacctgattccgatcgaaagtttgcatgtcttcatcgagcagcaatctttcttcctgtctggaattccgcattagaggttaacagctaggagcacatatgcaaatatattcgtgcactaacaagtaacaagtggcaacatccaattctcactcgaactgcatagatgaagctgcccaacatgttcatgaaagagaacaattttatcccgatggaatcgcagtatttcgtagcttttgtaaagcgctttgcttcggaaagaggaaggaaaattcgcgtctaccaacgttggctaattaaggtcgtgtcgtgtgtgatctggaaaaacattggctgcaggacggattagattgagattcccgtgttgggcaaaatttttttttttcggaaaagcagctagacgaaagcatgtcccgagatcacaatcccaagtatctcacgtgcttatttcatagtactactttcatagccggcaagccctgcaactgaaggtacgatgtgttttcaagtctgtggaccatctggctggctgtaaaaataaaagcaattcatgtttttggaggcagattgactgcattgcctgggtctgaaatgtttgattaatttcacaaacaactgatacttagatcaaaattcagttaaaattttaaaagatatattacaaaactataaatttaaaccaaatttatcatgaaaacatgtgtttaaggtattgtatcgattaaatattaaatagctgaaattagaaaaatagcatagagtccatataggaatttaatattagaaaaatagtatagagtccatataggaatttagaattagctaaaattcggaataaaaataataaaattaaaagtagagtttggagtccatatagaaatataatttacaaataactaaaattcaaaattttaaaaataggaagaagaatctaaagtccatacagatatacaatttagaagtaactgaaattcaaaatataaaaataaagaatattgaaagatgattttagagtccacatataaatacaataaagaaattttcaaaatttagaattgaaaataaataatattggaagaagagcctagagtctatatagaaatacaatttacaaataacgaaaattcggaattaaaaaatgaatattagaagacgactctagagtccatataagaatataatttagaaataactaaaatttgatattaaaaaaattaataactatcacatatatacaatacaatatgaatattacaaactggtaatttggtaaagttagtacaaaatttaaaattagagtaaagtgcattggcggtacttaaacttgtagggttgtgtcatataggtccttaaactctcaaaatgcatatccagattccagaacttgtcaaagtatatcatctaggtcccaaatcgacacatcccctataggatctacgtggcactaatgtggcatgccacatggacgtgacgtgtcatccaggcattcatcccttccgtgtaccattccctttgtacttggttcccagctcaatcctctaggtatccgttcgtccgcgtgggtcagagagaaaggagaagaaagggaaaaaagagaagaaaaaaaaataaaaaggaacaattttaaatgggtcctatttgtcaattaaaatgatgccacatcaacgccacgtaggatcctgaagaggttgtgacgatttgggacctagatgacacactatgacaaattttgggatttggatatgcattttgagattttaaagacctagatgacacacccctacaagtttaagaaccgctggtacactatactcttaaaattatattatcattttaatatattttaacaataaattagaaaaatatatatactattatatgagagaaaaatataatgatgctagccacacaatctgtgcgggccaccatgctagtttattaaaattttaaaaagatatataaaaaaactataaattcaaacctaatttatcatgaaactatgtgtttaaggtattgtatcgattaaacatcaagtttcatcacaaactatatcttttgtaactaaaatccaatagttctatggatctgaattctagaatatataggtttatgacaactttttcattaaatttatagttttgtgatactccgtctgaaatttgtagttttagtgataactttactagtaaatttataattgtgatctaccgtcttaaatcttccattttgtaataatttagttcaaatatatatgttgttttgtgaaatttatttgaaatatttctttgaaacgagagtctaaattctgacttggtctctgaaagaagtccttgattagtttatgggctactatagtctctacacactagtgataaacatagaactctagtatatatgcaaatgtcattaactgtccacttgttgacactgaccaattttgatgagacaaagtataataagatgaaaaaacaacactagtatgcagctaacagggaggtccacttgaacaagcagagtccatgtaaggtgagagactttactttaatccaacattccatcagctacgcattgccgacaacgcaccaaacaaaaacagatctcgtttctacggctcgtccggtgacgttaacatccccagattccctaggctatacaccacgctgatacgccatgaaatgcacgcaacaccgcagcgtgcgagctggaaagcagcagtgtttcgagcgtcccacgcgtggagcaatggaggtcggctcatgcttccaaaaaattggtactctagctagttaattactgcctactggtgaatggtgattccggccaaacgtgttcagctatcgtggaattttgctgaggattcagctaccggagtgtaaaattttgctgggtctttcgccgcctcgtagtcgtatcgctatcgtggaattaatggcgacggcacgtagcttcaggtcgtctctgtttcacagcagcgacaggatgacgaagcgcagcggcgcgagcgatcggccgactggtcagtcagcggggatggacggcgcgtcgcgcgtcaccgatcgatctccatctctttcacccgcgatcttgcaaacgctctcggtgccgtggcctcgatgggagaggatctttccggcgtcgcaattagatctccctttttgtttttcgcactggagttgcatggctatatgcaagatcgaaatctaggccggtactgaagtttgaaagttgcgaaagcagagaaacgtcttggcacgatcacacggcatctggataggctacagcgaacgatgatcggtatatatccaggcaccccgttcttgatcttgtccattgcatgaaagtctcgcactctcgcaattatatattctgagttttcagtgactgcagcttgagaacgttttcaatgtctgccgcttcgttgaagcattttggtgcacttcgtaattctctgaatcttgacttgcgcaattctccatatcatatatagcgggtataacggaataaaatctccatagccactagctatgtgttttttttactgcacttcgtgcgcgtacatagaggccgagtttagatctaaattttttctttaaacttccaacttttccatcacatcaaaacttttttacacataaacttttaacttctccatcacatcgttccaatttcaaccaaacttccaattttaacgtgaactaaacacacctagaattagattccagacactcggacaaatatcaataacagaagccatgcatgcctgtgatctttttgccggccggtggctttgcaaagccaaacactgttacttggatgggtgtacgcgcgaataatcctatggtccaccttttccttgatactagttgataccccgcgctttgctgcgggatatgtggatgaatgtatgttatacattataaaaatgataggtgtatatgtttaaataatgtgaagatggtaattttatattgcttgcatgctaagttctaaaaataaaactaaattacaaatgatatatcatgtttgtatgagatctaaaatactgtagataataattgctagtggatgatgatgtagcatactttatgttgagctttacgaattagtgggtactaactatatatatatgttttcctgatgtaacaaaagggaattgatagatcttagtcacgtaaaatttatatattgctatgtctagagttataatatgtgcaatatgttgttttagttcattttaactgcaatttcattgtttttcttattatatatggtttacctttttttataagtctgaatatttttgcatctaattttataaaataattatggatggtaaatttactttatgtgtagcttagagtaatccgttgtcatccttttacctagctaagaatgcggcaactttattttggataaggaatagtgagagatatgaaaaccattaaattaattgctatcaggaaaaaatgactgttttcttataaaaaaataattaccttaaatatagtatgtagatactttctagttaattcattcatttctatcctcgaataattataagaaatctaaatctgttcggtgatccaggacttaagagaacacaaccatagtgaaatttaaaagaaaactagcccctatgggtttcgcaacgtcccacccaaaggactactagtgttccgcctaaaacatagaggttctcctagatatcgaggtcttaaaatttgtaagtttctgtttattttaaccatatataagcttattacatataattttacaattttttttgtatgttatcataatttattgttgaatcattggaaagcgataagtgatataatagttatgagaaacattgtctatcatccaagggataataaaagtgaccataatttttaaaacttaagtagaattgtggagcagcctaatctcatctccatttttaaaatcttaagtagaattgtagagcgggaactagctcaactttctgtttttaaggtgaagctcagaccgtttggtagggctataggtatacctctccattaacttattataaagttaaaaacatatttaaaatagtattacaaaatattcatgcatagatttttttttaaaaaaaaaactacgccgttttgtagttcagaaagtggatgtgatagagttcggtggtacgtacgtactcttcgtgacagtaaatataatgatatatcatattccggaagagtgtgaccaatcaccaatggcaacttatggatcatatcatctagctacaactcgtttatatatatacaaatcatcctacagcgatttctcttttggacgcagacgccgacgcaacggcgcatgcaagccagttgccgagttgtcgtccaccagtttctggtcgactgttgtaacccgatcttggtcgcgcgcagctgctagctggtgcacgcgagacggacgcgcgcgcgcgcgcgcccacgtcgtcttcacgggggccgccggtcacgcgaccccgtcgcgattgcgatggaggccggcgacccatcacccgtgcctagctagctaattagctcccgttcatttcgtagggccgctgcacaggtgatccgtcgtactgtcgtggcggagcgcgacgtgacggtgctcttatgattactgccttggccagccggggtcccaaatactatagttcctccgtttcatattatggccccgtttggaagcagatcctctgacttaactgtgactcaactgcacagcagttaagtcagaggatccctttctgctctgtttagttccccaaaaatttttcccaaaaatatcacatcgaattttttggatgtatgtatagagcattaaatatagattaaaagagaaactagttacacagttaagggggaaatcgcgagacgaatcttctgagcctaattagtccatgattagccataagtgctacagtaacccatatgtgctaatgacggattaattaggctcaaaagattcgtctcgcggtttccatgcgagttatgaaattagttttttcatttgtgtccgaaaaccccttccgacattcggtcaaacatccaatgtgacacccaaaaattttcatttcgcaaactaaacatgccctatatcatgtcctccgtttatattacaagatgctttaattttattagttaaatttgaatagattgggtcgaatttatgaaaatatattattccaatttttttatgaaaatatatagcaacttctacaacactaaattagtcacattaaatctaacattaaatatagtttaatagtatattggtatggtttgaaattttttcatataaacttagttaaacttagataaatttaatttaggaaaaaaaagttaaagcatcttataatatgaaaagaagaagtatgttagtagtacataatacatggtactcctagacgcgtaacctactagtacgattaaaagccatgacaacaaggatgaaggtaagaagtagctcgattgagatcctctacttaagtcaagtgacttaacagtcactaacatgtgggtccatagcaaagaaggcccacatgtcagtaactcagaggatctcaatccgtagcatgagtaggagcaaaatatctactaccacgtagaaagattaaaaaagtaaaaattgtaaggtagtcatttgcccccagatagtataaaattaactgaggtttaagatctctgcttaggaggggtttggatgggataaaatttttagcccctgtcacatcgaatgtttagacaataattagaagtattgaacgtagactattgataaaacacattccataaccctggactaatttgtgagataaacctattgagcctaattaattcataattaacccatgtgatgctacaataaacatgtgctaattatggattaattaggcttaaaaaatatgtcacgcgaattagctcttatttatgtaatttgttttataaatagtctatgtttaatactctaaattagtatctaaatatccgatgtggctgggactaaagttaacacccctaactatactctagatatgtctctgtatgacagctgctaagctagaatattttgaggtttcctataaggtagtacgtatttatgttatgaaaaaattaatttgtgaaagatcaaaaccccaaagtatgcaggagacttgttctgaatattattctgccctctattattgtgtcggtcgggcacaattcgagtatatttggcaacttgcacatctacagttctacactgatcattctcccgagactgttgcaaaagatactgttccatgagctccccactgcagcacaacggcaaaacccctataatattgccgctacatttatcattgtatcccaaacttcttaaaataccgaacccaaccattgcttaaaagctcgtaccgtacttttatgtttacgagctaaagttctagcgcatgaaagtcgaagtatatactttagtcgatacaaagtcttctttttttgaagatctactgtgataatgaaaaagatttctacatatccgaccaaacattccctatgtcatacgtcaagaatgattgaaccacttagacatcaccacttgcaccttatttttctttcttttttttttagaaacagactaccgtcactctaaactctaaagtactatggttgattttcctaaaaccttgaatatagaaatggcccggatattgtaccctctaaatatgaaattaaaacaggtccaaataatctagtaagatgtatgcccaataaaccatgatgagcagtgagagagtcgacggcattgtcaaaccagggccggcgttatagtggtcgaccacttctttaagatatcaacgttagtcgtcattgaaatcgaagtgacgaagctcggcgaccgtccaacctgtccgtacggtggttttgccgctaatgacgaggatggtgatatatatacatcaaattagctaagtacattttgattagtgggacggtttgaaaaagaaaaagaacatacgctagcagttggtccggagatcgtcagtaggaaacagaaatgacgaagggagtgcttcggccaacaacagtttttgccatataaacaaatagtgacattatcattcattcatatcgtagaagtgcttacggaaaataactaattagggttcatcagaaccggtttctatatttctagggaataaacactaactatattttgaggacaactttttgtatgtacacgtttttatttttcttttccggacgaatgcactgaacctaccggagtgccggtgagcccagtataggccagggcacgtttgttcgggcgatccccaaaaccggcgcgaccaaggaaagcagagcgcactcacggccgggcaggagacatattggtccttgcggcgcgacaagttgaacgggcgccggccgatcagtgcgcaccgtcaccatgcatgcattgatgcatgtacaccagcgaggcaatgagatgggtccagaaaagtcaagtggagatcgcagcgatgggtggatataggagttcttccggcccctacatgatggagaaagcagagatgaggaagaagggacatgatcagagatgaacaggaacgacaggacaatcaaccaatcgttgggactggggtctcggggtccagtccagcaacagcaaaaaagagtaattggttccattgatgcaagtaattaagcatcatgtaatgcttgtgtactgactgaaatgagatctgtttaagcctcaagagttttcaactgaattttactggaagatatcaattagtttaagaaaaaaatacactggataaccaaaaaataatttggtatcaaataatcaacaagaaagcgtgtgcctgtttggtgttaaatctcatgcaacctcatggtatcagttggtacatctatagatattagcagttcgtagggctccgtttttctctgttttttcaatattttttttgctcttctctttaggcgacacatgtttttctagtatacaggactcctcgagtgggaatcggcaaaaatgtcctccagtttatttgtaattcacgtatcgcaaacatgctgttgtgtttcttacggaaaacccttcgtgtttcagacaagtacaacgctaagatgagaaaatttcgcttttaggggtagcgctgtaaacataaaaaatacgaatttttttttttcgaaaaacagccacatagatatgcttatccaaaccctatccggtcgcctcccacctcgcccacacttcgccggggctccacatctcctctcctcccacagtcggcggtcctgcctctccccatccggcggcctcgagcttgagctcctcttcctcttctctcctccgatggctggcggcctcacctctccccccatccggcggtcctctcctcggtggagcctcgaatcggacaacgtcgaccagatcgacacgacaaggaggttgaggcagatgtggatcgaggcggccttcgtcgggccaccactgcggacgggtcgaggtggccgtcgtcgagctgctactgcacaggttgacaacgacgatgagcgacggcttgtaaatacatagtacaatatgtacatgagcaatccaggaggcgactccaccaggtctgaaccaccttcctagctcaccaccttgccaccatcggcaacgtcacccacccacttccgatgcctgccctctcctctcctctcacattctttttctttctctctctgcctaatacagatatttttcttctatgaattcaattcatattttctcgatccataaacactgacggcaagagcgagccatcacagacgacactcttgctccatgtgggcatcggttggtgcctagagagctgatttgataggatgaggttggtcggtttgttttgaacgtggactaatcaacgtgaagcagggaagcctttagaggaggttggcttgttcggtttagtaggtggttatagaggtggtattggccggacacaatgtacggttttttcctaacaaactaagcactgtatgttttttttgcataatgtatggtttgatattttttttcttaaaatgttatatcttctttaatataataaattgccacaccctttttaaaaaacctgatatgtgtccataggacctagccatgtgaagtctacatttgacaaatcaaattgatcaggtctgggccaggtgtactatgcccaaaattctgtcatcatcaaatccaaaaagcaaggaacagtctcttatcgatctgtagttctctacttaatagagttgatcacttaggttaggtatatagaatagtaaccaccactaccattatagtattacactatagtactactacatcacaaaggcattagacattaattaggagtaagagcaaatcttgtggagaacctttttgtgactgtgtcgggtaaccggcatgaactcaacctgcggcgtgcacaggacacagtgtgatcagatcagataatcagattagcagcttagcttagcttagcttgcttacgtccacactactttactctccgttggaccaaatcactaaactttgtcgtaaactcgtactacctccgtgccataataagtgtagccataagtttccgcgtccaactttgatcgtccgtcttatttgaaacttttttataattagtatttttgttgttatgagatgataaaacatgaatagtactttactcgtgacttatgtttttaatttttttaaaaaaattttcaaataagacgaacggttaaagttagatgcggaaaaccatggctgcacttattttgagatgtaggaagtaaggcataccgcacaccacgtcctgggggtcaggcagtcagcctagtgaaaaagataactgtgcaagctagcttctcgctctcgcgcctataaattgggcgctcgccgccggcctcagagtgcacacacagacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgaggtgcatatgcatgccaagcactagcatgtactaaccagcaaaaaaatgttaatatgattctagctaattcctaagtggccgcacaacttattgatatgtttcgatttttttttgttcatcgagccacctatacgtacatcgttctttctggccgaaaggatggaaacatattcttattctccatcttagtcagtcgacccaccaattcaatcttatcatctcagtaggctcgccggctagaacgcctactaattagctttgatttgtcatgcttgtcaaagtattaactttgcatgtcgaaattaacatgtgtgaatgcagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggtatacttaccctgcatgcatgcgtcatcatcaatcatcattaacaaactcaatttagtctttgttaatttatctgcatgcttctgaaagaaaagcttaagttgcaaactcgcctaaatgatcgtcagtattttaatcggaagtagtacactcacaaagcaaaggcttacaaagtatcctagctactgtagagtgtaggcctgaccaaaacctcaacaaagttacacctgacacgacgcgctctactatagaaatgcccacttctgtaaacagctactgcaaccaaaggtgacaggattatcgaccaaaaggagatgcttacttttttactgcggcttatccacagcgtcgattactcttgaacggacgtagtggcgcatctctgcaccctttcctactatgagatagtaacaagtgtaggaatacaccattttttttctgttttcccccggagaggagtatacatcatacaacgtgcagtaactatcaatcaatcagaactcacactaactggattcgcttttggcaaatggcaagtgacttgtgaatattcgcgaggcctaacagaagcccatgtgtcgcgtttgtgtaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacggcctccgcgcccacaccgacgccggtggcatcatcctgctgttccaggacgaccaggtgagcggcctccagctgctcaaggacggggagtgggtggacgtgccgcccatgcgccacgccatcgtcgccaacatcggcgaccagctggaggtgatcaccaacggcaggtacaagagcgtcatgcaccgcgtcctcacgcgccccgacggcaaccgcatgtccatcgcctccttctacaaccccggcgccgacgccgtcatcttcccggcgcccgcgctcgccgccgccgacgcggcggcggccgcctacccgaggttcgtgttcgaggactacatgaacctgtacgtgcgccacaagttcgaggccaaggagccacgcttcgaggccatgaagtccgccgccgaggtcgtccacgcggcgcccatcgccaccgcttgataaggatcagacttcactagctacggctgcgcgtgccatgatccagatatatgggatgtgtacggtagtgtacgtggtgctgtacatgccgtcccgtgtttttctgcgtaatgtttttacgtactagactactactagtgtgtgtacgtaacctggggatgtaagtatcgcgtcaagtactcaagtgtgtgtaacgggcgctctaatcgtattgttctgtgcttcaatggctaccacgttagatgggccttgtgctaatgttgttttatgctacttccgctgtcgccttagatgggccttgttgtataatgtctcgtcgacacatctgtgcttttctgggtgtgtttagttggggaaaatgaaattcttggctgtcacatcgaacgtttgatcgaatatcggaaggggtttttggacacgaatgaaaaaactaatttcagaactcacctggaaaccgcgagacgaattttttgagactaattaagccgtcattagcacatgtaggttacagtagcacttatggctaatcatgaactaattaggcttaaaagattcatctcgcgatttcccccataactgtgcaattaatttttctttttatctatactagcatgggggcccgcgcagattgtgcggctagcatcattatattttctctcatataatagcacatatgttttctcattatattattaaaatatattacaatgacaacataattttaaattttgcaataacttttcaaaactactaatgtgtaataactactctagtctcctcttctaatattccttattttttaattctgaatttcagctatttctagattgtatttttatatggactctgctttttcttgttctctgattaatgtgagaatttctaggccatgagagcgaacatggaggctcctttttattctgaattttagttggatttaaattccaatatgaactctatactctacttctaatattccttattttttaattccaaatttctattttttttcttaattgtatttctatatggactctatagtctacttctaatatttcttatttttaattctgaatttcggttattttctaattgtatttctatatggactccatactctacctctaatattccttatttttaattccgaatttcaattatttcctaattatatttttatatagactctagtctcctcttctaacattccttattttttaattccaaatttcaactatttcttaattgtatttctatatggactctagtctcctcttctaaatttcttattttttaattccaaattttactatttcttaattgtatttctatatggactctagtctcctcttctaatatttcttattttttaattccgaatttcagctatttctaaattgtatttctatatggactctagtctcctcttctagtattccttattttttaattccgaatttcagctatttctaaattgtatttctatatgtactatgccttttccttttctccgattaatgtgagaatttctaggccacgagagcgaacgtggaggctcctttttctattcctttaattatataactagctgggtggcccgcgcaattgcgcggctagcacccacaaaattatctaatttttcacatgattctacttaaaatttattaaatatctatctcgttgttttatgactttcaaagatcgaacattatcatccccgggtttataattttataatttttaaaagtcacacctgttgctacccttactcctttgtaacccctttatttgttgcgcggctagcacccatccaggattatatatttttaagcatggttttatttaaatttgttaaatagccatctagccgatcttaaaagattgaatcttattatcatcgggttagtttttaaaagtcaataagtcgtcaccccttacttttttacctctcatttatttgattgcccgacctgtcataacttttattcatcctctttgaaactttcatatttagatcttatagttttttaattcattgtcttgtcgattgacatatttatatttttagaagttacatcaaatgtcatcattgtactgttctacaatccacccgatgtctcctcttagttgtcattggaatttaaaaagtcaaatatgatattatgattatcgttgtttttttttctttttagaagtccattcaaacgtcacgactgcgctccttgatggcttgcccgctgctgtttctcttaatcgtcattgagatttttaaaattgaatctaatcgtcatttatatttttattgttttaaaatgtcccatcaaccgctacaccctatttatttatttacggctcacccgttatccctccctctttattgttatttaccattgttgtgttacgggttgttcttttaatacttttttttttgttttgaacttttgttattcataaatcgtattctttcttaaacttttgtttttatttttctaatttcataatttttaaaaaaaattaattaatcacatgttgtgttgtagatggttttttcttttcatagtcttcattattattattatttcaaaattagttacttataaaacatctgaattgctggttgtatatttggtgattaaaaaggatcgaatagataaagaggcagtcgcttcatttttactggcaacaaatatatcacagtatgttctaaatagttttgaagtgattagactgaaaaaataatacttacatgtgcacacgtatatacacggctttctgcctacctagttcctgttttgctttttttttccactggaatcaaataggtttagataacagttttagaattggatctcgattattccatcgagcaaggcgctttgtacacctgtattagcactacaactctaattcctatatttatatataggtgttatatctcaaccgttaaattatgaacgttaaattatgaatccactataatctaaacgtttaatctgactgtcagtttatagcggcttgcactaactcatctcctgtgaaaaatatacactaattacaatatgttgatatcatttgtactttcataaacatcaaagaaacttttggtgtttgatgcattgccggctgcaagtattgatctgtttgttgtaatgtctatgtaaatatcatgtctttttactatggttggctcccgctatcattgggttctgccgctccagcccaatcgttgatgcttgaaatctacagaatatataggtgcagcagtgcaagctttgtttatttggcagcacaactcttctccgtataggtttgtaattgaattagattatacgtgtattgtgtacaccgccaaagaaatagaaaaggacaaagactcctagtatgtaacgtagtacagatctatagacttatcttttctactgtaaacagttaaaatctagaattaccaaaggttttaattaatctcgtattgggttcttatatggactcctatttcagtattgcttatttttaattccgaatttcagttattttttagtttgtatttctatttggactcttcttttctttttcttcgattaatgtaggaatttttagcttccacagcgaacgtggtggcttcttttcgagctgttttaataatataatagatagatttatgcttcatgcatgtgttcaaagatcgatgtgatgtttttggaaaaaaaattgataactaaacgggccctctttcggccgagcatgttaagctccgggcctcgctaaagacgatttgtaccgcctacgcgatgctacgagacaacgaaccaaaggtacaaaacgaatccaccacgggagtacgagtcacaaaaaactgtatcctctgcatgcatatcagcgtgtggccctccagccggcggggcacggattttcacggggaaccaccgatgaaacccccgatattctcccgtctcctcctccattcggtggtccagctcaacctcgcctgccggctccgcttggcagcttccctcacatgcgcgcgcacgcgggtcgcgggggaggcagccaggcgaggcagagatcggttttgtaccgaagggaggccacgtcccgcgaaggcgaagctccatgtgatccggactcccggaggccgcagccgtggccgtgcacgacatcacgacgcccacaaccccggccggtacgtcgcgtggttggctggttgccgaaaggcctcgagacaacgtgtgccgtggtcgggtggggagccggtggcaacgcgagccttttctagttagatcagcgtcgtacgtcgcaagtgcgtgtcaacgcgacattttagattagctggtcacaaacactagtggtgatctggtgattgtcgtgagaagttgggatcaacggcctgtcaactttgtgagtgggcctgatcaggaaatactactgtaaaaagggacgttactatgtggatctttccagagcagtttggcacgaaatttctccttgtaaaggagaagtacgcagaaatcccaacgacggatttcaaaccaacctactactaactgatttttaacaaactcacggacgttcacaaaagcgtagcctgaaagcgaaacaattgcaaagcacgagacgagacgagggcacaacgctatcatgggtttgaaactctaatgccggtcgaattggcttcaaagcaaagcaccatttccggtataaatccaccagacgatggaggaggaagagtcaaaccaggcaacaaggccctcgagacaagccatagtgggtcactcacatggccaaccaatggctagtacaaatcagtctataatagtagtgatttaggttaatcatatagtaatactccatactccagcgtagttacatggactaaacaaagatatcccccaccattagccaaagctgcaaaaagaaagaggtacagctactacagtaatctgtttctacgccgcagcaaacatgcagcaggagtcaagcagcgggcacagcaccacaggtaaagaaagggaggaaaactggaaaagaaaagcaaagattccaacatctctgcctcttttccctccttcctctgtccggcgttcgattttctttcataaatcctcgcatcccgagatggctgctgccgctgctcttcttcagtctttcgctactgttgcttcggttcagaccgtcgacgggagctcacacttgcccatctctgcaaacaatggaatagacaatcacccagtaagatcacggttcaaaaagaaagaatcatacaacagggtggtattacgcgattaaaaaactggtaaatcgctgctatcatgtgaacaagagaccaattgtagtgctggtccaaaggaggagacgcgtatactggcggtaaccgagggaataacaagtggaggaatactgtaaaaaaattgatgcaggtagtaggagtacgaactgcaaaaggtacacgacacgatagtggcaatcagtcacacgttgcgagcctgcgacatccagccacggcacgcatcaccatgaatgaagggagtaaagaatacaggacgagtcatatcacgtcgagctgcgagccacgctgaccccatctcatcgcagtcataattgcacttgtgcgggtttacaacttgctgagccactcattaactaccgcagtgcaatgcagaagaagcagaacacctacagctcgaatccaatgcaacgagacctcaaaaccgcagtgaagatttgttggtcacagagacacagtagcggctgcttgcagtcgcaattttgcaagttgcaaccgccggctgcgtctttccaaggtgtgtttaacccaggcaggaagccatgggtgtgaatcgtgtggcacatgccagtgtgtggctgcgaagactacagtgaagcgagaatcattcccgtacgatgccgatgcaaagcgcctttcatttgcacccgtactgtgacccacccatctgtgaatcaccatgtacaagtagtagtagttcctacgcaaacttttaccggaacacgatggcccaatccaggttgtgtaacgtgtactagcgtgtaccaagccctacacccgttcgtataacacgtacatttcgctacgaaacgcaaggaatcatgtagaagtagtacgaatgcaatgaggtaattgtacgagcaaacgagcgcgaagactactcacttggcgcttggttgacgacgtaggcggcgccggcgaagtcgcaggtgccaatggtgcggccctttcgctggtagtagtcgttgaaggcgtaggaggcgtgggcgaccatggtgttcggctcgaagcacgccgcgccgggctggatggccttgcagtccgcgccgcccggcccgcacgcgtagtccagcgccttctgcagccgctcctccccggccatggcgttcgccacgcaccacgcctcaccggtcgacgtcgccttcacgccgccgcctgcgccggccggcgcattgccggcgtttaccccgccgttgtcctgccagccgagcccgccgttgtccttgccgctgctgccgccgccgccagcggagttgccgccgaggacgaactcgacgtcgtagaccttctgctggttcgggtagaacacgccgtagttgcgctcggaggtcggtccgggcttctggttctcgttgaagagagcgaagaggtacacgtccatgtcggcgtcggggcggcgcggcgttccggcgttgccggagaggacgcggcgcaccaggttgccgttgtaggccgcggcgttggccgccgcggcgccggtctccttggcgtcacccttggacggccacccggtctccgacaccacgacgcgcacggcattgtagttcccaagcttgctcaccgcggtgaacacggcgtcgagctgggcgtcgaggaggctgtagtacttgaggccgctcccggagtcgagcacgccggcgttggggcggaacagcgcgtagtcgagggagatgacgtcggcattgccagagtacgcgaagaacgggtacgcgttcaccatgaggtacgagccggtctgcgcgaggaagtcgagcatgggcttcatgaccgcctgggcgaggtcctcccggaacacgccggccgacggcgggtacgagccggcgagcgcggtgagcgcgatgggggacgacaccttgacgggcttgtcaaggctgagcctcgccagcgcggcgtgcacgttggtcatcgccgggacgagctgcgccgtgaggttcttggccgaggcgaacacctcgttcccgacggcgatgccctggatctgcgtggccgggtagtacgctgcgacgttgcggcgcacccaggcgagcgcgtacgacgggcgcgacgccgcggcgagcagctgctcgttgggcagcgcgaccaccaccttgatgccggtgttggccagcgcccgcagcacggtcggctcggtgtcgtacagcttcacctgcgcgatgccctgctgcttcatcagctgcaccaccgccgccgggttgggcaggtcgttcgccaccctcccatagttgatccccaccgtgcccgcctctgtaaccaaaccaacccaacaatcaaccacactactctccactaaaccacctgcattgccaaatctctcgttacctgaagcggacaggaagagcagcggcaatgcgacggcgaggatgagggcgcggaggcgcccgggtagagccattttgctgctcttgctgctgctcactgctgcgcgggcgcgagaggcagcagagcaagacggcgacgagtcgtgtagtggagagcgtggtgagtggtggagagggggggaaaagggcggggatttatggttgggggaggtgaggcgctgtaaagtgggccagccgcacgcgggcgggttggttttgggtggggaggaaatggcggggatgttgggagatgcacgtcgcgctcgcgtcgggttcgtggcgaagtgggtggtgcggccgtgcgagcgagggagagcgaccggcgcgccggatgaccgttgtctccgcctgcgcggcgggggcccaacgaacgtacggagcgcttgggctggctcggggttaagtggttagttgctggctaatcaatgtcgatgaatgagactgtacttgtagttaagcgtgacctaattgctctcatcccaacggctccaaacttgttcctttctcggacgatttaatttcctgagctgaaattgttggacgattttcctgagctgaaaatgaaccgaaatgtgggtgtggtagtttctggcatgtgggaccaaaatcattctgggctttgcaatatttatcggtgttcggtgaacatgctccacatagactgtggccctgtttagatgggactaaactttttaagtccctatcacatcggatgtttgaacactaattataaatattaaacgtagactattaataaaatccatccataatcttggactaattcacgagacgaatctattgagcctaattaatccatgattagtctatgtgatgctacagtaaacattctctaattatggattaattaaacataaaaaatttgtctcgcaaattagctttcatttattgaattagttttgtaagtaatttatatttaatactctaaattagtgtctaaatatatggactaaagttaagtccctggatccaaacaccacctgtgactacaataagttaaaaaaaacacctttttaatgaaaaaaaattctttattgactggactactggattgagtgttacaaaatgtaaacttcaacgacgtgatataccctacttttgttagcatgtaaaccgaaacaaaatggtgactgagcattaatcaaacgtgctatacgcgcgactgttttcagctacacttagaccaaataattgtcgataacaaacctgtacttttgtagccttgttcccctcaaatctctcatccaagtgactaggtggacgatgcatacacgcaagggaacgcttgtagcatgacgccgacagcgtgccccggtctctccagttttctgctttcgcaacatgcaattgcatggtcctctccttggaggacgtaacaaactctgccgacctgaattgcttggtcagtaaagtctctcggccacacaggcgatgaggcgagcaacgcatgactgcacacaaaggcagccaggtacactagctaccacaggatctttttggagcggatgaccagtgtccagtgcgagacagcactagtgtaccaactcatccgttgcatttgcacatttgcactgcagttgaacgctttagctcggtttggtactttggtgacgttggttcattaattagctgtaaccgtgtttgctgtgattagatgagctaggacagtcccaacccataacactagatatggtttttataaactccacattatcaagaaactaatactagacactactcttacaatgcaaacaccactatttcatactttaatttaatgctacttatctcacataatgtcttggatgttgtgtaggaaccatgtctcatgcaagacatgttttccttctcttttctcattttattcacttgccatattatttttttgtcctagatagcaacttatttaatgctatgaacaccattctagttattggggtggaaatgcccttattaattgattgattgatggctagatctgaaggtagccgaaatggttagaggtaaattatgcaagaaatggacaggaggacaggttagcctttttcaagcttcaccttcggttaattatgtttgaggtccggacaagaatacacatggggatcgagtggggaaaaaggcctggacgccttttaagccgctaataacaacggacagccgcgcatgctggttagagtaggtagagtcgagctagcgtgctcatgctcgagacgaagacatactgcaactactactactcgatggatggaagcagcatgtcctcgctaggtccaaactacagtgtttgccccagctcacattgcagcagaagacgagaagaccagtaataacagtagtcagtagatgtgctgcggcacagctattgttgagctcgacacgattaggaaaattcctcagggcgtgtactcacggtcttctccgtgatcgtcgtagatcggtcagtacatctgtcacgcatggtgtcgtcgattcgtcgttcttgctcgctcagctgttccacacttcacatgtagcgttctcccctagattagccagccagtttctggcaaacaaccaattcgatcgtgcaggcacagttgcagatgaagtggacgtggtgatgaacagaggagagcagatcgagcgagcgagcgatcaagtggtaaacggatagaaatccagcaggaaaacgcatcagggcccgcgcggcgagaaatgatgggggaagactggtggtaaaggggacgtacatcccagctgtgcaacggggggaaaagcggcctctgctgcgtccggcttgtcctccaccggggcgcgccatgtgcgccgtaacgcccgttgctccccggccgcggcgcgcggcgtccaccgctcgtctccacccgtctcactgcctcactctctcgtcggtggccacagtagtaaacacacaggcttgactcactggctgccaaagtgccaatgctcccgaatgtggcccaacagacagaggattaattaattatttgccactcttacggatggtgataaataatctgcccctagacccatatgtgatagacgcataagggcccacatgtcatagagacataaggacccatatatcatagacagcaagtgacaaataattaattgccacatcttaaacgtggcccaatgctaaatgtcctagagacataggcctggtttagttatcaaccttttctttaaactctttatttttccctcatatcaaaactttcctacacacataaactttcaactttttcatcacattgtttcaatttcaatcaaactttcaattttaacgtcaactgaacacacccagaaagacacaggatttttctgcttccgatacctgacataagagatcgtgccatcgcgataatgcaaaggagaggagaggcagtagtaggcctttggatctgcactagtaccattttcaggttagtttttttattttttgtcaagaattttcaggttagttgtgttcatgttccctactagcagcttcgttctcgcttcgaccatgtggcaagggtggcactgcaatcttctctcctataatagcagtagtagattccagaccggcagaagcttgcattcaaagcaggctgattaatctggttcagatagagaattatcgctcctgcgcatgcatgggatcctgcatcattgcacgaaggtttttatcattagcattaatatttttctctctgcctcttgagaaccactgagtggccattgctgcagacgagagtagcatggtgatctgatgaactcccacgctatgatcagtgtcagccatgtggatcttggagcatcatgcatccgagtcccagaggcatttctgtcggtgtggctggggaattcactcatcgcacgaaagattaggccgggaagggcagaatgatgaacatgcttggctaccctacgtcactggacgtcatccctggaccaccatgaaccggttcatgattggggcttggatttgtactgcacctgcagctcgggcagcagtagacagtagtgcggcgacaacagccaaaggccaagactgggaaaccacagagtgcgctcatgtgaaccaaacgtttattttcacactgattgcagtgagccagtgagctatagctcactcatggaccattcatatcacatactccctccgccctaaaaaaaaaagacaaaccctggttttcatgctcaacatttgaccgtccatcttatttaaaaaaattatgaaaaaaattaaaaagataagttacgcataaaatattaatcatgttttatcatctaacaacaataaaaatacgaactataaaaaatttcatataagacgaacagttaaatttagacacggaaacccagtgtttgtctttttttagacggagggagtaatctctgagctgcctactttagatcacggcgcttcaaaagagtcaatagattcagacggaagaggacatcaaatacatccgatatgatactattgatactgctgctgattcagtgcccaccttcagagttcagaacaatttcacggccacaaatggcagtaacgtttatttcacgttaaaactgaaagtttggttaaaattagaatgatgtaatggaaaagttagaagtttgtgtatatagaaaagttttaatgtaatggaaaagttggaatttagaagaaaaaatttggaactaaactcggccttagtattatccgtctcaggccaagtttagttccaaactatttcttcaaacttctaacttttccatcacatcaaaactttcctacatacataaacttttaacttttacgtcacatcgtttcaatttcaactaaatttctaattttggagtaaactaaacacacccccagtggtgacactggttctgcaatttgttttccttatcttctttttttgctccatttcaccgttcggctaggatggggaatcaagcctggatcttgcactattgcacacatggaccggttcaccaaccccacgtgccgttggtgacgcggcagggtgaattgcatgctactagtatgctacaccacctccatgtgcagcagcaggaaatgacaacggcgaagaatagatgagatctgatgaaagagaggtgaatataaaaaggtgaccctggctgaagaattcggttttaaaacgtcttgctacatcagattattctctcccttccaactgatgaggattgatctaagtttggaatgataaaactggaggacccaacaaacacatatgaggacccaccaaacgtatatatgctgaatttactgtgtagaggcccattagtattgactttcgattcctttgtgatgctggatgggaaaccgattatcaacgatgtttttaaaatgtgaaactgagtaccacacacagttaagacaaaagattggacaaccgtgttatggaaattgatgcttagctatttagctaatactcggatgtaattacaaaattgttgttcagaggaacatttcgggaggatatgcacaaacctactaggctgctatacaagccattagaatgaacaaacaacagattctgcgtatgtacaattgcggcgttttgtttcactacttgcccgctggtacagataggatacatgattaaagctatgtgatgaaacattcggtataaacctgtacatgactcttccaattccaagcaagttgttttgaaggtctgtccagtcgaccgggtatgcttctgtgttagtaaatgtttcctgttcacacttttttcagctcacgactggctatctctatttatcccgcgcataggctccctgaatgaggttgttacctggcaagtcaagttgccaggcccactgttatctcgtgtgagttttcctttgctacagaagtacatacaccagacatgtttatgtaaggagttgaaactataatatagacaagttagttgaaactataatatagaaaagttagttttgaactgttacttcatgttggactctctgtagaatatatgtggaatgcaaaagatgatataagcatgattttgataatccaagttacagcagttcgtgcagtgaaaagaaaagcagccatattcacagttatcaccacttgtgggttaaaatgcaatcatagtttcatacttgattctgtagacatttcgtagttcaacatagcttaacatctaggaaaaacaaccaagattgtaaagactactttgcacttttttagtgggaaaagcataggcacaaacagcaatgaagcataactcagattgtcataacagactgttatatgaactagtgatttcaattccaagggtcatttttacccctaaacttcatgaaaaaaaatcatgatagactgtaacttttttaaaaaagtaaggacttacaggatgattttgactagaatacctccgtgtgccttcacaagaggtggtatgctgtgcaccagttaaaacacgagataggcgtcggagaaatacttgaatgtggttgtaaatgctgcagcatgaa

SEQ ID NO: 64690 - DNA, 26587 bp, Oryza sativa
  unsure (1)..(26587): unsure at all n locations
aaagggtacaggactgaatttgctgaaagtaatacaaaagagaaagatatcagaatcaacacaaaaagtttatcatagtgaggtcaatacaaattgaagagcagagtagcagccatatcgtctcagaagttgcagaaaccataccaacattaggcacaccactgaagaccagccaaaaaggccatataatcatctgcattgtactgataactacactgcatgaagtctccatcgccaacatgataactgagctcagatgtccactgtttcagcacaaaggttccatagcggcagggtaaattcaagaacctccaaaattggtcccatgattggctttgtcaaaacacttagagcagatttagtagcagttacaatcttaagagaccatgtaaaagcctgctggaagttatgtagaaaaagcatggttccaagatacttcagtcgtgaaatcatttcccacgtctctatccagtcaaagaaagggccaaacaatcttgatgcagttgccttcaacatggggacattcttgtagaggtcataaaatcctatgagaacagtaactattgacatcaagacatacaatgccctggcaagaggacacatccatgggcgatatgtcttgcagaacactggatatgactggagaaaaatgacccatgaaggaaggccatactctagcaatgttaacagcctcacatcagaaagtattacttcttttagtctgaaagggagatcgtggtcatcgaaccggaataagatcaacacatccttatatgtgctaggctcgagcagagtcttgccacaatcatcatcactgcagcacgaggaagatggagatgatgaatgtgttggtgaggtcacaacttcagaatatgattcttcagacataatattcccagcatcagatcctattatctttcttctcttgtaaggtccagagcaaggaggtggtgtgtatgaggagcttgtaaaacttgacgactctctcatgcattgactaggtccagaatcgtcatcatcactctgtacattctcactgtccccttcaggtgttgagaaataattctgagcgtcataaaacacatttcctgtacagcaagcatataagtggtctgcacatgcagcagagaagaatggagagcacattcatgcctttacctttaggagagatgctgttcaaataatcctgtaggagctggcattcagagtaatttccagaaaaccatgaagtgattaatgatgaagcttggttgacactctcaaattcccatctcttcattgttttagcttccactgccatagaagtatcagtctacaacaacataaaaacaaaataagcatgtaccatccattaatagctatgaatatcatgttcagtctaaaacaatacctgaagttcattgaaatagttcatgccgcgcacatcagcccagtctacctcaaaaattataaagccatataaggttcggtgcagttccttgttcagcaggcgagaatccttcagcctattcacatgaagctttttattccgcatggcatcatcaattaaggtataccatctggatgatggattccacaaatgagaaccatgtctaggatctttagagaatacaagtttcttcccagtttcatctccctttctcctagttctagtgtttgcaaaaggtgaaagtcttgactggagcaaaaaatgacaagaagtcaacaagtaagacgagccagaatcgatgtaacaagggcaatacatgaaagtgtaagcaatgaacaaatattcataagtactcgtttgtgtgcttacaagtggctcgtaaaacagtaaagcatacctttgtgaccatcaattgccacaggtgagcaggttttgtgtcctggtcttgcagccatggccggttatcaagcaatatgagaaacttcttcgtatgagggcacaaaaatatagtaagttcagcaagatatgattgtaaatccctgcatataataattatatcagactaactaactgtaatatagatgaaaatccaaatttacattgcactttaagatcatgaggttagtaaatgcaagcaaaactgtgaggagtaaaacaaaacttgcagtttgcaagaattcttaacacaattgcccacctcagaaattaagataattgcaatacaacttaaggtcatacgactttgcacaacaaatgcagtccaatggatgtacagaaaaaggataaaataaccgccacattgttcactgtttgatatcatatgatccaggtggacaatagcagatcaaaataaaattaatcaggaacacagtatttaacattttctttcctccagtgtacggacggagtcatgtattgcagcctactgaacctagaagtaaagtaaagccacaattccagatttccagtcgataaggtatgatgaatgtgcacaaaacacaaaattatcaacctacgataggcaactaaacctaggaataaaacctagattgttttgcaaacaacaacgtgatggtatagtaagtttgttttatcatctctgcatgaatatgtagggagaaatgacaaaccctgaattattgaaccgttccagtatagtatcgatcctgtgcctttacactggaaacatctactaccttaaattggaaagatttccaagaacagctttcctttctactcctactaactttagtcatatctctcatcaagatatacagtattctgtaacaaaataaatgctactagaatgaagcaatacaagacaattcagctacccactcccacaagtgagctttcctgtctttttctcataaacagtatgctggaacttcctccaccaagtaacacaaacgaataaacgactgttgtagttttgatcaatttccactgccctttgggaaacaagcgtaactaacttcaaccgtgttcatcgaagttatccagttaactttctcgtaacttctcgtttttttcacttatatcacaacgggactacattgcattgtggaccacacaaattagcacccaaattatacgagactggaacattccaccaaaagcaatgaaaagaacgtttccaccgcgagatcaaaacagagcccccgcacacagaaggagacttacccgatttgcaagctcgtaagggggaagaaatgccgcttcccgccgctctccatcacgccgactccaccacctccctgaaccacatacgcgaaaacacgcaaaaaattccacatcaaacgggagatcagaggccaccacaaaatccaggcaaaggcgcaagcaaaaatttgcagaggtatctcgtcgaatacctgcgcagaggtcagaggcatcccatggtgatgcctatccgcatgccaaggtggccagagttaatggccacccccggtggggtaaatacgccgcctacctccccctctccaccaccacgcggcgctcaatcaccaatggctcctcctcaaataccaccaccacgagcctccccccccccccaccctgcctcgcgctgctccggcgagaggcgcggctagctctccgccgctccgccgccggtgacgcggcgtggtggtggaggcggcgaccggatcgcggcggggccccgcgccacaagccaaccaaccatccgaacggccggtacgggggctttgcttccgaggtgagatgagacggttcggatatttatatcccgatgacatgtggagcccgagcacgagcagggcccacctgtcagcgtgcccggatttgttctccggaggcgggtgcggtcggcgtgggggtgacgttgatggcgcggactttcacgaaacccggggggtggctgacaggtgggcccggagattgtgtgctcccacaagccagcgtgccgcgtcatccgcttcgggcatttctggtttccccgcgtcgaagcaaaggggagacaaatactacgtgccggcctacccgacgccactggtatgcaagtgacgtgtggggcccactaagattggacccatatgtcggtgagatctgcagcatccgacgtggagtaaggcgagtgacccatatacgtaattatcgaaatccagagtggggcactcaggggatcaactgcggctgttcggtcacgcggcgatggtgtgcgaccgatgatatggtgacacgtggaccgtgctgcaatgatggcgtttactgcagcgatgacgtgtggtgtttcgtgttcggacaggtgcacggagggctctaggttctaggcgccacatgcaaaggaggaacggcgtccgcgtgacgcctcgagcaccgtgtaacgggtttattgcatgtgaaattattggcctgtacgcccagattgatcatagataaatcaatgatcgtggcctcctggagaaaacaagctggagctactccgttcagacaagatccaaggaactaaccgtggaaacatgaacggtctaattaaaagtactcccttattctagcatttctctcatattgatgttaataaatttaaacatatatatctatctaaattaattaacattattatgaatgtgaaaaatgttagaatcacttacattgtgaaacggatgaagtagtttagagcaagtttaatagtatagttcactattaactccaattcatctataatcaatctaatagccaattcatataatagttgctttctatactattaatatatggtcccacatgtcatatatacattgtgtcttggagtccgtgctgtagctggctacacatctgtagcccgctgctcttctctctcatcgtttatctcattaaaatatgtttatagctggctaatatccagctattgtacctgctcttatgggaaaaatataattttgtatgaaccaaatctaaaaaacagaccatgataaaaagaaaaggatttgatttatctcctcgattatcataaaagtattatctatccccttaaactagagtatcggaaatttgacaatccccgagctattaaatcaacacgaaccaaaaccgtaccccttcccatgcgtaaaaaaaagtggtagttttaatattacgttgcaaacatatgacatcgatttcattacatggcaacctaatcacgcattttattagttttcttaccctcttatctatctttcttactcgctcgatcaaatatagggccgtcgctgtctacgacctccttccctgttgtcctctttctgtttcctgccaccaccttggtctttccacttacttttttcgatcaatgaaagaaaggtaattcgagcgacgagagggccaaaagggagaaagggaaaacctcctaatgttgtttgaaggaggggagcaacaaagaacaacacgaccttgtggaggaccacgttccgagctggctaggagggaatgaaggggaagcccatctaccatttatggggatgggagtgacagaggatgcatagtggcgcaaattagtggaggacggtggcggacatgcttgtctaggaggggatgaaagggaagttcgttggtgctattttaaaggaggggagggcgagtgagaggatgactcgtaagctcatgaaggatggtggcgggcaagctcatatgggaggacaccgacagctcaagctcaaggagatcaaatcgtgtccgctcacctatgcatcaagtatgtcaaccttctcattcaccgaatcaagtgcttcaatgccaacctcaccatcccatccataagacacatcccctccatcattgtacggggacccaatgaggtgaaacttgagcgggtggtatagatctagagggcaaaacattgaaccgtcctcacaccacaacttcacatgctattatcaaggtccctccatggcttcacgctaccaaggagggaggctggagcgttgagaactagggcattgcctaggaaagtaggttggggcgtcgagaactaggacatcaccaaggaggggttggtgcgtcatggaagaaaaagaataacgagataggctggtaggtaggcataatgagctgatatttttgttgccatgattcatccagatttaatagttcggggtttaaaatatttaagagggtaaatcatacttgtaggggtaaacaaaaaggccctaaaatcaccaatgaaatcaagctttaacattctatgaaatttggcaataattgatatattaatgcttataattcatcaacccattaatacattgacttgtctggttgtagtatgtaaattgaactacatatttcatattttcgttccgtattggaccttagggtggtcatgatcgatctaccaacgttgccgtgataaaattatctatcaaccaattaatgtattgggtctttttgtcaactcaccatattgtagttcatataataacaactatatatataaattgctcaccgggtgtattgacgtgttgtgcaccagatagctgactagctgtgcgcctgcttccgttgtttgttcgaaaggcatatccggcgtgccgcttgcgacagcatcttccatctccacatcggcaacgaccagacgatgggtttgctttggaatcgccatcgcgttgcagcatgcaggccacatgggccaaggctcgaagcccaatcacatcttttcgttctttactttccgagaaggcccaaaataattttagcccgttgcggtctttactctttacgcatctgttctcgtgcgatcgtgcccaatccctcgatcctgtccacccagaatatgtctatttgacttctctaagctcttgctcgtgattaaatagcctccctcaacctaaaactgcatataacatctccctcatttttaaaactagtgtaaatcgacttattcaatggtttggaaaacgatttctgccgatgtggctggttgaccccagggctctgcagttgcgtcgccaccaacggggcgtgtaacatcgattacttatggtctccttggcgggatatgtgctgccgacctcaggagatagatggaaaggagaggagagaggaaaataaagagaggagagtggctgataggtgggtttaaccagctgattcagcgagtcaactataattaacatatcacgtctacaggaaccacttcctaaatcatcgaaagagtttgatttgtatcggtttttcaagatggggaagacattatattcagttttgctgttgagaggcgattcaatcaagaagagagataaagagagtcataatagacttattcctcccccgttttgcgcaccgacttcggcccggcccaacccagccagcacctctgccctcctcgagcctacggctacgaggcggttgctcgccgccccaataaataccccccgcctccccttccgagttccgagcaatcgatcgaaacgcttccccctcattctcgcacagcatcacacacgcggagtccgcgcagggagaccacgcgcgactaggcgctcgactctcggcggttgctccgcggcatcgcgcacccacgccgccacgactcgcgagagtagggtgcggaaccctagcctccgcaatgtcgcgcggcagccgcgaggaggaggatgaagaggaggtgtacgactcggaggaagaggaggaggaggagggggaggtggaggagaggggcggaaagcggtcacgcgggggcggcggcggcgggaagtggtccggcgtagagagcttcatcgacgacgcggccagtgaggatgaggatgaggaggaggaggaggatgacgacgaggactacgtgggtggcggcggcggccgtgcccgcaagaggaagagggcgtccatcctgatcgacgatatggctcaggtcgacgatgaagaggaggaggaggaggatggcgagttcgaggacggtgagtgcttcctggtggtctcactggtgtttgaactgtgaatccgtgatagaatcgttagattgatttcccaaatccgaaattacgaagcacagcgaaatcagcaatttcgtttcggtttctgctagctgagtcattggacgtagaatttgtgtttgttaattaagcgctaagttgagcgaaccaacaatttcaatgctagttccttcccggttaccctggataatcaactctgttcgaaatggtccaggtgtagattcattaaatttggtggtcaatttcgtattgattccatgttgttgcagttctatggttgtttgtggtggtttagtctcatctaatggcaataagaatcgagatttctgtttagcgatatgtgaaaacttcagttggaggcaaaagtttatattcattccgggatttttgtcataaattgggcagatttgctaggacaaaagtagttccgtcaaactaactcgacaccaattaggccttcaccaaccaagaagttaactgggcgagtgggcgtagttcattcaatcatctctatttaaagccacgttgccttgaatggcaggactctgcgacatgccaatatgatggactgaatttgctgctactacctattatcaatgttcaaagttgtctgaatacgctgatggcctgatggctgttctatgttattgtgatagatctgttaaaaaatcttcgtttcaaatgtgaaacctaattggaagatgctcctactctttgtttcgaatgcggcacagggaagatgctccaattaattcataaactaactaagctgtttacttgtgctgactactaacatgtgttaccttccttttggtattatcagattcacattgtcaaaatatatcttgtgttgaattatataatatccaaaagcaagttcaagtgttttaatgctgtcagctatggtccttcatgttttggtaggctttattgatgatactcgagctgacgaccctgaccaagatgtgggaagaagctctagacggcatccatcttctatgctggatgaagaggaggacgtggatgcacttgtgaagctaatacacgacaggtatataattccgtcatcacattttgtggatgatgacgatggtgtgactgaggttgaacagcaagctcttctgccatcggtgaaggatccaaagctttggatggtgaaatgtgcggtatgttgcaggttctatcgaataatgttctgctccacaattgttttctgtataatttgatgctcactgatatccaattatgattttcagattgggcatgacgggagacagccatttgtttgatgcagaagtccattgatacgccagatctccagattaaatctgttcttgcattagatcacctgaagaattacatttatgtggaagcatataaagaagcccatgtcaaagaggtacggtgcttgacctgacattgtaatattcctgctatgtgatgggaactaaaatttattacaggcttgcaaaggtgtgcgcaatatcttcgcttcaagaaaagtaactctggtgcctataagagaggtggctgatgtactctctgttcagagcaagtctactgatatttcaattaacacatgggtccgaatgaagcttggtgcatataaaggggatcttgccaaggtatggccatcaccacggcagtacagtttcttcatgctaacattttctgctactatttgattttatgacctccatcaggttgttgacgttgatgatgtgcatcaaaaggttactgtgaaactcattccaagaatagatttacaagccttggcaaacaaatttgtaagttgttacttggtataaattgccacgttttatgttcacctttcagcctaacatgccctgttatatttgtggtgatgcatctgctgttaatacattacctttttaggttgttgctgccatcatttggtatgatgttaggatttcctatctgatgtgattcactgaatgccagatgtattaatttatagtggaacaagtgaccatttgagtaaattgaaaattaaaaatctgtacgtagtccgtggtcatctgcatgctattatcctttgccagtgccgatgggctagcatgatcagtatttcccattttcaggatggacttaaggttgtgaaggagaagaaatcatttgttccaccaccaaagttatttagcgccaatgaggcaaggtgctttttcctccgtttgtaatcagtatgtattcatatatatttgtattgctgcaatctgctaactcgattgtaaataaggagatgaacattcgtgttgaccggaggaggaatagagactctggggaatactatgaaatggttgatggtttaaaattcaaagatggtttcttgcacaaaacgttttcaataaagtcaataagcgcacacaatattcagccatcatttgatgaactggagaaattcagggaacctgataatgacataaatgaggatgcggccagcttgtccaccctatttacaaataggaaaaaagggcacttcatgaaaggtgattctgttattgttattaaaggtgatcttaagaacttagagggctatgttgagaaaagcagagatgccactgttcatatncgatcaaaatacctggtcttctggtaattacttgcaaaaggaattttcatgtcattttcaatgtagccattacgaatttatacatctctttgtgtacctgcagaacacacttgtcttcaatgagggggatctctgcaaatgtttcaatcctggagaccatgtaaaagtggtgtctggtgttcaagaaggtgcaacgggcttggtagttaaagttgaaggccatgttttgatcattttgtcggacacaactaaagagcatgtgagggaattttcgtggacataagtataagaaactatttggataaacttccattatgcttttgactttctgatgtgtttatatgattacagatccgtgtgttcgctgatcatgttgtggagagttctgaggtaaccactgggcttaccagaattggtgattatgaattgcatgatcttgtacttcttgggtaagctcagaatttctaatgagccattgttgttgcttacaacattgaacggctatgtaataacaatgttcctcccattcaattttcagaaacttatcttttggtgttattataaaggtggaaaaagaagcacttcaggcaagaaaatttgtatagaacatttcacgtatgcctaatgatcttttgttcccatattttttgtgtactaacccccaaaatgcatttagattctcaagggagagcctgacaaacctgaactagttcttgtgaaactcagagaaataaaaagcaagatttatcggcgaacatctgcaaaagatcggtccagtaatatcgtgtcaacaaaggatgtcgttagggtcattgaaggagcttgtaaagtgtgtacagtttattttatttgtttttagcttttcatattatattctgttttagttttttttctgtcagaatatatgtttattacattatcccattatactatatgtctaatacactttgtcacaacagggaaagcaagggtctgtggaacatatacacagaggagtactttttatttatgatcgtcaccaccttgaacattcaggctttatctgtgcaagcgcacaatcatgcctccttgttgggggatcaactggtagccgccgcggaaatgtatgtttgaagctatttacctctgttggttgtcttggaagattttcctaaccattttgcttctctgatacagggtatgggtacagttgatccacgatttggtgcttttagatcttcagcaaggattttgcaatctccaggaaggctcccccctaaagcacctcatactaattgtatgaatattatctgcacagctccttgttttttttttatttaggctgcattgctctgctaaatgcaatagcaataccaattcataattgtccttcctatctaatgcagatggcagacggtttggaggcagagatcatggtggcaaagggcatgataccctggtgaatagatgtatcaagattaaatctggcccctacaaaggatatcgtggtcgtgttaaagaaatgacgggagcacttgtacgcgtggagcttgattcacttatgaaggttgttgcaggtgaatctttgttgtcatttgttctatttttggtgggaactttgcgcgcatttgtattaagaagggaagcaaaaaccaataaaaggagatcaacgagtacacctcttcatgcagcaatcgctgcggacacactacaactttcattcctgagctgcattccttccaaatccccactatttcttctgatttttaaaactatcttgcttcaaatatgtagttaagagagaagatattgctgacacagctactgttgcaactccattcgggtaaatttcttcctccttgtccgtatatttggaaagctgtttgatttcatttaatgactacttgtatcgacagtgaatctcataattcatggggcaacgaaacacctgtgcacccatctagaacgccactgcgtccttttcagactccattgcgggaccctggaggtgtgtccatcttacatgcattatggttattataaaaattaagacagctaagatcacttatttgttccttccgtttacaaatatgtagttttggacataaccgaagcaactttgactgctaaatatcagaatatgtttactaagaagtaacaaaaatgttgtattatgatcccaatgtagctattttgggtcctaagagactgggaggtttatctataatgtcataaatgtaaagtggagagaagtactaattccatggcactactttgtagttttgttttctttatgtcatctactcaatatgtaaaaaattaatgcggatagactttgctacttagtacttgagtactcagatggtgatggaagatttatatggaggctagtgcatctgtactgtttagcagcataatcaatggctatcatttctctactgtttaatcaacttaaactatatgagtagtcacctctttgtatcttgattggtgttgttttttggagggagcctttcctctcctgaatgcttatcaggaagcacttcgaaatgggtgtgatagatgtaattcagatgaacgatgtaaaatttgactggcgttgtgtcgttggccaaacgaaaatattatgcagttcatgctataaatggtatttactttctctctctctcttgcacacacacatattaacaaggtgttcgtcttttacagcaacaccagttcctaatggaatgcgaactcctatgcctagtcgagcatgggcaccaatgagtccaccaaggtttgtatgctgacattatgtgcaatttagttttataatgaaaatgaattatgttgtgcaagcgagctaattctagtataagtttattttatatagatttgttgttgactaattcaattattacaggaatggctgggaagatgctgtcacttgggaaagcagcccaacttaccaagttcgtcatgcacttatgctatttcttgactgctctttattttctgtagattagctttgggttggcaatcaatggtaagtttttgagcctctacatttcacttttgcagccaggaactccagttccccagccacacgaagcccccacccctgggtcaggatgggctgttacacctggagttagtttcggtgatgcctccggaaaaaatccaagctcatatgcaactccaacacctagtgggcaaccaatgaccccaaatcctgcatcatatctcccgagcacacctggtggtcagcccatgactctgggttatattgaaatggatataatgtctcctgccataggtaatatttttatccttcgaattcgttgcttctccagcaaaatgcattctacagtcaatctggatggtgatcgaaactatctagagctctggatgcacttatttgggtactaattcccaaactgctttcaggtgaggagggcggtaggaactggcttttaccagatgttttggtcaatgtgctcagggaaggttatgataccacctgcggtgtggttaaggaagtcctcccggtgcgtactatttttacatctacaagatgacccccctaattcttctttcactttcctacactgacacatccttgaatttaaactctaggatggatcttgccgcgtcgcacttgggtcgtcaggcagcggggatgaaataactgcttttccaaacgagtttgaggttgtcaagcctaagaagaacgacaagctaaagataatgtctgggtcttggcgtggactcacggggaaattgctgggagtcgacggatctgatggcattgtgaaggtggatggtctagagacgacggatcagacgaaaattctagacacggcgattttgggcaagctagcagcctgaggcaggccgatcctacaagccagacaaattcttgttcatatcttagtgtagcgagtagtcagaggtgtacatgtattttaaggtgtcctatttgtccctggatattcataccaggatacgctctcgtctcaaatgacaaatgatactgaacaagttgcgaatgccagctgcatcgttgacaattgatgttgtctgcccttggccatcaggtcgtcgatacatagattgctgtaccagtcattactctagaaagaaacggaagaactttttgcaaagagatttcacataaattgagaagatgacatcaagactcaatagcgaccaaacaaaagtacaataggctgtattttataatactaagtatccaagtcattaccgagagatgcaacactaatttatgctttcagaaaatctactacacggtgtcctgtcacaacgggataaactggataagatctctgccttatctccttcccttcccctccacaaactcactcactctctctctctggataaggccgagaaggctgagaagaagccagccagaaggaagggatcgtcgtcgtcgtcttcggcggccgaggaggacgacgacggcacggcgtcggtgaggtcagggggcgtcgggggtgatctcgccgcacttcctcgacgccgtcctccgcccgctgcggcgccgcctccgcgcgcacgctccccgtcactgccggcgccggggctgctgccctcctccctcgcgctcctcgccaaggtctccatcgcctgcttctcatgagccacttgtgccgccgtccttgcccgctgctcctgccgcctccttgccggtgagcgcaggtggatcctccgctgccactgtagaagcagaagaagccggcggtcccggtgcctcggctgccgcaacgccggcgacaacctgctctagaacctctacctcctcttctttgccatcaacttgaagatgaagttgctgcagcgcgtgttcttggagatggtcaccgttgacttccggccggacctcaccaccttcagcgtctgcgccacagccttctccatcaggcatcagtcgtcgtgatacctcagtattaggcctggtatccacaagtatcaggcctggtacaagattacttagtgtcaagcgctcttcgtcgatgtcgacgctatcctcctctcatcagtgttatgtgcaggtacggactgatacctaggtatcaagcttggtaccaagtactaggggtatggtacctcaagggtatcatgcctggtacctaagtaccatccagtatccatgggtaccatgtgcatggtattaggtaccagatacctataattatcaggtaccacatggtacctgatacctattgtacctgatacctcgagggtatcatgcatggtacctaggtaccatccatgggtatctgttaacagtgaaatttggtaagcccagagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacctggggtctatgtaatctatcttcacgatcaatacaattcggcgcatcgccaccctttttacttctacttttgttttacgttccggcggaacttggcacccggcgcggggctacatcgtcttcgatctccggcgaagggataagtctaatgttccgccggtccaggcaattgtatcgtctacgtcggcgtcgttcaaggctgcatcagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctaccaccctgaaaactcggtcaacagcttgattgtctagatattatgtttcttttcatacttagtgttacatcagttaagtttgatctactaagtcgtgcttagaaccataatctctagcctgcttttgattgccactaagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagttgatgtgtgctttaaccttcggatcgatgcttatttatcatatcattatctgccgattggtttatactggactatattattgttatattttattatcaacagccgattgcctttatatcatcatctacattggacatatagccgattgcttacaccctatcgctatcggctagtatcggcatcggctattatcggctatcggctggaactattccatcggcttgtcagccgattgactgttttgatctattatttgcatatcttgtcagttgcaggatcaaactgactggcacgctcgcatctaatcaagatttggacctgcacaggagctaagcaaatctctcagccgatgtgttcgattttctcgtcaacagtaccatatgcatggtatcaggtaccagatgcctagtacctaggtaccatccatgggtaccatgtgcatggtatcaggtactagatacctatagttatcaagtaccacctggcacctgatacctattgtacctggtaccacggtcaaaggtgggggaagggggagcacgccgtcgccgcctggctgaccggtggccacacgttcgttgcctcctcttctgttctcccttcctcagttcctctcctcaacgtttctcttctccttctgttgttgttgctgtcggtgggggcaaagaggaggatttagcgggggagttgtctgctgctcccgctgcttaggggcgacgacgccgacgaggaggtgtgtgcttctccaggtgcaaaggcaacacgacgccggcaagggaagcgcgcgatatcaggaagagccagctaggtatcgtgcctcttcacgtggacaacagggacacgggacgccatttttttattttgtcgtgtgttttaattatcccgtgacatcacttttccacggtatcttgtgggctagctgccctcttatgctttactccttccgtttcaaattctaggtggagtagtagtacttagtccaaagaaacgaacagaactgtttgaccactgggcacttctcagctcgacgtgatgggactagttcatcaaggactcgaactcgttatatccacagttaaatccgcgggacttgcacggaattgactgtgccttcgggtcaataatcttgatcgcctacagtgtaatccgacaatatctatcctatactattgttcaggttggaaaagcagcagcagccgctagcttggtgtgtcaaggcggctgtcaacaggcaagctcgagcgagctcgcctgtctaggcttgagctcgatacaagctcgagccgagtctataaaatgttcgacctttcaaacaagctcgatttaagcttgagcttgatttttaattagaacaatatatattttaaaggataatctttttaaaaataattaatttatgatctatcgtagaagaggaaaaagaataaaataaatatatgatgccaatacaaggtatataaataacatatttgatctacaaatttattaaataacaataaaaaaaatctagaagctcaagctcggctcgacaaagctcgcgaactttaaaataggctttagctcggttcgttaggagctcgagccgagctcgaatcgaacttaggacgagtcaagctcgagcagctcatgagccttgagcttttttttttttttttttacagtcctacgtcaatcccgtgccatgattcccatgaacagcgccaggtacccgacgagccaaatcacaagcgccaggaacaggcgcggcaatgacgacaccggctcggcgtacacgccaatgatggccgtcgctccaagcagcatgaactggaacgcgtagacccgctgcatcggcggcctgcggcgggcgcgttccgtccttggtcctggcgcctccttggcgacaccgccggcgtcgttcggagccatgggattaggacggatcaatgcaccacgagtccacgacggccgacgccgccgtgggatgtgtgagtaatctgagtgagcgccgcgagacgaggtgttttctttccgaatatggcttctgttctgggcacgaactctgattaccttatttatagctgtcggccggtatggcagttcgggtgtgtgtgcccgtacatttcgtgcgatggatattggctgctgtttgtctgcatcctagcccttgggcacctgcacctgcagcttcggcgcagcttccttcgcgggatcacggcgtccgcccgttgctttcacgagcgaacaggtgacagtgacctgacctggctggcttcaatccgaggtgtctccacgtctgtacatgcacacatggcgcatgagcattcgtcacctgctcatgatttctcgcggcaaaaaacatgggggtggcttcagtcaagatgcagggtcattagaacaggtcgtgaccggctaatcattctgaaacttgttaccattagtcggtggcgccgaaatttccctgtaatctcgttcatttctcgttcgctggtttcggcctaacaagacaaaccagcggttggtggagcccaagggtttgggaattctgctgtacgtcactcgagaacaaatattcattgccgacccatttaaacgactcaaatttgagtattcttacagattagacagaaacaaataaagatagtgttattttttatctgcctgttcctattctagaactttgacccttgtatgaatagccgtactttatttagttttatcataagaaaacaaaatgctaccagcccatcaattaaaatatatgtttggcttctttggagcgaaggaaaagtggaggaattttggaggactaaaattcaacagaaaaatttcccacatggtcctttggagaattggagtaaatgaatggcttctccgaaatcatttgattatttcatatgaattttggagaaaaactctttgaattatagaaatgaaaaaaatggaggaataggaaaaatacttgattcagataataatacaagtataaaacatagaattgcaaaacatagaatgatcatttgattggaccatatagatttgagaaaagataaagatacaaatgaaactttccatgagattctactcatgttaattttcgtccaaaacttgcatggaatgagacattcttcatataattctatagaaatgaaatccttcaaaattgatatgattttcctttgaattaagggggcctaagtccacttgcttttctataatgttaccagacaacacttttttgcaaaaacctcgtggatttagtccctttgagttcctctgaatttaggattatggcacggcatcctaatcctgagattttcatgcatctcagggtttacattaccggttgaccactaaatttcgagccccatcggtatcacggttttcgataaatttcgatcggttatcgataaatttcgactgaattttgaccaaatctactgtttaaccttcgaaatttcaatcaaaacttaattccgagtcatgtcgaaacgtcgaaatatcatggaattcgacatgtttttgtcgaaaatgtgaaccctattctcaagttctcaaccaatctagaatcggcccaacccacctaaaacaatccctctccgagttgggccaaaagttagcaaacccatctgtagagcacggcgcccctttcttccccagggatctccccctccatccggcggccgggcgacggtgcgagagagtagagagagacccgagcgagagtccgacacggggccagcaagcgctgggataatggcgacggcggagaaaaagaggcctcggagcagaagcggcggcggcggcggcggcggcgtggagaagaggccgagcaggaagcaggtctttatatttctctcctctcctcttgttgatggggccagtatcgatagctcgttcgtttcaccctacccgtagtcgattactcatggctgatacgatttgttttatattccgcgaaaccgaatagctgataagattttgtgtatttttttagtagatggtgtttggcacttggttatgtcagagttcaattagcgcgcacttcaaaccctacaagtgtgtcgaattcctttattttcataaactgcgaaagctgcagtgtcaactttattagactcatgtgttcttctgttgaatacgtatgttgcaacctctagatttttgtcaaaagttctttttttaaacttatttggtgggtggtttgtcactcctgtcaccgaggtagcatttgaggagtaatagcggagatgtatctaatatcagggtctcattcagataatcttctgcctttgcctagatattggggagaaagaaggctgttgaagaacttatcaggaaagctgtagccgtgaaggatcatctagcgcaatttcctgattttcataagtatcagagaaatggtaacctacattgtctgttggtgaacaaaattcactaccttaggactagtaatgttccatcatgatgtagaaactattaatattcccagcgaaaggaaaaaaaactcctaatgtcaaatttacctctataattccaacactaggccctaacaagtcctattcagtacaatgcaattttcttatatgtgtgttgtgggcattatatcaatctcaccttttttatgcttaggtcttttggtctacttggagtctggacatggaaatcaacttccattatcaacaaggaagtacatccaaaatcttctcaaggtcacatatatttctctttcattttgctcttagtgctgctggatattttgcatatcttccttttacagtttccccataaatattgaatgtaatgctagaaagcaataatataggttaacatggagggacaatatgggccagaatggccttcagaagagaaaattaagcgccgggaaatggttgccccagaagcacgatatatctttgtccggcaatcttcaaatgccattaccacccaaaatattatgaagcaagattccgggctagaatttacacatgaagcatgtaatgaagatcgcttgattggttttgtacactacagatttgttttggaagaagatgttcctgttgtttatgtctatgagttacagatggtgccttctgcacaggggaaggggctgggaaaatttctaatggaattgattgaacttatagcttgtaaggtaatgtgacttgtttaacaattactgatggtttactaaaatgacctgctcaattttgtgtgtacatatttccagaaatattatgcgtacttatattcttctatgatacctcttattccttcatctgtcttatcatgtacattttttagcataaaattgctatctgaaatctcagcatgaaggatcagctgattttgatggcgtgtacatgcagagccaaatgggagcagtgatgctaactgttcagaaagctaacaaccttgctatggctttctacaagaagttgaggtgaagtgctaggcttgaatatttcctccacagtttatttatgctaaatttataccttatcgttggtttgttaatattgcagtgactgctggttgaaacatttcaatgtaactcttatcctgcagatatgtaatatccagtacttcgccatcacgagtagatccactggtattgttttgcctataaactatagtttttattgattaagatgttcatatcgtgatccttccagtgtctacagattgggcttgaaaaaaactatgagattttgtgcaaggcatgtgaatctgaagctaagtccaaattagaggtatgcagcatgttgttcagtgttgcataaatttactgctaccttcttgcaacttctaagatggttgagtctgatgaatagaaaaaatattcgccagacaggcatattaatcattcactaaattctttatgagttggctgtgttgatcctttttcttagtaacaaatcttctttgtttagtattggctatatgccaattactcactaatgcataatgtggtgaatttgcattaatatgatgtaaaacaagtccttgatatgtatttttgttaatatttgcaggaaggcaactgaaaactccctgcgcaatgaccaatcttgttaaaatgtgatgtgatgatggatgttgttctccactacagttttgacaccttacagggtacagcactacagctcatgcttgagcggccgcatatcgtcaggacaccatgttatcgcaatgcattcagatgtattgcacatttgcactgttcttgtctgaatgaagctgatcctgctaatccatcctgggaaacaaacacgattggctggcccatattctttccttgcaaaacgcaaatgtacatctgcacgatggagagcatatgaaggttgcatgtcgtaggcttgagacgacagtaatgcaactttttgcaaactatggatggagattcacaaatagacttgaataaatgtatactccttatcttggtttggtcttttattttgttggtgtgtttaatttcattttgaactacgatactttgtaataattggctgtagctctgatgagcaaaggctggaatgtttcattccattatctaaaaaaacatctgcacgtttctcaattttacttggaggaaacatgctgttgctgtatggtcgtcaatattacttcaggtaggatggcagatggcaaattcgcaggcacgcatagatacgaccccgagagctcaagccgctcaaggcgcgttgtcgcgcttcttccgcggggctctcttcccccttgtgacgatgatcgcgtcgccgctccaggtctccacctcctcctccggctccggctgcggctcctcctcttttgcacatccgcgcctgagcaggagacgcttgcgcggcggcaggtggtgctcgtccccgacgccggcgtcggcgcggtgctccgtgcggcgcagcccgcagctcgcgcatatgcgccgcctcatcttgatgggatacttgcgctgtttctccgtgaacgcgccgtcctcctcgccaccggcgaacgtcgtgcacacaggggtcaaaggaagcgagagcgacctattgctcgtgctcaacatcgtcccgctccactgtagattaatctaagttcgatgtggatcgtattgcctctcgatccatgtttttgtaggtctaaaagagctcgggtttttctgggatgaagaatgcttgagcatgcatggggcggcacagcaccatgggaaccgtcttatgattgttgcgtgtgaatcaaagcatgagtttgccctgtgtgcgggcgttttgctttcgtttcctgacgatgaagacaaaccatatgtctcggttcctcgtgcgagaaacgagagccacatcgttcgggttttccggttgctgcccatttggtgccgtgcgtccgtgcgtgcgcctttcgtgtttttaacatctcgcaatggacagtgccagaacgcagcaacagaaagtaagcgtgggacgaggatcaagttaaaccagacattaaaaccgtcgtccgagccacctttagatcttgcttatactagttttaaaagttgagcaacgcatgcttatactggttttaaaagttgagcaacacattatatctagtaattcctccgtcccaaaaaaagccaacctaaaaagggatgtgaccctcctagtactacggattcgtaggactaggaggggtcaggttggctttttttagatagagggagtaccgattaaggaaacgatttaaacccaacctcaaccgaaaaccatcatccgaaccgtcttgagatattgttttcactgattttaggagttgagggacgcgtcatacagtcatatctgatactccctccgtcccataatataacaacctaggaccagataaaatatttcatagtacaatgaatctagacatgcggcctgcccagattcgttgtactatgaaatgtcacatcctatactagattgctatattatgggacggagggagtagaggtttagggcctgttcattttgatgccattttcaaccttaccaaattttggtaaagttgccaaaaatatgtgtacgtttagtttcctgccaaattttggtaactatataagaaatcctgccaaaattttggcaagttaccaaaattttggcaactatgccaaaattttggcaatttggtaaagtatttttggcatcaaagtgaacaggcccttagacatgaattttagatttggcgacaaattaagggatctgaagtgaacttatgcccccaattatctgtcgatctctcacactcatggaggcccaataaacttatgggctgaatttagttagcccaacaagccagagtccattatcaccgtgggcccgacctcttcgtccccctcggctctctctcctccccctcggctcgcaaccgccatggagccatcgccggagattccgccgccgccacccgccttcgccgccggcggagaaggcgatccgcatgctcccaccacagccgccgcccgctcctcctcctcctcctctttatttcctctcttccccctctcggcgcccgaggaatcctccgcccccgcggcggggtcccagtggctctcaaaccctagcttctccttcgacgcctcctccctcaacatccccgccactgcctcctcatccgtaccgccgccgctaagcgcctcgtcggacgaagaggaggcgccacggcccgcacctgctaagtatgacctgctgccctactcaccgtcgcctccggcctccgacgaggagaggagggacagacggaaggataggaagaggaggaagcggaggcgggagaaggagcggtacaatagcgcggaagcctcgcgaaagccgggggttcgcgcttgggctgggtcggagacgaagttggctaaggattactacttcgacgccaagggcgaccaggataacttggcgtttggatcgatatacaggtcaggtttttgcatatgaaatgtgtagcaaagctgaacttgcattgtcatctgaagttaataatcaggcatacgcactgggtttgttccatttttgcggtatcaggttccatttgaaaaccatgggcgtttatgttaattgcgcaattccatgaaggtgtgctagactagctgctaaagtggcatgttagatgttgtgcaggcttgcttctgtttagggcatcatcagaattctcagtatcaagtttgttttcctagattcatagctacttgtttaaacatatttgttgtgatctctgagggaaataaataaaagcctctgggctaattgagttgcaagaaactgttaggcaaatttactgaactcgaagctcattaatgtttagtcccctttgaagttaagtgggctgatttgatttcgtcttgagaaaagcgagatctgatttaaatagaatgaatcagcttacatcatgctttggccagaatattaatgcttagtgtgattttgtgactttccatttttttccttggttcatgagttgattctttatttttctgctttcttcatttttgtttagtttgactgtagatgcatttttcattttactgaaatttgacacacaagaaaattatgcagaatggatattgcacgctacaagtctcaaaacatgccagaggcacgtggtctaaaacggcttttgtttcataacttgggtgtctcggtacatatgggtcatgagtcagatttagatggactgaatagcaaagcaagagctggaggtcgctactactcggcgaaatatgcagttgtagaaagaaataagggtttcaaacacctaaaagtattgaaaaaggataactctgcaattctcccagaagattttatccccctagggataccatctcttcctgaaaataacactactggggaacaggaacttgaagaa

SEQ ID NO: 64691 - DNA, 2012 bp, Oryza sativa
tttctctgctactttttacaggataaagttgccagtactcaacctcagaaagcagcccgtttgcaaacaactgaaagaaaaattagtatattggaaaaagctgtagagcttaatccagataatgaagaattattgctttatcttctgaaggcatatggtgagagggatagcacccagaatctcctggataaatgggagcagatactcatgaaacacccggatagttgtaagttgtggaaacagtatctacttctgtgtcaaggggaattctccagattcaaagtatctgacctacggaagtcttacgcttatgcagtacaggctttatctgcagcttgtactaagctatgtaggcaggttcaacttcagtgtttctttgtatatagttcagcttatctgctccccctcccctttttctatccctctctcggcatgtatgcactgttagcgagttaaaattttctgatgtttattctttctttctttttttcacaggatacacaatatgatcgtctcgaacctaagtattcttccttaattcatcttgaactcggtctagtggatatatttgtgaatttgtgtcggttcgaatggcatactggacatcgggaattagcaactgcactatttcaggctcaaatagaatttagtttattctcccctccccttcatctgaccacaagcagtaagcaaagactctttgagcacttctggaacaatggtggtgctagaatcggagaagatggggctcttggatggtccagatggttggcaaaagatgaggagagtagacaaaatatagatatacaagaaaatacccaagaaactgaaaggggtggttggagtggttggtttgatccttctctaaggactaatagtgaaacaagcaaagtggaaccatcgacatctgatggaaatgatgcagaaaatccagatgatgaggacccatctgcacaagaagatgttgaatctttgctgaaaaagcttgggattgatggagatgctgattacaatagtgaagttaaagatccaaaaacgtggaatagatggtcatttatggagttatcaagggataatgaacaatggatgcctcttcatgaaaaacttggtacgttattttctccttgtgtttgtagattgacaaatcacattgtttttttagctaacccagtacttacactggatgccattttcatggacaggatcactttattctgatgatgctccaactggagaagacaatgatcagctttccagagtaattttgtttgaggatataactgagttcctgttctctctatcttctgaagaggctcgcttttctttgatatgccaattcattgatttctatggtggaaaaatttctagatggtaatttcatctacttcttttcagataagctgttgtcattctctgtacgcaaagtctactagcacttgtacaataaaaatggcatttcgacctcagtgaaacagcaaatattattgctcattttttaaagatgtgaacgtattccttaagatcatcactatatgggcctttgaaagaacatactaatgatagctgtaactgtataatgaggtgtatgattcaacatggcaagtgcatcttaattttagacttgtgctgatcatgttgatagttttactcgctcgccttaaattaaggaaaatagatggtaatggtattactgcccaggagtttatagtccttgcaagcaaacatttggacatgtatgatgaaaacagagacgatggcagtgagatgtgaaatgtgttatatcacccttgtcctcattttatgtgccttaaaaatctgtattaattatgagcagttcattgggttgcactatgaataagttgttacttttcacaatttgtttcttgccattttcatattgttgtgtaccaatgagttaactacaggatatttttacattccaggacatccaccaacagttcaagttggattgataggaatttgagcctagagatgattacagatgacattca

SEQ ID NO: 64692 - DNA, 14238 bp, Oryza sativa
tagttgcaaaagacatagtgtcagtgataaatggtgtccgttcaaattaatcagattcaatctatgtgtaaatacttcacatggtcccaaccatcacccattgctcaaatcagtcctccaacttaagaaacaagtcatactagcacatgacctttattagttggcccattctcgtccatattctgggtcagcagccaaggttacccaacaagaactatgagaaacgaatgaaataccctctaattatttcactgcatggttttatgcatcatgcacaaacacaacagacgctctgttgggtctatgagcaatggaaattaaaaaaatgttaatggagagcaaatttggtcatttcatgtactctaggttggctggagatcctaggtgctgactcagcatagagatgtgtgatgccacatacacacaaggactaaaagagctaattaatgaaattcgaggattgatttgactagttgaaggaccaacgtgaaccacaaacagtaattaagtgaccaaacgaacaattaactccaagatagatacaggaaaagcgaatggggtacctggataccttcattggtaataaaagaaactttcattgctgaaactagggctctcagcaaggttccatgttgttcatgctgtttatccttgtctccttcaggcatttctgtacagctgtcacaagaaaattcaacacgcagaatcagggatcccttttgtttcatctatatcaacataactattttgcaaatttgctcatataaacataggtgggaaccctattgactaagaacatatcaataattgaaaataacttgcaacatagtgtagagctgacaaatgctgcctgtgtatttctgatgaacctacctataagctgcaatgctggaattgataaactgatgcagtgctgttaacacataggtcatgtttatagaataattgggtgttattccttcagagaagttcttccaaactgcattcacgtactgtgataatatcttgcaaagaaactctagcgaatccaggtatgccacaaaagatatatggtcatcagagtgagacaaactgttcttcttattagaatgcccaggctgcattgatgaactagaagctttacccatagtatcaagtggaatggatctaccattggcaaaacaaaaaagatgtgccagtgtggcaagggcactctttaaagtttgtagatgcttttcatcattaagaaaatctgtggatttatgaggccgctctctattttcaatttgctgagcactacagtataatccaatggcataaagaataagtactgaggcagttgcaggggttgaggaaacctacacacagcaagtaattgaattaatcaaaagcactgcttgcattgggatggtatgcattcacattaaatgatgctaacgaaatagtacagcatgtacctcagagaaataaccaccttgttcataaattagctcagcagcaccaacagataaatcccaatttgaagaaacaaagcttcgagaaaaatatgctacaaattctacaagcccatttacagcccttggtaagtcagcctgaaaaaggttacatcacttacatgacaacattacacaggtaaagatgccttggcagaaaaacaggttgttggctatttatggaatgaaagaatagacagatgaaggtgtcattgcacattacaaataaacaaatcaggccagagtgcgccacaaatctgctctccatgacctagttgtttctagtcattatcacttagcccatcagatggcacatgactacattactcaaaagagggggaaaatgatacagtgaaacagcaccgatcagtcctcgatgatatttaacataaaggaataacaagcactggaaatggtcctatataaggggcattcatggttaccagtttaagcaaattaaaatgtaagagaaactacaaactagaaagaggtttccagctgcataaaaacaaaggaagcatgaaaatacctttagacatgcagcagacccaacaacggtctttaagacatcaagcaaaagctgagtgcccccaccccaactcacatctacagatgaacaaatcttgcgagcaacctgatccataaaaatatagtaacatcattgactagccacgttttttagcaaattcgagagggtaatcaattgtgtaatgatacatactgccggcaagcgttcaatagtttgcgccttcatacactcccccaaggttgcacgacagaattcacacacaaggttggtattgaacactgaatattcagcaaccaagagaatggcacagcgacttaatgcattcacaagcagtgtcagatacttcctgctgacatcctcagccagaatcctgcgcacacagaagtacactttaaaccactcatttcctattttattaatcaaactgaatgcaaagcttagctgagcacacaatctcaccgaagccatggctggagttggtcaacaaggctgacaacccgttcgtatggggcagcttccttcaccttgcacttgctggcacaattagcaaagcacacggtgagctcaatcgcgaggatggtgacttcagggtccgcaccagcctcccctgagatgccaggatcaggaaggagggaagcaaaactcgcagtcgcagcacggcgagactttgaggccgtcggcactgacagcacagaccgaagcgaatccagagtggcagcagcgtccgcctcggcgcgtgcgtagtgtccgcgcgactcgaggcagcacacgaatcggccgcgctggagcagcacggagtagggcttcccggcgaggcacgccgatatgaccgcgaggcagtcaaggaggagggcgtaaacgtcgagcagctcgtcggtgcacccggcgtcgcctgagctagggttggggcggagtagcagcgggagtacctggagcgcgcggcacaggaaggggaggaaccgcttagcgagcgggcggaccgtggccgcgtcgggtggcggcggcggcggctgctgcttgcgctgcttcgccgtcctcttcgccggcggtttggcgctagggtttagcgtgggtaggtagggggagaagggctcgaggtaggcggcgaagcgggaggtcaggccggattgggaggacggggaggagagcgcggcgaggaggtcggcggcggcggcctccattgccgtggtgcggattgcgcttgcggcgccgcgtgtggggaaatttttgtgcgcgtatttggggatttcggggacggggatgggcgggaaaggaggaggatttcggagctctgcgcgctggacagaggagataggacggtggggaccggcgaggaggaggcgtacgctggaagatttgattaatgggctggtaaattatcttgtgggctgccagtgggcctattctgatgacctctatatgggcctcacttcaattcaacaatttggttagtgatgcaagaagaaaacattagccatttccaaacatttgaaaaatatcaggcagaggagtgagttttgccgacagtcaacacaatgtaataacagattgttacagtcgtagtaatatctcggttttatttgctctagtatgaccaatgaaatatacatcttgattctcaaatgaaccatgtgcacaaccatccatcaatctacactctacactttttccatggccatcgaatgcgaccgccgcgcgctactccgatgtaccggaactcgagagagctccaaactttgaattaaaatttatgcaactatgctacgtatatgtacagtttttgcagtgtcgtacactacacacgtcacgtttcagaagacgaggcaggacttgtcgaggtcatagcccatcttctccaggcccggccgcaccgtgcactcgaccatcgccggcggcccgcacacgagcgcgagcgtctcgccgtcgcccggcggcaggtgctccctgagcgtccgctcgtccaccctccccacgccgtactcccacccgtcctccggccgcgccaccttgctcaccacgtaccacaccttgagccgcgccgggtgcgccgccgcccaccggtcgatctcctcccggaggagcatgtcgtcctccgtccggttcgcgtacaccacgtgcatctccgttccgtcgtcgggctggtcccagagcacggcctggatcacctggtacaccggcgtgatccccgtcccgccggccaccatggcgagccgccgcgcgaaccggcgctcgccgttcaccgtgaaggcgccgcggccggcgtactcgatgtgcccgatcgggcccttgatgtcgatggtggcgccgagcggcaggtagtccaggtactgcgacatgagcccgccgtcggggaacttggggtcctcgcccttgaagtatatcttgatcaggagctcgatgtagccgacctcgtcgacggagctcgtcggcgtgtacgcgcgcatgcagagcttgccgccgatcgacgcgcacacgtacacgtgcttgccgaccggtagcccgagcttctggtccggcgacggcagcgcgaaccggaacaggcgcacgttgtaggacaggctcttcttgtccatgagccggcatttcaccttctcccgcgggttggacagcgcgacggtcgacaccggcacggcgggcgccgccgctgccgtagggctctcaacgatggacgtgaggtcagcactgctgctctgcggcgagtagtcgctgccggtgacgatgagctcgccgatgcggtacatctcgaggaggccacgggccttgtcggagtggatggcgtcgaattcctcggtgcagtcggtgccggcgttgatcatgatgctgtcggcgccgccggggtggtccttgaggaaccccgtgcagtcgtagacatggccgtgcacgatgatccaggcggactccggcgtcgtgtggcggcgcacctcggacatggtgtactgcgtggtggccgtgttgaggaacggcgtggacgtgctgcgcttcagcgtgctcaccgcgctctccgacgtctcgaggtgcttctgcctcgccatccacccgccggcctggttgcccggctgcgtcgggtgctcgaacaccagcccgatctcccccttgtgcggcctgcacgtcttcgtcttcaccctgaaccagcagttgttcatcatgccctgcacacacgcacacgaaccaaaacgtaagcacatcgtcgtcgttgaaacggatggcgttgccgttgctggtgcttagtgcttaccatgagattccaaatgagcttctccggctgggtgttgagggactcgtcccaggcgcggacggcgatctccttggcggcgagcagctcgagcacctcgacatcgacggaccagaagcaccagcaccagtactttccgtacttggtcggcctctccgggtggtcaaggttgcacacctgccacgtctcgccgccgtccagggtcacctctacccttgtaactttccggccaccgcctggcaacagaaaatcatcaccgttaatcacccattcaccatcagtacaaagatactgatattataacggcccagtaaaagcataaagtgatcatggtgggcttttagaacgagcaggccgaagcccaaaaacaaacaacatgatagatgagatgggcttggggcttaccggagtaggcgtatcccttcatcgtatacggccgctgcgtcgtcagcgcattgatggggagcacctcatcgtgtcccggcgtggtgatcaccgagtttatgttcagctcgtttatcatgtactccggcttgtaccaccaagctgcacataatccaaaaaaaaaacacacaagttaagatcacaaagatgcaacaatgtgtgtctcgtgcagtgcgttcgaggaagatatggttggttaattaccttcggcattggcgagctcggcgtcgacgtgagacgggaggacgcggttgtcgcggtaatggtagtagctctccgactcgctggacgcgacgatgatgcgcttgagccatttcaccatgcggccgccgatgaagcccgggacgatgacccggacggggaagccgtggtcgggcgtgagcggctcgccgttctgcatgtaggcgaggatgacgtcgtgggcggggtccatggccacctcgcggcgcaggctggtgccgtacttgcacccgccgccgcctgggaggtcctcggcgccctcgaagcacacgttggccgcgccggcggaggcgcccatgacaccgcaccaccgcagcacgtcgcgcagccgcacgccgcgccacacggaggtggagatggcgccggggccccagttgaagcccacggtctggcgcaccatgttctgctccttgcgccggttgcccgcgcacaccagcgtgacggggagctccacggcctcgaacccggtcacgagctgctccatgttgagcctcgcggggcgcttgacgagcccggtcacctccacggcccacgtcgaccagtccgccttgggcacggcgccgtggttgcgcacgtagtggagcggcgccggcgtgatgaagccgtgcgacatgaggcgcggcagcggcggctcggagttgaacgggtgcttgccggtgagccggacgagcgccgggtggcgacgcacccacgcgtcggaggtggcctcgtcgcgggggtccttgacggccggctccgccacctccagccgcgggtggtacagcgacctccagtccggtggtatgctgtcctcgtcgtcggagtcggtctcggagcccgaacggcgcttgccgccgccggacgggaacaagtcgaggttgctcgacggagcattgctcgcccacgggtgcggagccagcttgtactccaccgaggccgccattgttgccgatggaaggacacaatgttacaattttgcggacactgtaagctgtaggttgtagctgtggttactgagctagaagaagagatcactcgcgagctagaagctcaggatggcatctgttcttggaagcagtggaggtggtggtctggggtttatatagggacgaggaacgcgaggtcgtagtagttgcctctgctctgatgcatgcacggacccaagcaggccacgagctggcgtcaccacacgcgcaggcgcgcgatgggatttctagggggattcggccggattttttttcttcattttccagattaataccggcgacgtgacgtccatccctgtagcagcctcccatctaatacgtcctttcaattcctcttgtactagatagaaaatgacctatttcttttggagtttcagactgttgggagtgaattttgatcactctagggatggtcgatctctcgttatctgtatgttacttaaaaaactagcatggttgccccatgcagattgtgcggctagcatcattatattttctttcatataatagcatatatgttttctcattatattatttaaatatattaaaatgacaacataattttaaattttgcaataactttataaaaccactaatgtgtaatattcatattgtattttatatacgtgttagttattaattatttttaatatcaaattttagttatttgtaaattatatatattcctatatggactctacactcgtcttttaatatttctttttttaattctgaattttcagtgctcttctttcaatattatttatttttatttctgaatttttattatttataattgtatttctatgtggactttaaacttatctttcaatattatttaatttttaatttcgaattttagttacttctaaattgtattcctatattgactttaaactcttcttcctatgtttttcttaaattcgaattttagttatttgtaaattgtatttttatacggactctaaactctacttttaattttattatgtttattccaaattttagttagttttaaattcatatatgaactctatactctacttctaatattccttattttttaattcataatttctatttttttcttaattgtatttctatatggactctatactctacttctaatattccttatttttaattccaactttctattacttcctaattgtatttctatatggactctatactctacttctaatattccttatttaaattatatatattcctgtatagactctagactcgtcttttaatatttctttttttaattccgaattttctataaattgtatttctatatagacgctatgctcttcttccaatattatttatttttatttctgaatttttattatttctaattatatttctatgtggactctaaacttatcttttaatattctttaattttcaatttcgaatttcagttacttctaaattgtattcctatattgactttaagctcttctgctcatatttttcttaatttcgaattttagttatttgtaaattgtatttttatacggactctaaactctacttttaattttattatgtttattccaaattttagttagttttaaattcctatatggactctatactctacttctaatattccttattttttaattcataatttctatttttttcttaattgtatttctatatggactctatactctacttctaatattccttatttttaattccaaatttctattattttctaatcgtatttctatacggactctatactctacttctaatattccttatttttaattccgaatttcagttatttcctaatcgtatttctatatggactttatactctacttctaatattccttatttttaattctgaatttcagttatttcctaactgtatttctatatggactctagtctcctcttctaatattccttattttttaattctgaatttcaactatttctaaattgtatttatatatggtctctagtctcctcttctaatatttcttattttttaattccgaatttcagctatttctaaattctatttctacatgaactctgctttttctttttctccgattaatgtgagaatttataggccatgagagcgaacgtggaggctcctttttctattcctttaataatataatagattataaaaaataaaaaaaataaaaagatgtattaacatatgatatatcgctccataaacatacaagtttaaattcaacttatacatctcgaaaaaaaacagacttgatcatgaatatgatgtactttaatttgtttttttcgttgcaggatatagaagttgaatttgaacttgcgtggagtgatatgtcacatgttaatacatcttctcaaaatttttcaatttttttataactatttaagtgacatgcaaattatgagaggagatcaaaatagttttctcaaactgttgcactattttcacatctgcattgttaactctggtgagaatgagcagctcggactgttcaacctctcgtaaatcagacacgtgcatacgtgcctggtaaatgccgtggccgtgttatgctaaacacaggctgatggattagttgatcgaggttcaaaaaagaagtttttttcctgacctcctaataaccccagctttaggtgcaagaaaaggagacggcatttggtggctgccggatccagccacccccgaatgcagcttgcctgagaaatgacctcgcccaggtgaatcctggggagctcatggacacggacaccgggcatgcacacacgcacgagccccactcggagatcctgcctgtacactctcgtcgcttctttcctgcttcctttacgcttctctgaatgatcaacgccaatatactaatcaggggcacggacccgcgttccatggtggatggatacgtgcatcggcaaattcgaccagccgacctccattagatcggctgtgatgcagcattggagcgatcataatttagtagctttctttgttgattccccccgtgttccaggacatgcgtcaggggcaaatatttttagcaggtgaaagcctgcaagatcatgcatgagcttgcagcaaacgtcctatgggagttgttcagaactggttgattaacagcggcttggttagtttgagaagccgagtattgtagttatggaaatggcctctaggatctacagagcaggcaccctgtggttttaattactgtaaaggcaagttctacttgcatcattttctcacataattaagtcaaaagtcagagcacaaagtcataagcacacagcaaattcccagctctctcgagtcgacacactaaaataaaccaaagccttgatgcatgaccagcaccccgattccctgtaaattaatataaaccagacagaacaatactaatccaagcatgatgcagagagtatcttatcacaggacataacatagaaagatactttcccattcaaaaggaaatgaaaaaccaaatgattgacttaacccaaagtataagcagcaacagcaggtcgggtggtaattaacaatggcttggcgcatggcattttccaatggccaagtaaccggtgggaagctcggaggatacttcatcacatcacttgctggctggtttctttcagcagcagctgagctgcctactgtagctgcatcttctcaatatcccaaagccggccggctccaaagcaggagttgcctcccgccatcgccaagggccaactggaccaagccctggtccagaggcaggcaggagagtagtagtagtagtagctagtagtagcagcggtggcttgttagctagcttctggagtccagccttccccagttggcgactctgccgctgcgtgccattttgatttcttgagagatctctctttttcatggatttggtgttttgcgagatgcatggaggcaacaacctcctgttactgacgttaaagtgttcgactcgccatcagaaacgtggtctgccagtatggtttgtcgacattgtgactttgtgaggctgacacttcattcacttggctttaggtctagtagtatcctaatgtaaggtggttaaatatctatcatttcctgtatagaattttttgtttgcacattacaaaacagtcattgcttcgcttattctgattataagccacaacagcttattagcaatcaaaaaaatatataaataaaaattatatatatgtgttcttaattagcaatttaaaagcaaatggtgaaaaataagctacaatgaaaagacccccaaaatcaactttaaatttaagtttttaaatccaaaattttgctgcagcttacgagctgagggtaaacaatgggagttttaagagagtaagtgttttctaattggtgcagccctgagaccctatttgagagaactattagaccgtagcccctgtggagaagagtgttgtcacgccccgaactaatcccgaccggaactagcccgtgacgctctaaattaacctgttaatcgatatcagtcccaggaaacagtgctggtatcacagggagacagaatatcacagcaacagaggtctttttattatagagtagaggtacagtcatgttgggctgcggacagatcccgagctcacaactgcaatacaaaagggaaacggaagccaggacttggaccaaacaacacaggcgcgacttgggaactaggccgaaaccctaaaactcatcgtagccggcttgctcctggaagaactcctcatcggcaggttccgcttcatcttcttcagcaactgggggggattatttatatagagcaagggtgagtacgggagtactcagcaagccatgggaaataagtgtttaatgcaggcttcaaggaaaggctgttgtttttgcaattgatttttatttgaactcttttctgaaaacaactaagtgagtgcttctcaaacgacacggatgggacagtgcgtctcgtccggtcggagtatgtgcaatgtatcagtctttagaattgaaacaaggttggcacccggccaacagcttttcaaacggccacccgggccaaccactttcaaacggccacccgggcctagctgatcccatcagctgcagattttttttttaaacatcgaacccctttccacaacagtaatttcgcaagcagtagtcaaacaaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgacaggaagcccaggggtcctccccgacaccaccccggcgaatccacatgtctctcggcatcaagactcccctgataagctagttactcagccaggggtgtcccattccacccatgtggtcgtacttgtgttatgtttggatgaaattccaaggaaacggtccttaagtgcaagagcggaaaaccgtacacccggtacgttccccggtccgcggttttggaaattcatttagttcacaagcaccgacccaggtgtcgggttttccaagtcttttgtaaaacccaagttttacccaagttgttattcagattttaagtttgaaggcgtccgtcgatactcgcacagggtgcacgaatatcgagacgcaactagatggatacaaggagacatgatataacaattaacaaaggaaggatcaaatgcaacaaattaggtaggtccgccaatctgccttgcagacgggacaacagattaagtgcgatcctatcaatgcataatattttacaagcaacataattaaatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaaataaagccctattaatgacctctaagtgtgccattagttagatctcgagatttgaggaattttggaagttgaacggagtcaaacggatttacggttgggaagatattgaatttctaagattattggatttttggtctaaaggaaaaaggatttaattaaatcctttttggaaaagaaaagaaaagaaaagagggagggaaattagactttcctcgggcggctagggcgcggcccgagagaaatggagcggttcggccgagctaaatgggccggccggcccaaggcggcccaaggcacgcgcgcgcgggaggggaggagagagagagccggtggaccgggctcaccacgcgtggtcccgagtgggacccgcttgtcggtgacacggttcaccgtgcggagcgagcacgcggcacacgcgcgcgggcgggggagggacgcggtgcacgcgcgcggttcgcggtggatgcggatgcggcgggcccacgcgcagcctcacggctcgcggtggaacgcttggccgagctggcgccgacgtggcgcctacgtggctgccacgcgggccggcgggaggtagacgacgacgccggccggaatggacggcggacgacagcggcgagcggcggagcgaaccacggcgatacaggcgaaagcgagcacaccgggtggttgcacaggacgaggggagacgagccaacggctcggattcgccggagggagcttgacggcggcgaattgcggcggcggcaaccggcggcgggagaaggggaaaacggcgacgaggtcacgaggggccgattcccggtggcgagagcatctacgcggctacgggaatccaatgctagcgttggattaggaggaaacgcatcgagggaggccggcgacgagaggcgcttccgagctcgggcggcgacggcggcgggcacatggcgagcggcggcaacggtcggggcggcgccggctagctatggggaggctactcgtgctactacccgagtctaagggaaggagatggaacgaggaggaagaacggagggaggctctaccgagatgaggtggggcgctgtgacgagaggccgacggcgcaggagtgatctatccggcctcgggcaggggaagaggaaggagacgagcgcccggagtccccttccgcgtcctcgctcgtgccggctcctccgacgcgcgcgacgacgaacggcgacggcgaaacagaggggtggcaataatggagtggaggcgatgggaggagaagagagggagggcgcccggggctttaagggcggca

SEQ ID NO: 64693 - DNA, 1056 bp, Oryza sativa
  unsure (1)..(1056): unsure at all n locations
cgggcgcgcgcgcgcgaacgacgcgcggggagcggcagcgagggaccggagaggagggcccggccggcgcgggcggcccacgcgcacgcgcgggggcagagcggagggggaggggcgcccggcgcggttcccgcgcacgcacgcgcagcgcacgggcgcagcgcaggggcagggaccggagggagagagagccacagagaagggctcgccggccaccccgggggagatgggccgagagggattcggcccatcgaccccggggaggcaaaatagacttttgcggaggaaattgatttggaaggatttggattcggaaatgaactcgacgatagatcggggattgagatcttgagatggcacggacactagacgacaaacaaagaaacaatatcgcaattagggtttttaagagataattttcccgcaaggcgccacgacggaacgggcgctacaagtgcatattttctctttgaaaataaaaaagaagtgaacacaaactgagttttaatgtgttatttatccctagctcaatcgtactaagctgctacaccgggaaagtatttttaacactcgcatgcacctcatgtttcctccagggtacttttcagaattcagattaactgtttctgaaacgacaaattgtgatatttcctcttttttgacacaatcatgctgattcttgtggattcagtatcccccacagagaaaaagaacgacccagaagtccttttctaagaaaagagcatactactgtcagtgagggaaatgctcacctctattaattctgtttagttcgaagcagatcattagaacagtttacagagtggtggcctgtctgttcagatattatttttccttctgcattttgaacagtatattcattctgtagaattagaacatctctctgcattttttagtgtaccatctcttgcttgttacggttcaagctgttttcatgctcaacatcgatcgattccagacaaggagatgaccatttcacagactcacagtgcgtgcaccacgcagagcanacacactaaggacattgatcgcaag

SEQ ID NO: 64694 - DNA, 3011 bp, Oryza sativa
  unsure (1)..(3011): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaaccaaggaacaacatcagacatttgtacactgcagaagcggcagcatatgtccctgaagacagatgaaatgaaaacaacttacacaagtttcacgaagcgctacaattgcaatgtggatatgtgactgatactatagcaagacaatgaaataaccttgactgttctgaaaggaagcccttgagcaaaaacaaactcatactatataatatttctgccctctctgaaataagaaaatcaccagtgctctgatccatgattagtccaaataaattatgctcataagttctataacaatcctgaggaagggatctaaagtacaacaatgatatgcactgccaatagatattatgaattttatgagctccatgcaatcctccatgagcacccaaggcttttgctgtaaaatacaacactcagaagtgagaaaaaaaaactatatgaatatattatataggaatttagtaatgaataaaattcaatcagacttcttaaacaaaaggactatatctgtcaccatcacatgattcaatgcatttcacagtagcaaaagatcatttgatgttcacccgtaacaatctcttcgaatgtataaataaacttaactttatatgaatatcatttggagctaaaagaggatttcccatctcatatgtgtaaaccaacagcatttcacagaaataactgcactcctgctgttcaacagagaactgctcaaaagccaggtatacaaaattgaaaaactggactggtccatgggtcttccataataaaggtatcctcttgaatgttatagcatgttactaaaaaataatagtaaataaatgattaaacatgaaatatatcgaaaataaactagcaaaaacctgaaaacatacacgtaatttatgcgcaaattgtgaagcccttagttgcgcacatgttattacgtcaagtgtgcaatttatttgtttaacacacataataaggagcataaatagagaaaagtacctatttttaacaggatagacacatggttgtgatgccagaacacaatcccatctgaattgcaaaatattctggatgtacccagagttgagtgtattcacaaaaaggcaattccaacatccaaatatactgcatgtgtaatctatgctctggtcaacgccatcaaggatacagtttgcttttcctcggaccaaagtatctgtggacagattatcgctgcaagatagcccattcttacagtgtagctcagttgaagccttttcacctttcatatgagcagttcgcttactagagcgcgtcctagtttttacatgagcttccacattctgttctttagctaaacgtgatgaatttctggttgtccttttaactttaacatccaatggtggacaacattcagaatccttatgtttcagaaattttaatgccgtaaactcattcgagtgatcaccggaagcctgactaaaatttgcacatacagtacatgaaggtaacactccatcatttgcagctaatggttctttcccatatttgctgcagataatgcaagtagttttaagcttatcatatgagtcaacaggagattccaatttggtgccgttcagtttatccagggcagactgatacatgcctagagcattagacaaattgcctgctgactgtttctgaaagtctttctcatatagactccaaaatagatctccagcttgcacatcaagtgatatatccagagttaacttgcagagcttgcacgaaatgaatgtagcattttgtgcaagaagatccctggcatatttaagctcgccctctgcggtgtcccattgctgtctcttgcggtatatttgacctaaaaaatcaggcaacatgaggcagaaggacaaatgacgcaaaaaccaccaaaagcaatatgtacaactgttgtatacttcctccgtttcatattataagactttctagcattgcccacattcatatataatgaatctagacatatatatgtgtcaagattcattattcattaacatttatatgaatgtgggcaatgttagaaagtcttataacctgaaacggaggtagtactatctttggagaagtcccaagaggtccttttcataacttatgaagtgccaaaactaaattacaagtaatagtgcctctttgatcttcgtaacactgatgtaaaagtatatatatacgcacagacctaaaattgataaggaagtatataaacacacatacctaaagctgatgcgaaaaggacaccaaaaaccggcaatccttgaaattgtgatatatcctttcctgttcgtaacaaaacttctgcttcggcaccattaccaatcaattcatgcagcaaagcaacctgaatagttaatgcattacagtgtgagcatcatgcacaaagtttctttttattttaggaagcatcattcccgaagttaagaatgctggccaaatgccaacaatttgtgtgttgcactgtaaaaattatgtctacagccatttgcataccacagtaggcacccatcagcaggttggatgtcacattgacatgacagataggcccacatttatttgactacagtggtgtaccagttccattttttcaatcattaaagagtattgcaatggcctttacgccatgtcattattgtacctgcaaaatgctatcaagatagcactggagtacagtccaaggagtaaggaaagaatctcttgttccagttgatctggtagaatctggccaaatttcagttattgttgatccccatgcttcaagtgaaacagagttttgccctccagaacattgagcttccccacttgtaaacttgccaaaa

SEQ ID NO: 64695 - DNA, 780 bp, Oryza sativa
ttgtgaaaacgagtgagtacctctattccaaatagaggttccctacttgccataggaggtgcgcagtcaaactttcaacactttcaaaaaaaacttttcaaaccttaagcactaatagatatcatgttattgtttctcacagtaactaattccaggcagtacattttataatgcttatcaatgtataatgtaaaagaagggtataattgctagcagtgtgtcagagaaccattgcaatatacagaactacatctatattggaatttggaagggaggtagtgagtgagacccatttgacatactgatctatatttctagcagcattggcacattacaaagacataatgacaacattgattgtatttttggatctgaacatactgattcatttactttatggttttacctctgaagctccttgagaagttgatagtgccaagtcgaatatatgccttgctttgacaaagtccccattcatagcctcaattcgtccatatattccacaaagcaaaagatcctacccgaaaaaggtgacatggttcagtttttttttcttatttcaaaagaaaagagcgtcgtgctccaagtatcactgttaagaatatttactgatacatgtagtgcaggtatataaatattaaaaaaatgcacacatggaactgttggaaaagcaagatccaaaataagatgaacgttgaaatactttgagctagttaaatgaaatggatgttattgaattgaagagacatgtctcaatctctgaagaactcagtttgattt

SEQ ID NO: 64696 - DNA, 3327 bp, Oryza sativa
gttcgtttgtaaaattagtttttgcaaaggatcaaattgtcaaaatttgtgttagatcaatatcaaacttccatagcaattgttaaatcactttcctcctatcctatgtctccgtatgcatgcatatgttagaaacatctagccataaaaactgccatcaaagcaatttttaaactagaaaccaccactaacaatagttagacaattgcctatggttaatctcatttattctctcatacgtctcttgcaattcctcctataattaggacagtcctcacaccccatcggcatcctctatcttaagagcgagtgtatcgtccttcttgatccatgttaatcacaggtccagcatcggttaatttcctctactgttttagttttattgattatctatgtaatataggataacttgcctgtttttgttatagtgttcttcccagattgaaaataaatcttaagtgcttcattgcttctactcccttatttctacacacattgcaaattttaagcacatcctttttttatcaagttttcaagcacttcattggtccagtttcaacaaatttgcttattccccaatacacatacaagaacaagttttactaatagacaactcaatcatcatacaaaacaagacacacaaccactttataggatagcaaatatattttttttactatatttgtctttctagatttccaatatatgctacgttagttaaattagtttcaggttacgaagtggtacctactgtctactaacagtattgcaatataagggcccctttgaatcgcaggattgagaaaacgtagaaataggaaaaatataggattttgataggaatgtaagtataaaacagaggattgcaaaacgcagaaaaaatataagaataaccgtttgattgaaccgtaggaaaaatataggaattggatgagagagatagactcaaaagaaagtttaccaagaggttgaacctcttgctaaatttcctgcaaaatctctatagaattgtccattccataggaatttcaaaggattggataggattcaatcaataaagggcttcataggaaattttcctataggtttgaaatcctccgaaattcctatgtttttcctccaaatcaaaggggccataagtttgctttctagaacaagacttgatagcaactacttccagcaaattctgcattttcaaagcttcctccaaatagttgtcttgaagatgattcataaatacaacgcatattgcaacatatatcatgaccagtaccataaccactcaattcacctggttcatatcaatagtttggagggcttcacattacacatgtccattatacctaatttacataagtatatcatatggcttttcagttaaaggaaagcttatgtgaaggcatgttcaagttttgactatttgaagtaattctatactcatgtgacttttaagttccttataatgaagttgagagtttctacacattggatttttttatttacccccacacaaatgtttatacctatatataggtaaaaggaaaaccctcagtgacataatagtacaaagagcctagcctctcatgttttaagtaaaactagacctacacgatcatatgcattattttccttcaattttcaaactaggcattgtcaaagagaactataatcatggtaaaaaataaaataaacaattatcactgttcaatttttttctattttgcaccttcaaaaataattctcctttttttatataaaagtacccaccacaatgcgcggggcattacctagttagctacacttcgatgcctccatcattatctgaatcatttacagaggatgtgtacacaaggcactttgtaatttgcatgttgatccgctctaaattgtactctcggtaaaaaaaaaaacctttttcatagaaaagtccctccgtcctaaaataaaataaagctattttattactccacctttatttaaaatgaagttatttcttcacatgctctctcatctcaaacaatcacaactattttttattttatattttctacctactttttctttctaaccaatcaaaatatttcaccaatcatttttcacatttttaatacttgtgtccacctttagaaatacttacattttatgacgcagggagcaagtcctagccgtagaccttcgtactcaactctattgtagaatgttggggtgtacggcatagtgatcaaaaccaacatttttatggcaaaaaacagcttcaatagaaaaaaagttttaaatctcacatgttggaaggtaaaaggatattgttacatgtgctccaccaagaacaacattgttgggtccttcccaaaattttcattattttagatgtattagattatatcatgcagaccaaagcccttttggcatgtaggatagatctaactttgagccctcggtgttagatgatgcacaaacggtatgttgtttgttgtccaagatagtccaaacgaaaatttttcacctgtacaaactttttccatttgtagaaaccttgaagtcaagatacgaacgttcaattaaaccttcaaacagtaaaacaaattgaaagcatcttttacataatctttcaactcaagtcgctcattttctttagtttgtctgaacttgcaacttcaaaatcatgaacttacaacataaatcactaaaatttatattccaattctaaaactttcaacacaaacgtaattgcccttcagcttgaaaacatgaacattgaacacgaaattaacaaaaaaaaattcctatctggaacaactttcaacttttacaatgttacagccatacatgagcatcggcaccagcatcgacacccgcaaccatgcacatgaagggatggttgatagctagctttcccatccaaacacccaaatacaatgcaacactagctgcattgtgcaggttatcctgtgggagcaaaaagcttgttggtaaggatagactttacgagcaatataagacccctaagggcatggccaacgcagggtaccctaagtgctacctaggatgggccaacactcccaaaaagctaatttcccacagtgcaagggtctattcggctactttgtaccgctgctgcactgccacaaccggagaaacaatatacagtgcttgttggctgaaccacagtgaaaataatggcagccgaacagagcccaagttgcttcaggtggtagtctcatttttttttatttcagcccctggtgtttttcattttagccctcacaattttacaatttatatagaagttcaaattttacactaaacaccccaaaagccagaaatggg

SEQ ID NO: 64697 - DNA, 24278 bp, Oryza sativa
  unsure (1)..(24278): unsure at all n locations
aaacttgctgccttttagaacctccttagttgtctcaatgcttttacttttattactgccatgttaatgatcttgtggctgagtccttctgttttcatggagtgcattgcattaaaaaagatcccgtagatttttcttcatttgttaattatattgccaaaacgtgccttgcacgcgcacgataacatagtcagcttagtagaaagactgcatttttttcaatatttgcaatctggtttattttgagacatggtttgggcttgattattatctcattcttttgctgtactgaaattggttttggatttaattgtggactatgtctgtgtcactacaacatcaggtattggttataattcagctagaggaaagtagagtactttgaagtgtttgaatggttttcacatgtatactctgctagctaccctttagtaagtatattcatgtaaaggggagtaatagatcattgcactaatgttcaaactctattgagattgtcccaggtgtcactttgttcactgaaaaaaaaagagaacatttataggttttttttgctgcttgggagaggatgctgccgaattgaattaagacagccttcagaatctggtatatctaatggtctgtaaaattttacacaagcaacaggagggaccatcaaggtgagtgattatcttatccattcactggcagcgtacattgtcttatatgatgagaatagagttgaaatgtatttgagttcttatttcagtgcttcgtggtcgtcatttgctatgtaaacaattactaaactaataaaacacttaaatgttgcctgtcaattagatttttttaatatgtattaagattagtacgcagcccacacttttgctttctgtggtaggccaagtccatatccttattaggattaggaggaaaactgatgctccatgtgcccaaaatgtgtgtgaactgtacaagttagataataatagatggttggttagctagatccaaaacttgagctttactatggcttggtgccctgttatacaagacgtatatggataatgttttcagtattctgctttgtttgctatcagtatttttagtgcagaaatgcctcaagccactgtataatttgtatatatagtgcaacttggcagttaacaatttcctctttcatgtgattaattttcctgttacaaatttgcttccatatattcgtatccagaatttacttagcctaaagatatcagaaggagaacatatttatggagtgccgatataaatcggtaacccaacattcatgagcaagtaattatcgtgttataaattttatgccacattccagagttttataaccttaaattttatcttattacacacaccggaatcagttttatgagtcacaattcatgccaattgattaggtagattttaagaattaaggatttaaaaaataatgctttaagatgatagaaagagaacatatgctaggtaacccagcattgatataaactgacaacatgctgctgctgagaatatgtgtaacaatgccaaaatctcacatcatattatgtgtaacagggaatgtttcacatgtgatggattttgtatagaaaaaggagattcattgtttgctgaaggtgtattgaaagttgcttgccgataaataaagaccccatggatagatgcaatgatgcattaagctcttgaaggaggattaacggaaaactatgtcgagtttttagtagccttgtttgggctaacgacactcggtttattgttctagatctctgacctaagaatcctgttttagttttttttagatctcttgctttgggtgttgtttgctctaggtgttctgttgtccgcagtttcaggtgctttgtagtgtagtttagtttgggggtgttctcaaggtgttgtacagtgaattggtttcggtgcttgccctttgttgcgttggtgttgtttatgttctctatatcgatgaaagatgttaaagcttttgcctttgtttcgaaaaagattgaaaccacatacaaataaatggttgtgtgaaatgtaacattcatggatgcaaaatttaccactaagttatcaaatccagaatcatggcatgtactaaaatgattaatattatttataaaatcataaaaatgcttcacctgtaagatggcatgttaaaattaacaattgtagataatacagagtatgttttgtacaatttatattggtatatacgtgcattacatgtgcaagattactagtacatttaatatatttatttaatgtatttgtattagcttgcaatagcctcaggcctcagcccttagtaaccgactcgaacccaaaccgactatcgttccttccggctgacttaacaggaaaaggtgcaagagaacttctattggccgttcgacacgcgaaaaccaacccaatggtggcggccaaggtgtcgacccctgccggcggcgcggtgcgcgacgggctccggcggctcacgcagctctcgctcgtctccaaggtctgctcggagctggaggcgcacctcggcgtcggcgaccgcgtcctcgcggagttcatcgtcgacctgggccgcgcatccccttccgtcgcagacttcgacgccaagctcaaggcccacggcgctgacctgccggactacctcgcgcgcaccctccacaccgtcatccacgccatccctacccacgccgacgacgcccccgcccccgccccccaaaaccctgcctcccgtggcaccggtgcaagggtttgcgggaaggacaaggcggaggagcgggtgagagatggggatccggggctgtaccaggtgtgccgcgggaaggtcaccggcctggcggacgccgggtgcttcgtccgcctcgacgacgcgcgcggccgcgaggggctcgtccatgtctccgagatgcccggccgccgaatcgccgtgaagcgtgggcaggaggtgttcgtcaagatcgtgtccgtgcaggggcgcaatctggggctgtcgatgcgggacgtcgaccaggacacggggaaggacctcctaccgttgcagcgtgctaggggggaggatgatgtgccgaggccgatggcgaatccgtggaccgatcgagccgccgccactaggagaaggacgggggtgtcaggaattgtgatccccgaggacaaccagactggcacggcatcgtcgcggcggccgattaggcggatgagctcgccggagaggtgggaaatgaagcagctgattgcttcaggggttctgaatgcgaaggattacccggcgttcgatgatgaggatagcgaggggatgaattaccaggaggaaggtgtggaggaggagcttgagattgagcttaatgaagatgagccagcattcttgcggggacagggtcggtccacaattgatgtgtccccagtgaggatttccacgaaccctgatgggtcgctgagtcgagcggcggttctgcagagtgcgcttatcaaggagtggcgtgatatcaggaacgaggatcaaagagcattggttgactccatcccaaaggatctgaatcggccatgggaggatcctgtgcctgaggtcggtgggcggtatctcgcacaagagctacgcggtgttggattatctgctgaaagcatgccagagtggaagaaagaggcttatgggaagactgtaacatttggtcagacttcaaggctttcaatcctggaacagaggcagagtcttccaatattcaggctgaagaatgagcttatcgaagctgttcgtgacaatcaagttctggttgttattggtgagaccggttcagggaaaacaacccaggttacacagtaccttgctgaggcaggctatattacgagggggaaaattgcatgtactcagcctcgcagggtcgctgcagagtcagttgccaagcgagtatcggaagagtttggttgccgattgggagaggaagttggttactcaatacgttttgatgatcacactggaccagatactgtcattaagtacatgacggatggcatgctccttcgtgaaattttgttggacactgacctctctagttactccgtggtcatgcttgatgaggcacatgagaggactatatatacagacattctctttgccttactcaagaagctaattaggcgtagaactgatctcaagttaatagtcacttccgccactcttgatgcagagaagttctctggatatttcttcgattgtaatatttttacaattcccggaagaacatatcctgtggagatactctattcaaaacagccagagagtgattacatgcatgctgcgctgctcacagtatcacagatccatctgactgaacctgaaggtgatatcctcttgttcttaactggccaggaagagattgatcatgcctgtcagtgtctctatgagaggatgaagtctctaggtaggaatgtaccagaattgctgatatatgcagtgtacagtgctcagccagctgaaatgcagtcaaagatctttgaacctactcctcctgggaagaggaaagtggtcgtggccactaacatagcggaagcatctattacaatagatgggatatattatgtaattgacccaggatttgcaaaactcaatgtgtataacccaaaacaagggctggattcactgatcatcacaccgatatctcaagcatcagctaaacagagggcagggcgtgctggacgtacaggcccaggaaagtgttatcgtctatacactgaaagtgcctatcgcaacgaaatgccccccacaactactccagaaattcagaggatcaacttgggggagacggtcctcaatatgaaggcaatgggaataaacgatctactgtcatttgacttcatggaccccccagctcctcaatcactcataactgcaatggaacaactgtacaaccttggtgccttagatgaggagggtctccttacaagagtagggagaaggatggcggagtttccacaagaaccaccactttcaaagatgctccttgctagtgtggacctcggatgcagtgatgaaatactgaccatcattgcgatgattcaaactgggaacatattctaccggccaagggaaaaacaagctcaagccgatcggaaaaggggcaactttttccaaccagaaggggatcacctcaccctgctcaccgtgtatcaggcgtggaaggcaaagcagttttcaggtccatggtgctatgagaattttgtccagctaacatccctgaggagagcacaggatgtcagaaaacagctccttgagattatggacaagtataagcttaacgttgtctctgcagggaatgatctcaccaaggtgaggaaagccatcactgctggcttcttcttccacgctgccaggaaggatccccagggaggatacaggaccattgctgatcatcagcaggtgtatatccaccctgccagcgctctcttccagcagcaaccagagtgggttatctatcatgaagtcgtcatgaccacaaaagagtacatgagggaggtgacagccattgacccaagatggcttgttgaactggcaccgaggttctacagatctgcagacccaacgaagatcagtaagcggaagcgccaagaaaggattgagcctctgtatgacagatacaacgagccaaactcatggcgcctcagcaagcgccgagggtaatttgtctgtatatagtttttacttccactatagctgctctttatgcaatgtaagctgagtacttgtatgtaagtgtaaatatactctgctgataagttccaatacatattgggatattaagcttgaccatcttgtttctcttttcatttaggaagcagatgctgaatgaggttgacaattttgactgtttctatattagttgatcctgaaacattactatctttcgcttatgtttcgtgaaacttgctctttatttcatctcgaaaatttacacattgaactgttctgttcggggttgtcgagcccagcaatcgttgaagccttttttcttcagcgtatatagtgatttcctatcaagcagggtttgtaattttgaaagtaggatttctaccgcaggtgggcgatagaactgaaattttggaaatttcagattttttttttcgtacgaaattttttgaaattttgactgattttgaatgtatctgaataaaatttgatcaaattcacaaaaaattacaaaaaaaccgaaagtttcggacaagatatgagcatttcggtgggggcgaaatttccgaaatttcgaaccgaaatttcaaaccctgctatcaagcgccgaaatttggctccgtagccagaaagggaataaatttttcacacaacgaaatgataggcggtattgattatggaggtcataaaaacagaacgatgaacttttatcgctgcagagcattataggaacttttatcgctgcagagcattataggataatttgtattcgatgttcttttcagcactacaaatccgcacaacctttgctgtttcagtctgttggtatcacagctgaaaacttaggcattctccagattaatttcctgccaaaagaaatgttttacaacctttgaatatgctgtttcagttttttgctaacatcacagctgaaaagatttctccatattaatttcccgccaaaaggaatgttttccatatttcagcagttgctagtgacctcaaaagagtgaaggaatacgctttaactatctaatcagctttcctattctgcaaaaaaatgaacccaggcttccaggcatgcaactatatgcagttcctattatgcctctgttttcgggttatagatcgtcccaggcgaagccgtcgtgccgtgagagcatcaagcaagacatccaatgaacactccacagcttcagcctgctttcccagctcaaaggcaccgagctcggaccgcatatccaattcccagaggaggccagaagctgctgctgcggtgcacgtacgatcccacgctggctgcggtctaatatgagagcaatgtcaacagaagtgagttgcaggcagccaaagaagaaaattgtttaaagcaataatgtaggaagaacttgtgtcacctcaccttagcttatgcatgactgaggcgctaagcgtagacagtgagatacaaggtatgtcttcctctccccatattgcagtccatctctcctgtataaaacgttaacattagggtttacttagctgaacaaactggatgtagttgtgttccgttttatctacttgttgcataagcattagagctttgaggaataaagagttcccaaatgctgagatgacaacaaattatcgctgtctaaagatattaggacaattggctgagacttaaatggaagtgaccgaaatcagagtcaagcatcagagtcaaaagaaacctgcctgataaaggtgctcatgttgtacaatcaagtagtccaccaatggacctgtttggggtggctactggctagtgcttcctcaatcctcagaagcttccttttggttgtctgcccttaggaacctttagaagccaagctagaaacccatccatttttggtctgagctagcttctttttgttcatttatagtgctcgcttgccttaaactttcttttgtagtaattcacttgatgtattaagtttggtgatgagttgatcgcacgagaatattgttttctttttgacaaaattaaaaagtgaaacatcaatggtgcagaatcactatcaaaacaacaatgaaatatcatttgatttcatctacaaattgcaaacacatctgcaaaagaaccattcatgttgagtggtttgatctgtgctcacagacccaataattcttcctttatttgataaagggatcatggccatttttttttctaccagcacaatttaccaaatcaatcaaaaaatctctgcaagtcatcgcataagaaaatatctacttctaataccacccatttgcatcagtttctggtttggagaaaatacagtttggaacccagccaaaaaggcccttgccattgaagacaattaaaatttctcctttggaaaaaagcaaattagatcattaatctcaatctttcttttgtggccaagatgatacaagcccaaacctgttctatactgtgaatgggatctggaatttgtcttgagatttcgagtaatggtgcagggtgctggactttgtgatcttatcaagaatacttttcaaatctaagtgggaaaaagtacgaattacccccctgaactatcgtgacagtacgaattatccccccgaaccacaaaaccggacattttacaccctaaactttctaaaccggataaattacccccctaatacaaactggagtggttttacatctatgtggcgtccacgtggcaatccgatcagaaaaaaataataaaaataattaatgggcccacgtgtcatctcttcacactgtctctatctctctcagatgctcaatacgaggcgagtggagtgcgtgtcctactcatccacgtaaccacatgctccaattccatctcaaggatcaagcaatcccggacgccgccgatggcctcgcgctcgcggtggtagtcgctggcggcgagcgcgctgatccagtgctttgcggggagctcctactgcttcgccgtctactcctcggcactcaaggcctcccaattctacggccagtccgccctcaacaaggtcgccttcttcaaggacgtcggcgccaacgccggcgccacctcgtctgggcagccggcggcggtggcggaccaggcagccataggtggaggcggcaggcagccggcagcggaggcggacagcggccacactccacctcgacgccgtcgacgccgttctgcgtcaccacggcgaggaagctcgtgtcctggtgcgcagggagccccagcctcccgccgacctccaccccactgccaggcgccacgtactccgacagccgaagcatgaacgccatcgccgctgcctgcgcctccccggcctccgccgacgttgcaccgccacctccagcgcctccaccgtcgcaccatccgccgcaccgcagcctccaccgctgtcagcttctccgtgtacgcgagcaccgcctcctccgggaacacggtggccggccacatccaggcggcgaaggcgcggacggcgtcgggggagagcgggtcagcgatggccaggctctcgtagggcaggccggggatgttgccgacgtagcccatgacgagctccacggagacgtgcgccgcggcgccgacgcggccctttctacgactcccgcaaccatctccccactgtcaggagccgcggcggcgagccgatgcgcgagtggtcgtgaggaggcagtcgcatgaacgggaccatgccggcgcctagtcggccttcgcctccgtcgtcggccgccattgcctacctgcggagccgcctgcctgagcgtgcacacgggagagagaggggtatgacaggtgggaccaaggaaggcatttttatttttatttgctgactggattgccacgtagacgccacgtgtgcaaactcaagtgaaaaccgctcaaaactgtgttgaggggggtaattcgtccggtattaaaagttgggggtgagtaatgtctggtttttgggttcaggggggtaattcgattgaccgcgatagttcagggggtaattcgtactttttccaatgataaaacagagttagcgaaaactcaagcaatgatatttcttaggaattactaattatcctaaaactttcaagaatattaatatgtattaggtatgtgatatactttgttatcattttattcaaatatgggtatactgtctacagattatctggatatattattccaatataggtatgttgtctaggcatttttaggataaaaattaagagtaattggttttttctaattgccaatgaggttttttattttcaaatatttcttatctttatattataatgtactcttactgataatacatgtaattggacttggctactagtatgcatcacattacaacacgtcgaggaaataacaaccttcacatttgcttgaataaaaagttagtcctctctaatcgtattgtaatcaatcatcaaaatcattaggggcctagatgcacttccaatctctccatttttgctgattgatgacaatacgattagatcacaagagagaatgaatataatagatgattttggtgcaaaggtttagtgaaagctccccctcaaagtgtgcattaaagcaagtgaagagctccccgtaaatctttgcatccacattgaatctcacaagacaacaaatatatcacattttactcatcacatacatcacttcatatgcataataaccattacatctcatcacaagcacaatataaaggaaatgagacattgcatcacattaatcataaagcataataatatccattacattccaaacatccataattaaacaataaggtcttacaataacattaaactaactcaagaaccacacatagtcttatacaaagaaaaaccaactatgatcgaccataataaaaggatagatattctccctttttggcatcgaagcaccaaaaagagaggacgaagagagaaactcagacaaacggcgcctgggaggatcctcaagaggaggatagcgaaagccatggccaaaattgaagaaatcgtaatccggaggcatcccagcaaaaggatcctcgatctcttcctacccatgctcatcgggctcggcctcaaagcccgaaggggagggagagacatccacgtgaaaatgctcattgagctgcgcctacatgttcttgacgcgccgagccgtcttcttgacctcgttccacgctctgcggttctttttggcctccgcagagcaaaggccaaagagactcagcaaaatgcggaataagggagactgctcacaacgagccacaagagagggacgctcacgaggtagtaggaggctgagaggatgtggaggggatgtcctgaggcacagaacaacgcttgggtaagcgcagggagagagatgtatgtggctcctcacatacaaactgaatctgagagacgtgctcaatcatccgcatcaggtgaggagcatatggaagccccctcctgtactgaagagatgccatgaccgcatcttgaggcggactctgactcccaaggatggtgatgcaaacaacatcaaccattactcccgctccgtactcctcaggttcaatcctccctgtcgtcccttttcatgtatttcaatttgtttgggaggaaatccgcatggcatctcttcagtacaggagggggcttccatatgctcctcacctgatgcggatgattgagcacgtctctcagattcagtttgtatgtgaggagccacatacatctctctccatgcgcgcagggccggtcctgagttttcagggccccagtgcgaaactaaatgttggggcccttaacatactactacaaaacaaacaattaagcgctaatgcccgcgacgccatgcgtcgagatgacctacatatgtttatgttttgatatcgagagattagacagcagtaattaaattaataattgggctacggagatggtgtattggtgtgctgattactaaccttccgaggggaaggcaggcgatggaggcttaggagatgccgagcagcagcgacgcagtagattgcgtcgtcgctgagcagctggcagcagcaaccagggagattgcgtcggtgccgagcagctggtgatggccatggagtgaattacgttggcaccggccgccggcgacacgcgatgcagttttgatttttggcttttcgccaattcgccatcgcccggtcgccgatcgctgagcgcgtgcgcgtgaagagtagaggaggggatgtgggcggcggctatcacgcgcgtttctgttttcttttcaccgcggggcgcttcgctttccggcttccgcgcatgcatgcgctcaagaaacaaacaccaggcgagcccggacgggagcgcgggtcggggacgtcgatcggggcccctgcaatctgggggcccagatcggcggcaccgctcgccccccgccagggccggccctgcatgcgcagctgcccactgctccgcccgctcacgagctgcctccctcgtcagctcatcatcggtgtgtcgnaggcggagacagagctattggtgctactgtcgcgcanagccttgagctctgccgccgccgcacgcgctgcatctgccgctgccgctgcttccacttctacccttgccgccgccaattccgccgccaccagccttgatgctctcgctaccatcgcagaagtctctgccgccgctcgctcgtgttcccctaccgcggcgagctcggcctcctgccggagccgcgcgctcgaggcgaccgagcgctgagactgtcctacggacatggcacgctactgggaggctgctacgtggggaagaggctgcctctgatgagctgctgcttgtcagcacaggggaaaagggatgagcaggaacagtcggtgttcctgctgccggctgaggacagaggggagctcaagaaggggatgagcaagagatgtctaggctacaggatagaatggctctgataccacttgttagtagcaaaatctttactctcattgagaggatggcgctaggagagttggggcaattttctgtttattttctcatgaatgccataccatctcgggggagggtgggatacatatttatagctggtagctggctggctgcagctagtctagagcatcctagagctagtctagatgctgtcctagaaagtgaaaaaggaagatgctgtcctagagcatctaaaacagaaagtgaaaacgaagattatgcctagagcatcctaaaagctgaaaaagtaaaaagatgcaaagactaatcagccacaagacttattccatcaaaccataaggttgaccttagagatggtcagagtcaagatgtgctataaggatcaacagcgtactccctccgtttcaaattatttgtcgtttcaaggtttgtcctaagtcaaacatgtctatctttgaccattaatttttagaaaattgtgtagtttaacatgtgaattatatattatagaagtatttctcatggtgaatctaaaaatataaatcttataatgttaaactatactccctccattccataatataaggcagaaccacttttcttagatgttccataatataaggcatgcatgcaagcatgcaattaactatgacatatctctattaaattactacttttttaaaatattccactctctatgttatctaatcctatcggatgcatgcattatatttattaggatgatctaaactataagatgataataattattttttggtctttgggttaatggtggttgtgccttatattttggaatggagggagtatgagtttatagaaattgatggtcaaagattaaaatgtttgacttagtacaaatatagaacaagtaatttgaaacagagggagtaccatatttgttttcaattctgcttcgctttcatcagccttattatgagtttgccaaagggcagcctcatattcaatatactctcctcccttgaagattgtcttatgttgatgcaagagtaaggatagatgtcttattcttcagtgttgacatagaatggctgtagaccctcttctctcttgtagttagccttatttattccaattcctaatctataccataaatcaaagcccttttagcgcaaggttctctcctccgaatacaattctcactaataggagtaactatatgccaatgtgccaataattgtagaagactttattattatcctaaataggcggcaataggcccatcaagaaaaagtctgactaataaatagtaatatagctagttgccacacatagacttgaggtaagggcttactcatcctagtcttctctttagtacactacttagttataagttataggatcagaatgagattttctttgaacgccgttatggggagtgagaaagcaagctagacacgaaaactcaggatagacaaaggaaaactcgggatagatgcgctgcttttctagctttggttggaaatagaaaagtaagttatagggcccatgcggcattccctcaaatagcagtttttttttgtctgaagaaaagttgctattaataacagtcttccctctttcataaggctctaaggctgagttcgggagcgagggttgggaaccttcactcccaacacgcaaaacggagcgacgatcagtgcatgatttattaagtattagctaaaataaacttgaaaaatggattaatatgattttttaaagcaactttcctgtagaattttttttttcaaaatacgcaccgtttagtagtttgggaagcgtgtgcgcggaaaacgagagagttgagttgggaaaggttggggaagaacacagcctaacttgtgtatggaatcagggagctacagttgtttcccgccccttctgttcggatcagatactattctctacggaaattgaaagaattctttgataagataaaaaaaattaattcaccatggtaatatctcataaccctgttatgttcaagtgtactataataagaatttcaataaaaaagattgaagcccacataattgtgtgtcagtgtcactctatgtacttggcagtattatgactccctactacagtgaaaaaacagtatattccaaaagtgatcttgatctggagaatgaagatggtgaacaattatattctatctacaaaagatctctttccaggtttcctttctgttttgtttcccttcaatcttcatgcttcaattatttgttattaagttaccaagttttccactctttctttaattatgattcctgatgactatggatggaataatttcatgggaagaattaattccaaaagaggaagtgaagtcggggcaaatgaggaaaacgtcctacagcttcgtcattgggcttctcttagagggcagacactttgtagaacaggtagtttgatcataccatctgccttatcttatcaaataaggatgatttggctgactccctgttatatttgttttctttttccgtgaatcatgatgtagcatcaagcgttccttgacatggttttttaatctagtaagcctcttcagattccaggtggagcattatttttagttccttcaaaaatagtcctgaatctggaagactttacctagctaatagtggactgagttttcaattatgaagcaagcatggatgagggggaatagtgcaattcaagaagctatgggatctcagtcaattgtgcagctagatcttttgatgaccttagccaagactgaactagcaagaggtttcagaagcaccctgggggatttcataatcatgacgcttcagctctgttcagtgttcttcactttctaccttgggaccaagtcacattattttcgacacacaattctccatggtggtgcaaaatatagagcaactggcagatgtttttttgttcgccatgtaaggttgactgagaaatacagaatgtacttcagaagccactttgtgaaaggacttgagctgatgttgctgctagtagtctatcagttttaaggtgatgttgctacggattcatctgcctatatacttctgacatcatcaatatagctcttggttatcacttggctcttcaatccatcaggatttgattggcagaaaatggtagatgactggaatgactggaccaagtggattagcagtcgaagtggcattggggttcctgctaacaaagcttaggaatcctgatgggaggagaagcagaaacatttacagtctacaggtctactgggctgtttctgggagatcatactatctctcagattcttcatgctccaatactgtatgtctgtatcatgtatcactgaacaaatgcacctagacacatatgttgctactttccagacacacaaaaatcagaattacttacttaactaggtaatgagcccacccaactacctatatggaaatcggaattatctataatttaattacgcaatgagctcactggagctttcagttgttttagtaaactatctagtctgaatcatggtatcaagataacatgaacaaataatgtttagatgtaaacagaaatccagactaaagagggagtgcattacgttgaatgtgaaactcactgaactaaccttgagccttctgtataatgcagcagaattactccatgtaccatcaagcaaaacaaagttaaaaggttcatctttcacatcctacattgcaaaagatatttcattatttcatccatacttatttacatgatgttttagagtgtgcagcgaacctatttggatgtgccatgtgcagatgacattgtgtagatgtctcataaaggtaatctttgagaacttataactagaaaaaggaatggtcaaatgggtgtgggtaattgatatcttattgatgtcttaaaatgagaagtaagaaagcatggaggaagtaccatgttacttctacaagaaaatacttgttctaactgcattagcatgggaaaccagttaccccaaacaccatcagtacttatcatgttggataaaaggaggtgattggaaaaacagatcctccaaagaaggcagcattgtttatgctatagaaactttactaaagataggtgtgttggataagtctttgtggtccttggtcgtgattcttctttttgcttttgggtagtttcacctttttcaggacagcatctaccctttagcatatttttcagttgctaggacagctgcggttagtaggacagcagcagttagtatctcctttatgcctcctttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacatctggtatcagagccacactttcctataggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcagcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgggcagagcggtgggcagcagcccacctccacggcggtggcggcggcccaagggaccgcgcgcccgccgacgggaacccagacgggcgcgggcgtgccggcggcagcccggagcccacacgtggccctcacagacagcgcggctctcccctgaccggcgccatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcaggcactggatgccctcatcgctgcagtcccgcccgagatgcagttctcgctttcccagaagcggactgccaaggaggcctgggacgccatcactacggcacgcatcgacagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgatcgaatctctgctggacctctccacaatgtcgatcgaggaggcgttaggtcgcctcaaggtcgtcgatggtgatgagccacagcctctctcggggcccatcaccatcggcgggaagctccatctcactcgggagcagtgggaggcctctcagggtgacgggaggaagagggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagcaggcacgagacgacgcctgccgcaactgtggcaagcttggccattgggccaaagactatcgacagccacgacgcggccaggcccacgtcgcacaggtggaagaggaagagccggctctgctcctggctcacgcaagcatcgagctacctccagcggcaccggccgcagcggctttcctccaccttgatgagccgaaggtactcgtctccctctgcaacggctccagcaacgacaaggctgatgagtggtacctcgacaccggcgccacccatcacatgaccagccgacgggagttcttcaccgagttcgactccggcgtccgaggctccgtcaagttcggggacgcctccggcgtggagatcaagggtgttggctccgtcaccttcaccgccaagtccggtgagcacaggctgctcaccggaatctactacatccccgcattgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtttgcgtggtgacgaagcagcggcggctcccctttccccagcagacgagcttccgagccaaggagtggctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgttgtcgagcggcgcaaccagacggttgtggggatggctcgggccctcctcaagcagagggggatgccggccatcttctggggggaggcggtggtgacggcagcctacatcctcaaccgctcgcctaccaaggccctcgatggcaggacaccgtacgaggcttggcatgggcgcaagccggcggtctcccatctgcgggtcttcggctgcctcgcgttcgccaaggagcttggccacatcggcaagctcgacgacaggagcaccccaggggtgttcatcggctacgcggagggctcgaaggcctaccgtatcctcgaccccggagacacagcgtgtgcgcactgcacgcgacgttgtgttcgacgaagggcgagggtgggtatgggacaaggcggtggacgatggttcgactccgacgtacgacgacttcaccgtcgagtacatccacttcgagggagctgggggagtaggcagctcttcttcaccgagcgtgtctaccccagccctcgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccagtggagttcgctactccgctctcccacgacagggagcgcatcgacgcgtaccacgacggcgagcagctacggtaccgtacgatggaggatcttctcggcgaccaaccggtgccaggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgagcgatcacccttaagtgggtgttcaagctgaagagggatgaagccggagccatcgtcaagcacaaggctcgcttggtggcacgcggtttcgtgcagcaggaggggatcgactacgatgatgccttcgctcccgtggcacggatggagtccgtgcgactccttcttgcgctggctgctcaggaaggctggggcgtccatcacatggacgtcaagtcggcgtttctgaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatggcttcgagcaaagcccgcacgaggcggccatctactggcggggcaatggaggaaatgccttgctggtgggtgtctacgtcgacgacttggtgatcaccggcaccaaggatgcggaggtcgcggcgttcaagtgaggagatgaaggccaccttccagatgagtgatctggggcctctctccttctacctggggatcgaagtgcaccaggacgactccgggatcacgcttcgacagaccgcctacgccaagcgcgtcgttgagctgcctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcaatcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcaagtgcctcgttagctggcagtcagtcaagcagcaggtggtggccctgtccagttgcgaggccgagtacatggcggcctccgccgcttcgacccaggcgctctagcttgctcgactgcttagtgttctcctcggcagagacactggaacggtggagctcagggtggatagcaagtccgctctggccctggcaaagaaccccgtttttcacgaacggagcaagcacatccgggtgaggtaccacttcatccaaagctacttggaggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgttggaaaagtctttgtggtccttggttgtgattcttctttttgcttttgggtagtttcacctttttcaggacagcatctaccctttagcatatttttcagttgctaggacagctgcggttagtaggacagcagcagttagcatctcctttatgcctcttttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacagggtgtgcaacagtgcaacttattaatacacagcttaaagaacagaataaatacctcctccggatgatcacaactcaagttcaaaccatcaaatttaagatctttgacagacatgggggttgtactcttattcggatatagaaatgaaacctttccctttcctggcaaaaaccatatcagaatggaaatatacagtatttaaacatgaagtgcacagatacatatatccttgctaaatatagcagggagagtagagatattagacgacaaattaatgaaataatcttccatgggccacaagaaaattaattcaaatcttatttctattactagttcatacatttttacttctggtttggatttgtttctgtgaaacactaccctagttgttcaatgcgccaacaggttcaaaacagcagccacgaagacaacttccaatatgcaacagtatattcatttatgcaatgattaaaatagaaggatagaatgcaaacagaaaaggaacatcgataatgcaaatattttcagtactagcaatgcattgatgaaataacaaagaaaagatcccctggtcattagattgtcagtaaatgtggacatttttaagctccttctaaattaaaaatgccactcaatatgtgaagagggttgggacaggaatacacttatctagacactagcacagagaattccaaacgagcaaatataatcttttactaagcatttgcatttctaaagaaaggtatgttgcagtgtaatcactagcataatttgtgtagttcgcactaattccctgccccttccaagaagaatacttaacagcagttgagagtctaaaggccagttatgtttccagatcataaacaagagcttaaactttaaacacatcgggagagattgtgtgcgccaaagaagcttaagagaaaaaaaacgttgaacaagcatgctaagtgaagctaatgtaaactactatacagaaaatgggagctcctgaaagcattagtatacttttttaatgtaactgatttcatatgtttaacagatgaaagttggcattgacttttgtaacaacctgaacgctggaaagcatcccacataatgtcttcgtgctcttggatgccaaagagacacaagggtgcagcttggatgccaaatacttgccatagtaactttccggtattgttttggcgcaaaaagtcctgcaacaatagagtattagagatactggcatacccagaagaaagaacagaacaagaaattcaacataaacccctttgaagagaccttcggatgcatatatagccagaatctaattccctgccatagattgcaagaaccaagcttcgcacacatacaatcttccattggcagccaacactgtagttttaagaggtaggcagatcaggcaaactgtgggaaatgaagaagagcaaagaaagggcacataaatgttagtagcaaaaataagcttcagttgaataaaccattaaggcctgattgctgcattgtgtatgatcgctgcaaaaagaagtgattgacaagatgtgcatatactagctgacactgtcacatcaccttctggcacagatatcctctactccctagcaagcggcaagcaatctgccgcgcggagaagtactgcagcttcttgtccgagtcggcgagcgtctggtagacagccctgtgcttcttgtcctccatgtctttgaaatcaccctatgagtaaccagttcaagaaacaagcaaaccatgagccgatatcagtttcaattcctgcaatgctgtatcacctcgggaatctgcaagcagctnccaggacgtggaagggg

SEQ ID NO: 64698 - DNA, 48530 bp, Oryza sativa
  unsure (1)..(48530): unsure at all n locations
gggagggggagggaagcggcgatggaggaaggcgagggcacgcacggaggagggagaaaccagcatctccgcccgctgtattttttaatgctcttcggatcggccagcaggcggcggcggcagcagcagcagcgcaactgtcgactccactagtcaggattccacttttccattctatgaaaggcaaagcaatatccttcttttgatttggagaaaaacataaaaattatagagaattttaatcttatagaaaaaaaatttataaatgtctttaaatcaaatgattgaattatattcaattctttaaaattcctatgggatagacaatcctacagagatttcatagaaaacttagcgagagcttaaacctcttggaaaatttccttcgaatctatctctctcatctggttcctgtattttttctatggtccaatcaaacggttattcctgtgtttttcccgttattttacaattctctgttttacactttcattcatgttagaatcatatgtttttcctattcctccgttttttcatttttgcaattcaaatgagccttaagaatatttggtctacttatcactattttaatattactcaacatcaaatattattgatcggaagaattgttcttatcctcaacattcatcacggtcaataatatctcatgatattagcaattactccatctatactaaaataactcaatctagatgtgacatatccttattcaaaattgttatagcgtgatacttcgtatctccaacccattatagcttttgttgttttggaacaaggaagtaaggtcatgtttagttcccacgcaaaaatatttcaccatgtcatatcgaatatttggacgcatgtatggagtattaaatatagacaaaaaaaactaattacacaaattgcgtgtaaattgcgagacaaattttttaagcctaactacgtcatgatttgataatgtggtgctacagtaaacatttgctaatgacggattaattaggtttaataatttcatctcgcagtttacatgtagaatctatgatttgttttgttattagactatgtttaataattcaaatgtgtgtccgtatatccgatgtaatacgccaaaaatttcacccctaaactaaaaagggcctaaatcgtttgtaattggtctgagtcatggtttaaagcattcaatctaaaccgaaattgttggtttggcttctctagcactacctccatccaagaatataacatttttagttatgaatctgaacaagtgcaaatccagatttagagttaaaagttacttcctccgtttcatattataagactttctagcattgcccacattaatatagatattaatgaatctagactccatttcatattataagactttctagcattacccatattcatatagatgttaatgaatctagacaacatctatatgaatatgggtaatgctagaaagtcttataatatgaaacggagggaagggagtactactatattttaggacttttgaatggaggtaaggttgagaagtagtttaccccgagacgtagtcaggagcgaccgcttaaccaactaacctagggaactaggtggcaaagctaagactaaggtctggttcgatctaagatgtccggctaaacaaaactgtgacatagaaaacacggccagtaattaatacatgattaattaagtattaattattatcaattttaaaatacattaatttgattttcaaataaattttgatatatatttttttaagaaaagcgttgtttagcatatcaggaggcatgttcacaaatcacagtaaacaaagtagtagattccaaatagcacaaacaaattgatcctaagagctaaattggaaaagttatacatagccacaaccaaacaataattgttcaacttgctagttgtagctaattaacctaagcttttaattgttagacattgtttaacccatttagagccttgaaatctgttaatgttaatatatgaattggctaaatgaattaatatccaactctactcgagccaaaccagtctttctcgtccttatagaatagcacatacaaaatattatatcatcatcaaatatccagcgatatctacttgcgtgttgcacgtacctataagaataagtcggtagatgttttttttaccacctttattcatcacctactatattattgatgcactagtcatcaatatcatcatgtcgatatgcaaccaaccaaccaaattcaacatgcctactaacttaagttataaaattaataaaaataggttgcgattcctctctctgtgttatattaaacatgttttttttgctagttcacatatacatatatttggtgtttttttagataatggaaatggattacatctccggtttctgtcataagacacacaacagtaaatttgttaagaaaaagataaatataaaaataaataaataatgagaaataaggtgatgggacaaatccccaactcccctttattattgactagcgttaaactatatagattttttagctagaattctaatggaacaatgccacttatagtggaataagagacccttggctaccgactttaatagtgtagcatcattgcgcatagtatcctactccttagcaatttgtgctttccatcaatcacacaaaagatctttttatcacgactgacatgcatttttttaactgattttttcacccgcaagtacttttatttcccaagaaatatgtgctaatggaatgcccatcaccaatagcctatttactccctttatggaacttatataaaattaagataacctagtgcaacttactattacgatttgctatgaattaccctatgcgaggttggaaaaataggcaatatatttagtgaataataagcctattccgtgcagcaccactaccatctgtagtttgaaatcaaaaggatgtacaaaaaatatccttttgtttgtaagctttgctctattgaatgcctgctacttgcttgattttctctttgatcataaaatttgacgtttatgataaaatttgattaaatttttgaaaactccgactgtaaataatttctataatgcttagttttttaaaaaaaagtactttagatttttcctcgaaagtactatcatagtattttgaacctaatagattttataaacttttaaatataacattgatgatcataaatgtcaaatatttctaatcaaatagaggaccatgtaaaagacttgcataaaattaaatcaaaacaaaaaaaacacataaatgaaaattgaaggagcgacaaaatcttcggtatttacacaagtacctaggagctgtttggttgggtcgtttttggcccgtatcagttcccaccgtgaatagatctcgttacactcgtttgtttcagatggaccgtaatcggatagcccgtaaacgaattccggcccaatacaaatctgattacgctcctagacgggcggaatgtgataccgatatggagaggagagcgtgacctagcaccgccaaatcgagcgccaccgccactactccctcgcagcgcacgcgtcgccggcgccgccccaacaccccgcgtctgttgccgacgtcgccccctcgccccgcgcccgtcgccagcgccgccccctcccactgcacgctccactgctcccccgtctcgtgcgctcctccaccaccgcttggccaagccggcgcgtcggtgctccccacatccaggagttccgcctccagagtccctcctgccccgtccaacgtgcgttgccacctccccggagttccaccttcttggcgattggatcttgacgggaagaactccatggaaaatggatcttgacgggaagggcaaggacgtgcagcaggaggctagtcggagattctgctgccatcaactacattcgtctttcgtcgttgccgctgtcgaacgatcacctcgccagtgagaaccctccccctactgaaaccaccttattttatggtgatatacttgtgatgctggtgagtgatgatcttgtaatagtcttctaaaaaatcatgtagtagtttatacaagtaaatcacatgtgttcctgcctcatatctgtttgcctcacatgggttatgtagaatctatttgcctcgattgcatgaaagttgaacatcagtacatggttcttttttttttgagtgtagggaagttggaccaactcattttactatctagattttgagaattttgatttttattactgccaggtgatatattattttgcacaatatcagattggggaaaaaagttttgcgtattgcctgtttgacagaatatattccagtagttaaatatgttctagtaaaacagcacatacatgtaaatatgctccttgaatggatgcttgatattgtgttctggtgaattacttatgtttagcaacaaaaataaatttgtactgtcttttgtttgaatggtagcttgatgtattatgcatgctagcaggatatattctggacatagggttaatgcttttgttttatgtatttgtagagtgctatggctcgccttcccttaagtaccaaaacgcggagaagcaatggctgaggaggaccaactacaaaaatttcacaacgaagctattcttgagtgtcaaaagcttggattgactggtattgaagttgtcaatgttgcagctgcttttgtaaaagtgccggctcaaatgagtatgcttgtcgctctttcagagtctctcaggagggagtacgtgctaaaaatacttgctggtaattcacttgatcactcttgtagcgttgcaactgcaacaggcaacatatttattttgagatcattaattgtaagcatattgctctttaccacttagcatttcatatatgcattcatattatttgccttgcactagtataatgcatcaatgggcccagctgtccatctcaatgctatagtaatatcatattcacttctaactggagtatgtgcttggtcttgcttacttgcatacacctaacagggagtttttgtactcctaaagttaaaaaatgctacctatttctgaatatcatatatggcttgtatgagcaagaatattcttaatttggtatgatgctgagcactatatatattctttcacctaatgtttctttcactaatttctgaaattttttgttatcagatgaggcaaagaaaaattgatgtactgatgtgctggctgtcaagcaggatatacaagatgttcattatctgttctttaattattagaattccatataagcgtatgccttggggattagagactacctatgtcctaaggatgtttagtttcagtgcttcagctttatttgcttgaaccatgacagtctacatattctgtgatcaaagtactgtcctgttttcagatagaagtattgcccctagcttattgtttaatctggtagtttcatccatatatttcctcagtactttatttagacagatcacaatgtatcctcttgttgtttggttcattgaacttctgaagttatcacttccagcatggatcaacttttcatccactcctttgttgattaaattttgaaagtagagtaaagtccatcaccggtccctaaacttgtaccgttgtgtcatcccggtccctaaactcgcaaatcgaccgttcaggtcctcaaacttgttcaactgtgtcaccccggtccctaaacttgcacatcactcgtttagatcctccagcttattcagttgtgtcaccccggtccctaaacttagatttgaatatcatctgggtcaaataagacagtctagagactttatatttaaaaataattcataaatttttcatgtgaactctaataaagacaaactttatatcaaacttgtagccctcgacgcgatctacaactttgtagttgagttttttttattttaagtcattttttgtcccaaaatgtaattttaaaattaaaatttcaaaatatataaacatgcaacaatattttgggacctaaacagttttaattcaaaaacttttcaactacaaagttgtaagtcgcgtcgaaggctacaattttgatataaagtttgtcttcattagaattcacatgaaaaagttataaattattttttgatataaagtttttagactgtcttgtttagggaccggggtgacacaagtaaacaagttggaggacctaaacaagtgatctgcaagtttagaggccgggatgatatagttaaacaagtttgaggacctgaacggtcgatttgcgagtttagggaccaggatgacacagcggtacaagtttagggaccggtgatggactttactcttaaaagtatatcactgattaaattctgcagaatatgtctttttgtctcgagttctcactgtcaaaatttgtatccaaacatgaggtgacggtgttttgcatattatgaactatctgtcaaaactctgctcgttgcatgcatttgctttgtatttgcttcttgtgtccgtctcagcttcaactagcagctcactgaatctattacctagcggctagcgtgcagccgcgcatccaaacagcgtgagtgactccggatgtgttaccgcaacaaaccaaacaaagtacttatctgttacaatggtatcgattacggacggaaccactcccattaacattagcgttaccttgatctaaccaaacaccaccctagtaagtaaagataacttaattgatgacgactaaccttatcactaccaattttataaaagacgtggctaacaattaattaccataaatgtaataatgtttggttaaacctatagcgtaagacacacgtaaaatagtttataaattatgacttattattataaaccctattataataataatctactgcacatacaaaaatcaacacaaatgagatgaatctgagagaacaaaattgggctgctacaaatccctcctttgacacgtaccgcacactttttgagtctgagaaggtgttggtggcctacctagagcagtgagcacacacgctcacctcctcactctccgatccatggcgccctcccccttgtcgctctaaaccctaatccgaaccgagcaatcaaaccaaaatcgaacgaattcgaggacgagggtggggagccctcgaatccggcaatggatcgcccgcgctcctccaagcgcggctaccactacgaccaggactcgccgccgccccgctccaagccacgcttcgaccgccgcggcggccccaaccctaacaacagctaccaccgccgcggcccccccggtggcggcggcggcgaccgccgtggcggcttccagctgccacccgacgccgccccgcccccgcccccacccccgccgccttcctccgcggcggcggggggcggggggcccggcatgaccacctccttccgcatcctgtgcccgcagtccaaggtctacggcttcccgcccagcttcatcgccaaggtgcgggacgacaccaacgcggtcgtcaccatccacctgccctaccctggcgacgcggtccgcgtcatcgagacgtccgacggcgcgcgccgcgaggcggatgggcggccgccctcgttctcgccggcgcaggaggcgctcctcatggtgcaccggcggatcctggagacggaaccagacgacggcgatgaggatggcgagtatgggcccagggccaaggatgccagggaccgaggcaaggtgaccacgcgcctcatcgtgccgcgcctccatgttgggtgcctccttggtaagggtggcaagatcattgagcagatgagggccgagaccaaaacgcacatcaggatcctgccacgcgaccagcacacgccgcggtgtgtatcgttgtcggaggaggttgtacaggtaagaggctgcttactataatctggtaaaaaaatttcaatttttactttagacaatggtacattaacttggagttatgtgtataatttagttgcatagttatatattaatgtacggataaaaggaaagcaaaatgctaaacagattatgctacgtgttggacaagacttagatgtgttcttgatacttagaatatgctagaatcgaacatttgattgatgaactgctgtagagaagaatatttcctaataaaatttctagttagagtgatgtttagtttagttcggtttggtttattggccaaatttgattcactaaaatgtgtagtgtacgatgatcaaacctgaacactcccagatgaaaacgacaaaaaaaaggtttaaagaacagacacaaatcaaacaacaaatctaaaagcaggacaagacaaaaatcttcatgaatatattgaaaaaaaaaatgtttccacagcactgcaagatacctgcattaatacctacctttcttggtgcactttaataccacctaaaaataccgtaagtttttatgcagtctatgttagtatgtccatcaagcgctttggcttttttaaaagactttttgggacaaatacttctctagaaatccctgaatcacccctcaaatcatgctcagctcttcattcacttgtcctcatcaccattgaactctgttggctccatacaccgcttaacagtggtcagcggcagctgcagctgaggcacaccactcatcgtttaatcccatatgctgctcacttacggcagagatttgtggatgaatggatggtggcgctgacacaatggccagcttttgggtgaccgcatctttttggatgagcatgtcgctggagagcgctgcctcctagctcaagaaaatcagcatgcgggaacaaattcagaaggaatgatcagttgtggccttatggggctagtgaagtaatggaatgcttaggaaagggatctgacactgcttgagtgtgtggggtgttggtgtcatggggtgatggtgtcgacccaaccgtggtgctgctgccatacacgtaaaccggggcataccccatcccttcttcgccccattgacaatatttgggaatgactctgtgcatactattgggtctgttgccatggtttctgcagtaagagagaattcatagcttggatgggaggggtgaaattgagcagcaacttgtttcgatttggacagtgccgatagcctatgagggtacaggatcgggaacagcttgtgacttgtgatggcggagaactaatgtcaaatagcaacattgctttactgaacacgtggtagaaaatacgtgatactattagggtgaaaacaaattcagctatatatatagcaaaaatggtaatccctcagttccgtagaactgatttttttttccaaatatatctgaaaattttaggaaatgctccaagttccagtactctaggacttttcctactatctctcacaattatgttgactgatgactctgttcccatgatgtttcctgttcaataactgctagtacctgtgcactagttctggatgtttctcgctgttaactttataatgttgcttagcattaacctctctagtattcatatctttagcttcttttgagacattgagtttggcattataactgatttaatatcacaatatattaattcttgaactgtagtcatcaccgtgtagttggttacaagcaacacagtggaaactgatttaatgctttcaacagtaagaaatctgctctacccttgttcctagtcagtatttaatttcaactttgtttacacacacatttaatttaaaaataacctgttttcgttaggctttaataccagtttgtgaaattactctttgcacagtttatggggatttattcatatgatgtttgcttaatgctgagctcttgtattaaatgaaataaaataataatatagttggacatatagatttactcagctcacttatggaacaacttattatttgagactatatttcaaatattatatgaaagacactgttccagatttgtcttctagcaacagtggcttaaactatctctcttgtcaactttaaccttaaaagtgaaaactttagccttctgtttgcttagtgaaaactgttctgacattgatttgtaaattcattcaattatgatctgaaatgatctaggttcaacatgataaatctgtctcttagcacatgttgtaattgtgatttggatgcatagaaagataaatgacactctttattagacttctttttacttgtggcacttctcaccctactgtgtattattatcatgatatgatgttacaggttgttggagaggggaattgtgttaaaaaggctgtagcgataatctccgatcgcctaaaggaaagcttacaccgtgaccgtggccccttccgtggacggatgaattcaccagagcatcgatttcctcaagaggatgaatactatggtggtgcacagcagatgcctgcatatgaagaaccttatggtcgacctgatcaaattagaaataatactagcatggagctgccagggtatgagtttgattcaaatggtggcaagatcaatgatcacacagaaattctgttcgatgacatcatatttcgaattctttgcccaagtgacaaggttaacagtttagtcggaacacgtgatggattgttagagatgttacaggaagatgttggtgttgatattaggcttactgattctcttgatggctctgacgaaaggatcataatcatcacatcaagagaggtaatacacactcacttatgtcttttagttcaccactctccatactattactgacatggctgtttaagttatgtaaaaacttgtacgttataggaagggttgggttacagttctgtgggttttttcaaagttacatttgcagcttcaacagacgatgctatgagtgacgcacactgttttgtagtttttttccaatctcagttgcatatgaagttatatttatcagacgggtcctttttctgtgagaaattctactgatctactcattgcttcactaatctaaagtagtgttactagattgctagctagatttacacagtccaggcaatgtttgaagtattgcttgatgaaagtcaactattttttaactagtcattgtagtagttaagtaggttgtcttactgatgtgaatgaaacaagatgattttagcttgttggattatccacacctatagtcctatacagtaagctattcagatctgaggagctctttgttccaaaaatgcttacagcagtgtctgcttgcgtgtaacattagtttggcctcaattatgatggattttatttgaaatattatgttgttctttctgttggtattttctgctatttgtatcaaccatcattgttatagctggaatttgggttcagtacccctcccttcactgacatgtttcaatattttattcttaaaatggtccttacgattgttatagggcccagaccatgagctttttccagctcaggaagcattgctgcacctccaaactcatattgtagaccttggtcctgataaagacaacattattacaacaaggttacttgtcccttcaagtgaaattgcttgcttcgagggaagggatggatcattatctgatatacagagacagaccagtgcaaatgtacagatattaccaaggcaagctcttccatcttgtgctctagagtctgatgagcttatacaggtctgtcttctttcccagaagaacttcatttttgttatcttgaggattgactagatagtggagatccatgtgttaaatacctagatgactaggggtgggccgagaccgaacaaaaccgagccgaaccgaaccaaatcatcggttttttcagtcatcggattgtcctttggtttttgtttggttcttgttcagcttttggtcttttttgcggttttccatccttgccaaccgaagaagccgatcaaccaaactacctcccatgatcccagcccagtgtggcagcacctcaaggcccacgttcctccatccaacgaggcccatagcaactaggcctaatttatacaccagtaattgactggtttacctctacatagatggtggatcacgccatgccactggtgccacctagcacctcaaggcccacgttcctccatccaacgaggcccatagcaactaggcctaatttatacaccagtaattgactggtttacctctacgtaggtggtggatcacgccatgccaccggtaccacctagcacctcaaggcccacgttcctccatccaacgaggcccatagcaactaggcctaatttatacaccagtaattgactggtttatctccacgtagatggtggattacgccatgccgccgctgccacctggtctactgcttccgtgcgttagatgtgtttacggtttgttcggtgaagccgacacaccgaactgaattaatccggttacttcgggccggttttaatttttgttgacatgcacttctgttggcatatctcaaaaccgtgattctcggaaaccgaaaaagccgaaccgaatgaaccaatgaaaccaaacacccacccctatagatgaccataatccatatatttacaatttacaatacgcttgtttcttttgcttattgagccaagcctgggttgacctatcttctaactcgaatttgtgttcaagccaaagtgctcctagtaggcatgttatcttctttttactgttatattcttggtttgacacatgaatgatttttttactatgtttgccatattgtgtggttgaacaaattattgttcttgcagattgtaggagagattagagctgcacgggatgctcttgtgcaaataactgcaaaattacggagttacttctaccgcgagattcctggtcctaaccaacttggcaatattactgttcatggctccatttctccagcaaaaggttcacctagaggaccataccagggaagtgatattccaatgccatcctaccaacaagcacagcatgttccagcttcatggaaggtattctttagtacttcaatgtctttgttagtccttgcagaaaagcgcacgcgcacacacacacacagatatatatatatatatatatatatatatatatatatatatatatatatatatatatatatttgtactatgtatggaattttctctattttttaccactgacctctcttgtccttttggcccatccaattttggcctcaattttcctttcattcataatgggcatggtttccctttctttcataatgggcatggtgaaacttggcagtgacaagggatttgcatggtttccctttctttcataatgagcatggtgaaacttggcagtgacaagggatttgcatagatgtgaaaagtttgtaatgtaggatgttaagtatttgaactttaatgcataataatgttcttcttctaggttatctaaagttagccattgttttggagtctttggacttaaaatttgtcattttgaatttcaggatagtggaggtggtgcaaatatgtcgtttgagcaagggagcaacattaatgatgatatgaggcaaagtgctgcaaaacggtatgtttttgtctttgccatcttgttctgtttggttttcacatgatcaccttaatttctttttccaccagatttgctgttcctctagtgacaagaagcacattagaagttgtcataccaaagagtgctgttgcaagccttactatgagagctggaagcaagcttgctcaaataagcgaggttctgtatattctaatttttcttgtagaacaaagggcaaacaactctacctattattaaccctctaaaactgtttgttggtcgcagatgtctggtgccactgtcacacttgctgacgaaaggcctgacgccatagaaaaagttgttcgaatatctggtactcctgagcaggctgacaaagctcagagcctgcttcagggatttattcttagcagtgagtttctttctatcggttttgttccttttcaacgttattagaatggaaaccatatgacaccttcatactctctttgagcagtccaagatgacattccttcaggctaattggagacagtggaggcctacgctgtcatgttcagtagggtgtaatgcatcttgagtttttgtgaggtattttaacctctgctagcatgaggtgtgcctgacttagcattattcgtgggcaaaatgttcatgtataccaccaagttgccaacatgtactgtccaaagtcctaaaacatattatgcggtttctcgcaatcacccccaccgcttttttttcctttttctttttcctttttttgagaaacaatcaccctaccgctgatacctcatattatgcggctgagaggccaagtgtaaaaaaaaaagggctgaatagggcactattcgttattcgttctgtggttccttaggccttgtttctggaaaccgactttgtttctcatttatgctgcaagctggttagatatggcttgttgggcaacacaaaggaaggggattggaagtttacacgaggagagaggagattgatggtgagattaagatgagaatttaatttttaatgatagaggtggtggaaattgatagggagtttaattggagattaggttattaataaaattgaatggttgaaatttgcttagacaaagtaaaggagaaattctctcccaattaccactcctacctacatattaaaaaggatggagttcctttctcaatttcttattctcattccaccaaatttttcatgtctctcagctaaacaaaacagtgaatagctttatctctctaatctctcaatctctcctgaaagctccctccaactaaacggctaaacggcctgtagggatattggaagagtacataattattttatgattgtttacttcaacttttttacgatactagaaggaacttttttacgtaccagaagtttcgagttcctccctgactccctgaaaggtgctatcacatatttatgggtgccaatatggatacaacctatccgtatcgaccaccagacaagctattgaagagaggacaagctattttcgacatttcatttttctggtcttcctttggactttgagcatagaagttgaacttcactgtgcatcatcgatagcaggatagggtatgataaaataaactatggcatacggcaactattgaaccaaaacacagcaacggagagtcaaaaatttgctttacaaagtattccctctgttctagaatataaggaatttaagaggatgtgatatatcccagtaacattttggttgatcagcagaccgatgaagacgaaacaaaaaaaaatcaacctcaaaattgtaagatcttaccaatgaagaaaagaaaaacattttggttgatcagtagaccaatgaaattggaaagaaaaaaaaggccatcctcaacctcagaatatttctactattataattatgtaagatattttcactggtggtaggttgtctgtatctcaatctaattctatttgaaaaatattgattctgttttaaaaaaatattgtgtttttgtcctctgatttctggtcatctctcgtgattttagtcgacgcgttgggcctgtttaggtcgctctcccgcgtgcgtgacattggattgacacttgttgtgtccatttccaacacattgctccatgattagctggacacgaccgttctcaatagctacaaccctaatctatccggcaatgatgtgacatcactcatgtcaataaagttacaactttttttttccggaagtcgatctccaaagaacttcagggttaagcgtgcttggccttaagcaattttgagatgggtgacagactgggaaatttttcctaggtgcgcacgagtgaggacaaagtgtgcagaaaaaacatgggttggcctgtaagggcagcctatgacctatgaaagctatcagatgtaagggtgtgcacgagtgaggacaaagtgtgcagaaaagacatgtgttggcctgtaagggcagcctatgacctatgaaagctatcagatgtaagcgggatgtgttggcctgtgtaagggcaacctatgacctataaaagctatcagatgtaagcgggtccggcctgggagaagcgggacgtccgactctcgcggtttcacgggcgcgtgtgtcgcagttgtgcaggcatggggcgcatggctggtgtggaccgggagtgatcacacagcatggcacatgcgctggcactacacacagacgtggccaagaggggacgttcctggcctggggttgaccaacgaggacgtcggtgttttaaggggacgaggattgtgacatcccggcccagggcttataggattactagaatacttatatcaacaagttacaactttttttctgcaagccgatcttcaaagaacttcagggttaagcgtgcttggcttggagcaatttcgagatgggtgaccgactggaaaattctttctgaggacaaagtgtgcagaaaagacatgtggtggcctgtaagggcagcctatgacctatgaaaactatcaaatataagcgggacgttgattgaaggatgacctatgaaagctgtctaagcgggacgttgacgttacaaatgattatacagattgaaggcaaattattcagttccaaataaataataataagtatctataaaatttgtccttaatttctaatctttttaaaatatcagcaagtcaatataaggagtgtaccttatttgaggttgaatcaagtcttatttgaggttgaattaagttttagaagttccgcgggtcatgtaatatgaaaggtagaagggtactacggagttgtttaaattgatctcatttcaaactatatcattgttcagtaaaattgctgaaaatatgcatccatttagtatttaatcgaactttggtaaatgcataaaaaatctaaaaatacttaataatattgctaaattatcaaaattttagcactaaaatttgttaatgtttattttagttacaatctaaagaacctctacactttgcagatagggttgaccctgcaaaggtttgggatggtaggccatgcgtgttaaggactgaaactaatccttgttttagttgtttatgaaatattttattttgtgcctgcatggagatggtcttctgcttcttcttctttttttatttagccatgaacctgacataaacttcaatttcagtgatgtgctccctgttctcatcgctcgacctattcagtcttatttttcactcttctcgtgaagttagttttcaagttaagtttattttttactctctccgtttcagattataaaacgttttaactttagtcaacatcacactgcttcaaatttaactaaatttatagaaaaatataataatatttacaatactaaattagtttcatcaaatcaataattgaatatattttcataataaatttaggttgaaaatgttactactattttctacaaacttagtcaaagttaaacttagtcaaagttaaagcagtttaactttaaccaaaatcaaaacatattataactaaaacaccttataacctaaaacggagagtggtatatatcaagcacacagagatagtatattggatatttgtgggtttggacatatataaagcacaaatcagaaattcaatgaactatttacagcatatatatcgcatcacatctaaaactggcagcagatcagtaggcagcctgctataaaaagatagcatattatatttggaaagaatatgtaattcaggtagtttacatcttgtcagatgtccagaggtcgatgccagaagtaccttgcacccccaaattatttccagtataacaattcttttgattgaatagccaatcctattcttagcccagcagcagaagtgcagaacaaaaggacagtaataccatgtagaagattatcatcttagaccaaaatcgagccaaatttatactcgacaacccagctaggccgacaaagcacaagctaacaaaaccaagacaaattgtgacatcaacaatgaaggaacttagcgacattagttgcaagttgcaacagcattgaaggaatttagggtaaacagatcaatgggttgctgtatttagcacaaagatacgagtaaaatcatctttcaccacaaaacacattagtacacaaacaaatgaaacacatgtaacatttcaacaattctcagagaaatcacaagccttcgcgtgtcaaaaaactgtgaacacaagaacgttgtgatggagacaatcaataaacactatcaattcaatgctgattgacacgcaattctttgttatctcagggaagtaaggcccgtcactataaattcaattgctacatcttgtagcagattaatcctaagataatcagcaaacattgaactaacctgaaacccacaaactcatatggaaagagaaacaacatttgagcagtttgcaattacaaagtcgtatggtaagagaaacaacgtttgagtagtttgcaattgaatcatgtttgttatagaaaaataagatatctatcaggtataagaaatataatttcaaattattggagcaaagccttcaagaccttcaattatggacaatctaagaagaaatcaatcgatcagactaccagagaacaggatgccaatctaggaagaactcaaccaatcagactaccaaagaacaggatgtcaatctaagaagaaatcaaccaatcagactaccagagaacaggatgctaatctaggaagaaccaatcagagaacagcaggtcatcccaattacgcataaccatcatgtataccagattaaagttacggaatccaacaattatttaaccacctcaaaccatgacaaatatctcatatcacaagatgaaaccggcaaccaaacaatccataacagccagcccacatagtaccacacatagctattaattagaacatagcagtaaattgtagctgcggagaaagaagaaaagagcttagatcttgtcgatgtcctcgtcctcgaactggatgtagtcgtcgtggtcgccgccgtcctcgggcccgtcgacgtcgacgccctcgttgagcctgagggtgtcggggagctcgccgtaggccttgaggaggcgggcctcgtcgttcatgtacttgaggatgacgtcggccttgtcgtcctggtagtcgcggaggccgacgaggatgatgtccccggcggcgatccacaccttcttgtgcatcttgccgcggatgtggcagaggcgcttggtgccgtcgacgcagatggcctcgcagcggccgttgccgagcatccgcgtcacctgggcgtactcctgcccgtcctccttgaacaccagctcgcgcttgtcgtcgtcggcctcgttcttacccctcttgcggttcttccctcccttacccttgttcttcggcatggcttggctaccggcggcggatcccttcttcctctaggcgtcggcggagatgcgaaaccctcgcgtttcgatcgagattgggagcggtggagttgcgggatgcggtttttctgggccgcgttgggctgcggctgggagtatataggggcgggtgtggaagcggacggcgagaaggggaggcggtttctggtcgtccgatctagggttggagggagatcgacggccgagatgggcttaggaggatggcgtgtccggacggggctctctagcagataaccgtggcccacatggacacgggcggtggggtggggtggggtggacgacgagagttccgtggtaggtctgctgcgtccacgacaagcaaatcgtatggagtacgtgtgcaaatcgtatggagtagaaaacgaatcctgctatagcctacagcacacgagtatagttattaagaccggatcggagaatgaccgcggtccgataagtaatatagaatgagtgtttatatagtagcacaagcggcaggatggtggcttggctaacgcgcatctccaccaattttcttgggaattttgcgtgcgcatgcattggaggcatctagttgggtcctcatctcggcccattaactcctcatctcagcccattaacaaatccttcccaattcaactagcccggttaatctccggtttatataaaaaccactcgagttaaccggttttctccggtccgattgtatgcccgatcttttaaggggaccagaccggcgggagccctggttccggattttttcggtcgaaccgccggtccggtccggttctaataactatgcacgcgagacgagaaatattgtagcgcatgtttatttgatttttattttaaaatcatttagcagctcatagaattatagtttggtgttaaattaatgtttagaacattcacttagaattaggttggatatggaccaaacttgactccacacgggctgactcgttagctatcctaatgagtcttgtttggctcatgaaatttgtcaactcgagcctgacccgatttagaaatttcaaccaggagtcaaattttcaccatatatgcgattttgtctatacttagacaactgtatcagcctaaaataaagcaagagagtggcatcccctctacattttgttctagcttcatcgaggaccaggttgggggtggcgttgccgagccatgattaggttggtgccgctatgcttaggtggacagtggatgaaggggatgataattgatgagccttgttagcatgatgtgttgttggttgttgtgctggtttgctatgcacctatgcctagcttgggttgctggtaggggtgaaaacggtatggaaaccacctttgtcgtttccgttttcattttttggggggaatcggaaactccggatacgaaaacagaatcgaataccatcgaaaccgaaaacggagcgaaaataaaccggcgcgaatacggtaacaaaaaattatcggaatacaaaaacccctcaaactgaccaatccaattctcaagtcaaggttcaacaattcatcataaaacacaatcatataagtccaattgttaagtctcaacagtacatcacaaaacacagtctatggaataaattatctgtttaagagagtaatgctattgataaataccaatgcatgaaaaaaatgttttatgtaactctagatcaattttttttaaaaaaatagcaaccaaacaccatggtatgcactattcagtgcctaaaaaaagaatacagggtatttcagtcacaaaatttccggaaagtccgaccgattccgagttccgacggaaactggctttatcattttcgattccgtttctgagaaaatatttccgaattcgtttccgtttccgaaaaatttcgaccgacagattccgtttacgaaaataggtcaggaatccggaaagtttttgtaccgctttcacccctagctgctggcatgctgcgttcgtggtttctgtgaaaaaaaaaaagttccgtatgtcggtatgtgctggatagagtaatcaggtatactgatgatgatcatgatgagtaacagcagcagaaacgttacctgaaaccaggtcgccgtttgcagaaaagcaggaccagcgatcagtagtcttaccgcatagagaatgcaggtttacagggcaccggtgagttcccaactcacgcgcacgtttttcaaactattaaatggtattttttaaaaaaaaaattatgcaaaagttgctttagaaaattatgttaatccattttttaaaaaaatagtaaatacttaattaatcataagaaaatgtgtcgctccgttttgcgtgcgaactcacctccccaacacagccatggaatgcacggtatgtgcaaataggaagcaaatgataagttctttgtgaagacattatattacacctcaattatgataaatgtcacggaggtactcatatgtggtaagtaaagcaggactaaggatcaaaaacaagatgagtccagaactgcctcaaattaacttgagtgtacatagatactcagatacaggctttcaggtctccactgtgatcccggtggccttcataagatgtttagaaacagagtaatatagcagcattcactcgaacaagtattcgttaaccgaaacctacataaacatgtttgggtctcatatatcatttcaacatggtaatttgacaatgaaagctaaactagttacagatcctcaacatcctgcttggatgatgtagggcgaccttgatactccagttttgtacctaaacttgctgtgataaccctgaatttcagtcttatcttctccattatatcttgaacttgctcgtcttctgggttcgacaacggatagcttctcaacagtgcagctagttgctcaatgtttttcctgacccgagctgagaatgcatcttgatcaattgaaaccaacgacgtccaaacatccagacatccctgataaaaacctagttcttcacctacctgaaaaccattctttaaaccaacctgccttccctcttcttttccagacaccaagccctcactataaccattcttgaaacccgtttgatagtgtgtctcatctaagagtactgatggttcaaggaaatcaaaatcatccttaggtttctgatccatggtattaataagaacctaaagatgttgcagtaaacagttccttagagagggattccaaaaggttgctcagtaagaaaatgtatgcatacctaaatgcaacaagacaaaaatattaatatcaaagaaacgagagatggaaaagtgcaaacagaacttctgctgagttatgaacaaaaatgtgttgcacgtcaaacaaagcaaaacaaaaaaatgatgattcactaaactacgtactctagacgtttgaaactttacaatttttttatgggtatatctaacattaacgtcatgttccacttcatcaagtaagagaaattaggatgtcaccattactattgactttttcttttgaaaaaggttatattgactattgaatgcagtgcgagccaaactgtatgatgtcaaatgttatgacttcaacaagcagagtcatacaacctcacacaaaaataagcactacacaactcattcgaaccatcataaatcccttgcgtagttgtgttggattaacgccaaggttggacagaagataaacaaggtggtagctattcaaacaaagtggtagctaaccttcaggattcaggaataaggatacactatattctagtaatattcaaaacttccagctcctaagtttcctaagcagcacgatcacatttttttggtagaaataccctatattaggctattactattagctttcaatataagctaggatcaacacttattatttaaaagaacaccatgatcactaaagcatagcattaattaagtcttcatcatacctctaaaccttcaattagtatgatattctaaggattgaaatgcccaaaaaggaaataaaaaaaaaggaagataaaacctacgtttctccagctttacagaacagtaagtttccccaaatctcgcttctatctttacgatgctcttggcttctactactaccaaacaaacaaaccaaaacaagatgtaggaaagccataatcacgctagatgtcacaactactcgagaattgaaagcagtcaagctgaattaggagtcatgatttcagttaccctttgctcactaaaaacaaaaaaaacaaaaaaaaagttaccctttgctcagttgctcccggaagaaggcgtcagtttccgcgatacttctggaacacgccgctgcagttggagtccttagccaccgcgctttccgccgcctactcagggcagaggcgaaggccgctgatagcaacggaactgcgctttccccggtctccgcgggcgaaagaggcggggcgccgcacggcccctccgccggtggaccaggcgaggcgccgcagctggcggggggacgacgcggtggcgcggccgctgggcgccgccgctacgaccggaggaggaaggagggtaggagactcacgtgtgtggcggcggctccagcccagtgacctctagatgaagcttttgggtctgatttagttgatgatgggcttttttgggccatggagtttctcgacgtcagccttgtagaagttgataaatgggctaaagcccatatagatttggtggttgggctgcaatcacggttcgcgcgactcgagctctcgaatggccttcgtcttcgtcttctccggttctctttcccttccccatcctcctccccattgcgctgggtaggattccaatgtgggggactagggtttagggtttggagtcaatcccagaccgcgcccatgacgtcctcgtctcgagtaagttgcgttctgtattatcttcctctctctctctctctctctctctccgcgcgtgcgattttttttgggggtgtggttttggcgatgatatgcgcgtgcgattttttctccccgggtgggtttggggatgggaggcgtgattagaatcagcgaatcgcttcagtgcattgcgctgtattctgatcagtgtttttccataggagatttaagattttgttgttgagctgatgtgtgaaaactggtgtattgcttaggtaagggttggcaatctagtccccctcaatgaaggaaatgcgagctcgtcaaatggatcggtgtcaagcattcctatctatctgggtgccaatgttgtagggaggaatcatttggtggtcgtcgacaagagagtcagccgcaagcatctgagcctacatgcctcggcggatggttccattgaagcggtagtggtgagtgtgataaggcatggggatattccaattaactgcgcagtattgttctgatggcttttttttcagaaaataacttgttgttcattggcattggatgtgcaggaaggaccaaatcctatcattgttcgatctgagggccagaggaggaaggtctgtgctcaagagagagtaaagattgcacatgatgatgtcctggaactcatccctggtgaatattttgtgaagtatttgaatgtgggcgataaccataaaagttccacatcaatgggttcaagtgattttaaaaaggggaagaggctctgtgaggatgatactgtagttatcaaaagaaatcgtcagattatggaagatgaggctttggcaagaagtttacaggtaacttaagtacttaacctttctagttgcactgcctgtattgtgcagtttgtttaacttagaagagagcaatccatggttttccgtgtatcatatttccgtttagtctgatcatggcttaatctgggcaatgctgtagttttaatataacataaatgatcctagtgctggacatagaatacttagggcacgtttggatctaaggctagcattagcctagcctggcctggcaaggcccagcgtttggaaccataaatatatcgcagcttctgggggcaagctagccctacgggcaaggaaaagctcgctcgcagtggagagccaattcggctctccttcgacgacaaacttctctttagactaactaactgcccgtcaaaaactaaacaaccaaacaactcagtaaagcaagcctagcaacgcagcaacaacctggtttgcctagctgggctatagctcaaggtgacaaacaaccaaacatacccttaaagaatgcctttaaaagaagggattttccagtgtatattctgataactttatcgtggataaactaatttaaattatgtcagacaattgtttatgaaattgatcagtggctatctttatatatttctggtaggaaaataaagtctttacgtcttaattcatagactccaggctgtgacactgaaagatcctgattcataaatataccactgaaagatcctggtacacttaaataccatccaaaggtgcaagcgtttagaaatgtacttatctgtggtgaatatttatcaaatagtatctaagtattggatgtttggatttgctttctgaaactcagcattggatatgctatccttgtatgcttctgttgtttagtgttggcatattttatattttgcattgtaaaaaatggtgccccttagcttgctgaatattagtttagctgtatgttttctttccttgtgtaaaattaccagtatactattgaattgtagtatagtacattaccatcttagtttcattactatttcctgtcctattccagaaaagctttgcagaagaaagttcaactatttccggtttgggttgtgatcaaatgttaagttcacttgatagtgctggtttttctgagagaaataacgagagaatacactctgttgattatctgaaagatgtactttcattgacttttcggctcatgcgtgtccaaggtcttccttcatggactaatacttcctcagttaccattcaagatgtcatacaggtatcatccatttaacaggagctcttgcggaagttatgtggttgatttcgtttaacatggcgtgccacaacatcttttagatatgatctgttcaggacacaaatgttgcataagaacaaatttcttagcctgctcatcattaccaacatatttgttcaaaaagaaaatcattaccaacacaaactcttgctcatataccatttgtgatttatcactatatagcctcaactcatgtagtctgctgtttgaaagatggaattgttctctagttggaccttgtaaagatttctgtctatattgtcaatggtatcgtgtatggtgggggagcaaaggctagttcttattctgctgatctgttcagttttcagggatactgtgttgcatatcatttcccaaccatttctctaaaacaaatgttctcttatgttcacactctattcatgcattgccagattcatcaaagaagtatactagttcttacatgatgaatgaattattagggtgaagtgcttcttgctgtactctcaaattatatggtggacatggaatggctgcttacaggtgggttattgtggtggaaatcatacaagtaatattgtttgtccttgtatgagggctgcttcctttttaccataagtagtgaccttttttgcaaacaaaataaatttggcgcctctgccactttacagtttcagaagtcagaacactcaatcatgaaaccaactacgatcctgtgctatttatatttgtctgctccttttaattttttttgtactgcacaattaatactaaattctacgtgcttgttggtaagaggaaaagcagtcctttctttgttgctgaaagtaatctgccacatttttttcattgaataagcatttagtttctgccatcctggtagctttcccctcaatgttttgtttgctgtaactattcattggtataattctttttgaagtgaaagtagctgctggtaacaacctaactcatctcatattcttcattactgataaattgatgtaactatattggtcactctctattggtttctagaatcatagtcatttatgttattgatttacctaaattgtttcctgtgcaataattttggaagctcatctttctgagcctctatggctaggattacaatttgtatgtttactagttaattgtaaagcataatatatttgtggaataaaaaaactggactacaaagataagcaaaacatgtacttttggccttttattttgctatttttgattatgattctcatttgtcttctattttccactacttcatgtatctttttgttgacatgcacttagttatgaaatgtatgtatttactaaggagtttggcaaccagcgcccatctgtgttccctatgctatgtggtgaaatatcactgtgctttcttttccagtcattgccattatctacatcctttagttttaatgtaaataacattgcactgtgcagcatgtccaagcttaaggaaagttcgacatgtcctagttatacatggagaagatggtgcatcagtggagcttctgaaggtgacaacattactagagtaattcatgatattnntgtattccctttttctcatctcanattcatggtgggtgacaganagtgaagccagccaattggatccttcacaagcctccacttccaatttcatttggaacacatcattcaaaggccatgctgcttgtatatcctcaagggattcgtgttgttgtgcacacagcaaatttgatacatgtcgactggaataacaaaactcaggggctatggatgcaagattttccctggaaagatgcaaaagatgtgaatagaagtgtttcctttgaaaacgatttggttgattatctgagtgcaattaaggtagcagctagcagggcacttgtctttgcttcttgattaacgtatcactccaattgtgtttcacttttttagaaaagaagttaaatgttgttttcttactgatatattttaaattatcatcataatgtgttttgccggaggttaccagaataaaaattaacaaataactgtgcacttctcgaacaatcacagttaacactggcaacttctgtttctactcttctgctactcaataaaaagaaatcatattaaatactactgaattggttcacaaggggatccactgttctcatgttagtaaaacactgaattggtaaaatatgcatatcatgattttgttagagagagatcttggaattgctggcaacatgttgcaaacttatagtaagacagtagctgtctcattgctaaaagcaatgagccatgttaaagaataccttaaaataagtataatgaaagtttcagcaaatcacaaaacatggtcttattttctgtggaacattgtacagagttctgtaataagtacctctaaattggagtgaatgaaaataggatgtctcgggctgtctagcttcgaaaagccccagttcattctaactattacttttgttctagtttaattccctaccgttgcagtgtactaaacacatcttctctatgtatgttgtaatgtattattctcttcatgacaatgcagtggcctgagttcagggtaaatttaccagtggttggtgatgtcaacatcaatgcagcattctttaggaagtttgattataagagctcatcggttagtataatccattaatcttagtttacacttagtgtgcagtgctcagctgtaaacatctcgttttttttttctccatgcaataggctgacatgaaaaagaaaaaaaattgaagtccgctttgcatgataaatgctggcaattacttaatcacgtgatcactgatttatgcttgtgcctccgccgtaaataggctgctttatgcaaaagttcccttttcttcaataaatgaacagatttcatcatcttttagcactgtttttattgcttgtcctacaaagtatttactgttctgaaggattttcagttcacaagaaaccattctattgctccttttgttatccattttaaaatcttatgttggaccttaccagtttggttgcatttgaaattaatctatgcattttttttctgcaccttctgtattgcgtgtttagtgataaagtccacatatgccactgaaaacttgcccaatcctcctattgtcagtaagacatcaatggcaaataaggaatgaagtgatatttaaagcgaaaaatgaggaattgcctcatcattttggcccttgatctttctctccctgttggatgcacaaaaactaaataaactgtacatggaagctcagcagcactcgcaaaaggtctattagttttacatagaagcaaacatactagcacacacaccagttctcctctctcgtgtattcataatttagtctcagctgattttacatcttataggtcaggttgattggatccgttcctggttatcatgttggccccaatattaaaaagtggggtcatatgaagcttaggagtgttcttgaagggtgcacatttgaacaacagttttgcaaggctcccatgatttatcaggtatctttgaatgtgtgagttatttatccatttatcttagcatttagcacaggcaacttttcgaagtgatgtagtgaatgccttaataaccctgttaaggttgaagcagaaatgcttaagattgagaaacaaaaatcacatggtgcctagtttaccttaggaaagaccttctagtaccttaaccctgcactttgtagcacactaatgccattaatagaagctgtaaaaaaatttgcactaatggtcaaaggaatatgtacttagttaatagctgtttcttgttttgtattgcaagaatgagcgagactataaggagtgcgggatatgttatattgtcacctgcatcatcacggattaattggacttaaaatctggcattcatctcccctttctgtttcactgaaagtttatattgtaattttttactcgcctattacttcccaggcttgttctccttaaaggacatttagcattttaattctcttgtatgcagttctcttccttggggtcacttgatgagaaatggatgagtgagtttgcattctcactatcagctggtaaatcagataatggttcacctttgggtattggtaaaccactgattgtctggcctacagtggaggatgttaggacatcaatagaggtataaacctaacatctgtaaaaattctctaatcatacttcctgtatattgcatcgtaaaacacacgagcatgaaagctccttgtgctttcttgatctgttgagaaccttcttcagatatgatgtcctatgatagatcagtgctggccccaaaataacaaaaaagaagtataaaccgattgtgttccctctcaaaatcagcatgttccatgacctgaattttttctaatccttttacccgagtactagtatcaccgcttatctgattttcttttatgtcaaatgtttcttatgtagggttatgcagctggtagttgcattccaagccctcaaaagaatgttgaaaaagatttcttgaggaagtattgggccaggtggaaagcggaccatgtgggtcgttggtatgttccctgattccttcaattatctaacaagctattgtcttgttcaaatggaacttcctaatggttaccttgcccgtatggtgctgcatatcacaagaaattgtttggtgatgtttctttaatcacgacagccatgtttggaggaacggtcatttgtgaccaaacattaaattgataggttggtgctgttcaaccttaattatgtgtccatgtgtaggatcaaggactagagagagagggggaggggtgaataggcgatttttaaaataaatgatacctaatcaaaactaacctaagttgctaggtttggttaggaagaagtctaaccaagcaactagattaagttttgcaatcctagggtgataagggctcaaaaaatctgtataaaagtaaattacacaaatgtaaatgcaataagtaaatagaacaagagacaaggtgtttttcaccgaggtccggaaactcgctggtttcctaatccctgttgaggtgagccctacttcaccgctcaaaccacaaaacctcgatcactagggtagttccttcgctctgaaggaggtgaatttcgaaccactcacacccaacaccgggtctcctccacaaccttctcggagaggccaccggacaactcctccaagccgtctagaaggtgtcaacctccaagagtaacaagtagcaaccaaactcgtagatgatcaagtggcacactagctcaatcgatgatgcaatgcacttgacttcgctcaaactattctcaaacacccacaaaggatgaagaagtgctcaagtggtgtgagagtgaatgcaagaggtttatacaattgaacaatgtgccaagagaacctccttgctgctggtgggggagtatatatacccccacacataaaaactagctattgggggctgaaacacgactcacaggagtctgtcggtcgaaccaccaagggatgttcggttagactggcctctagtgcaacggatagaaaactagccgttgcagtacatttaatgcaccttcagtctaaccgccataggctggccggttagaccgcgggtggctccggttagattgagctaccaccgatcagaccgtcttaagctctagtggctctagagcgccaagtccaggcctcctattttgctccaagtgctcccgatcagaccgggctgggcccggtcagaccgcagcggttagaccaccacaagggcgccggtcagatcggctttcaggacttggagcctgaggcaaccgcgagaatagaactctatggtctaaccgcccacaaggcctcggtcagaccggagcacataccacggtcagaccggcatgaaaccttcggtcaaaccacctgaggtcagagaataaaagcagatttggaccaagagaagcacccacatgcatgtgacctaatatggcattttgataatttcctcaccaaggttaccacccctatacagcaaagctattaagaaacctagcaaatttgatcatccaacacctcaattgataaaaacgaaaagctatatttatcacattcatctcattgcttggccatcagtttttaatccgtggtaatcatccttcatatgcacatcatgtggtcctaactcaaactcttactcaaattgaataggtagtccataattagcgcttgtcattaattaccaaaatcaataccacataccaggggcctaatgtttcttctatatgatctgtagtgctgtgcaaaatgagttttatattttctctacccccaaggttaggcaaggcaaatttatatttaattgcaaagatagcgaagaatatcattgtaatctaaaaagcagcagttcattgaagtagtcatatatactaataaaaacaagagggagtaatgattatgattgtctatattttatagtattccttgagcatatttagttgatcgatggatatttgttatagcttgcaaaggttggcatccctgccatacctagatctgtaatattttgatcctttttagagtgtttattactttatcactgacttggactgacattctgatttgggttttcttaccagtcgtgcgatgcctcacataaaaacttttactcgatacaatggtcaagacattgcgtaagcatccatataaactgttttgaactctagaattaataacagtatttccattgaatcattgtctggaatctttgtatatcctcatcagatggtttctactaacctcggcaaatttaagcaaagctgcttggggtgcgttgcagaagaataatacacaactgatgatacgctcatatgaggtggatgattttgttccattgttgaattgaggaaattttctgaacatccagacttttacaggaaaactgctctgcaacatagtgttggtcatcatggaatcgtagcttataccttgccatttgatctcttttcagttaggtgtactgttcttgcccaaaactcaccaatctgtaccacaattttcatgtacggggaagaacaattcaaacctggtactatctaatttctccttccttttgtattataataatgtgatcactttgcttttttttttcatcattttaagttccttacccagaataacctggcccctgggaaagagatcaaaaccaaactggtcacactctgctggaaaagcgacgaagaaaaagaacaatccacggaaattatcagattgccagtgccatatcaacttcctccaaagccttacggcacagaaggtgagctggattaatttaacgattgatacaacttcagtggagtaacaatagtaaaacacttagaaatgttttttttactttcagatgtcccatggtcttgggacaagaggtacacaaagaaggacgtgtatggttcagtctggccgcgccatggttagctaagcggtatgcggacaatatatgatcaatgaaaggctaaccctgctccgatgtcgacaacaagaaggccggtagctgatcgcctgtcagtgcccactactcaaccattagcaggaagtagtactatttcctgggagagattagatatttctattactaatttgtacgagcacaggatattttctttcttgttggtacgaatcgtgtgccttgtctgcttccgatcgtgatgtttatgcctccatcctcttttacagagtagtactcctacagtccgtcgtcatccagcgatagcgatctgaaattttaacgtgcaaaggacgctacctaaaccagctttttccagaaatcccccgtgcttgttcttgcggctgtccttgccttgagccgctccatgaaagcagcaaattagtggtactgcgtaaaagaataggggcaattgactcgacgatctcgcttccgtcgtcctgttgtgatcctagacgagaatcgtcgtcggtgatcgatcgggtgatgcgaagcgttcgtccaaatcacggtgattcaatcaccaacccgccgtatgaacgaccacgagcacgggggtgtgcgacgcttccctcggccgcatccgccaaagggtaaacgccgccaccaccacccaccaagcgacacggcgcgcgcgcgcaccgcatgaatcgcgtggtacgtacgtacgcccccatcccaccaacgggccaccacgcgacacgagacggcaccacggcttccgccccccgccgacccctcgcaccaagagcccacgtaccgcaccgcgcaccggtgccggtgcgtgctcgcttttgcctccctccgcgagccgggcgcgccacgcgacgcgcgcgcgcacacgtcgcacgccgtctcgacgtctcgctcgctagtcgctacccgcgtccgccccacgcaacgcaaggagtgaaagaacgcgatgccgcccgcccgcccgccgccacgtgaacgcgcggcgcccctatcaatccgcgggcggcggggtccgcgcgctcgcgggggccccgcgtggcggtggtggtgggtgggtgggtgtcaccgtcgcgaatctcgaatccgcgaaccgcgagtccgggggggaatcgggtccgtccatccatccctcccagtcgcgtctcgcgagtcgcgacggcttcgctctctcacctcctcggccaaggtgggccccgcctagtggctgctcgtatcgattcccggatacgggagatcgacgatgctccgctatgcgccgttgccgtttgggattgattgattgattaatataattaattttggtttaatcacgtacgtttcgtcgtaatcccggcatagaccgcgtctgatgctgcgggttggaatgaccattagcgtaggtcggtcgtctggtccggattctctgcaagtagcgggcacgtagtatgcttcattcctttaggaagaatcgtgtcaccatttcctcgtaatttttttctccatccgtctccgtcctaaaagaatgtagtagttagttttagttagttaagcaacatttcattaattaatacaaagagaatgaaggaaggaattactacttcttcgatgacaaaagagaaaaaaatatgaagtattttctatgcaataattatagctatttttttattacgaaatagaggcatgttcgtacctagagagatctaatgggctctacttaaaaatacaaacaaatttttaaatatgttcatacacaatgtcctattttattttgttagagtatttaagaattctattataggtgtggtctaatatgaatttaattttaaagttaattggatccatatgccattgtactttgataaattgaaaaaataccactactattcacaatatcggctaggtggcatcgatattttgtaaaatttgaaacagaccattatatacatcccaaacacagttgtaccaagttttttatattgtattttcatacttaccagaatgctccctatcccttagaggctgacaaggaggacccacacgttaaacttatcttcttccccgattattcctctagcttgacgattccgactgcaacaacaacagtggtggagggctggcactagagcttaccagtgatgacgtccccgcacctggcttcccgatggtgtggtagatcctgcaacggtgtgcttgagcttgagcgtagattgcagccccagaggcgaacagcaacatctagattgtggcagcgagcaatagtagccccagtggcggcggtcggtcctcgtctcattatcgtcggtgagtcccagcaccgacccattcaccacatcactgccacggagttcgagggagttggcagcattcctcgtgtgaaaaccccatcgctagcctctcgacaacgtggcggcaaggtcaatgcaggcgggctagattggggcggtgaggagcagtagtagaagcaaccccagtggcggtggtcgtttctcgtgtcgctgtcatcgacaagccccaacgttgacctctccaccactgacaccaccttcaatctctccaccactgtcgccactgccactctactcccgtcagtcttgctgtactagtggaagtgttagggaagataaggttgacatgtgggttccactagttagcctataaggttttgggggcattttggtttatacgaaaatacggtatgaaaaaatcaagtccaactacgtccgggccgtatatagtggtatattttctcttacaatttgagaaattaaaatttttacaaaatataccaatggcacacgaccaatatcaacggatagtagtgatattttttcaattcaacaaatttgcaatggcatggattatagtaaccataattttaatttgtgctcatcagttcaatattgcttttttactttgtgcctcacacaagctatcttctctctggccatcactaacaataggggtgaaaacggtacggaaacggacgaaaacaacttttatcattttcgttttcattttttttttctgaatcggaatcagaaaccccggatatgaaaacggaatcgaatattattgaaaccgaaaacggagcaaaaacgaaccgacgcgaatacggtatggaaatttatcggaatacaaaaacccctcaaactgataaatctaattctcaagtttcaacgatcaacaattcatcataaaacacaaattatataagttcaattgttaagtctcaacagtacatcacaaaacacaatgtatgaaataaattatctatatttaagagagtaatgctgttgataaatcccaaatgcgggaaaaaaaaattcttatgtaacttcagatttgcataacaaatattttttaaaaataacatctaaacaccatggtattcactgttcagtgctaaaaaaaagaacccagggtatttcagtcataaaattttcagaagtttcgagaaaattccaaccgacagattttattttcaaaaataggtccggaatccgaaaagtttccgcaccgttttcacgtcctaactaacaatatagggaacgtgtgctaaatataaaatgagaccttatatatgtagcgctgataactagaactatgtaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagatatttttttttaaaaaaaaatagaatgaagatattctgaacgtatcggcaaagatttaaacatataattatataattttatagtttgtgcattcgttatatcgcacgtcattaaggacatgtcttactccatctcaatttttatttagtaattaaagacaattgacttatttttattatttatcttttttcgattagatgcaaggtacttacgcacacactttgtgctcatgtgcatgtgtgagtgcacctcctcaatacacgttcaactagcgacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccgtctataaattcctccccccttttcccctctctatataggaggcatccaagccaagaagagggagagcaccaaggacacgcgactagcagaagccgagcgaccgcctcctcgatccatatcttccggtcgagttcttggtcgatctcttccctcctccacctcctcctcacagggtatgtgcctcccttcggttgttcttgaatttattgttctaggttgtgtagtacgggccttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacatttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatgaaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagtttataggtaatacccctatagtttagtcaggagaagaacttatccgatttctgatctccatttttaattatatgaaatgaactgtagcataagcagtattcatttggattattttttttattagctttcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttcatgtctgatctcgacattcagatcccaactgccttcggtatgcatgttgttctcttccctctttgtgatggtctgagtgcctggaatatttgtgctcatcatgttttcctgaacatgtacagatccctttgctgaggccaatgctggagactctggtgcggctgcaggatcaaaggactacgttcatgtacgcatccagcagcgtaatggccgtaagagcctgaccactgtccagggattgaagaaggaattcagctacaacaagatcctcaaagatctcaagaaagagttttgctgcaatggtactgttgtccaggacccagagcttggccaggtgtgtgtaataaccgaaatttgtggtgcctgatctttacgtttttctatctttctgagctagtttttctgatcaatgcttcactctgtaggtcattcaacttcagggtgatcagaggaaaaacgtatcaaattttcttgttcaggtagggatcattcttcttgtgcatgcttactgcaattagatgtacacatgctgtgatgtatgaaaagaatacgtcttgacttgttgtaacatgctatgtcccgcaggccggcattgtgaagaaggaacacatcaagattcatggtttctgagcaactgccaaaaccattgcaaagactatagtttggggtggagtatacttggttgtgtacatgcctgcgtgttccattgtacacacaaaacctagccacctcttgactcttgagtgtatgcttgttacccgtgtgttgaagtttgtaagaggcaccatcactatagatgatggcttgtgtccctctttcatcaagattgaataatatatgctactttgagagcgctatcctgcttgcctgattgtgttaatacttacatccgtcccacactcccacaatataaggaaataaggtattttggcagtttagagcaaaattcccttatatttttgggacggatgtcctcttttctgcatttttttatgttcatatgttcctgaagagtaaggtggatcttgatcaacctgtcggtttatggtgattgatttgagtggaatagaatgggccaacgtccggcatacagttatgcttcagctagctccaggagttgtggttttagattgctcattttctcattctttttcatggacgatagctgaactgctgaagtagtgaagtcggcatgcactggctactgtatatgtatatggcaattgatactagtagtagtgtcagctgaagctgcatgccttctactgtggagtactagctgttgatccaaactccagaccgtgaactgtttgttttttcattactgctgggtacggtacactagcttcattctgtgcatgagtcattctccggcatgtctgcaggacatctcatgatacttctggcacttcaacagtgatatttccagtgtactgcaatgagtttattcttatggttatgtacagtactcgtgctagtaatagtgtattgtacgaaatgaatatgggtagtactagtagttacaggattcacaaagctgggtaagttagaaatgaacatgggtagtactagtagatcacaaaggttcaggattcagaaagttggatctgattctcgaagccttcagtgcttctacgtcgccttcatcagtcagcatgtatgtgtaccatcttttttgagtgatttcttcccccaagtttcaacaaacaaaatgatgttacgaccagaccatcaaggttgagaaatcaaatgcaatcttgtcccctgttcagtcagacgtgcacgtagtacatcacagcatttttcagtcccgaattcgctcatcctgctgctacaggtggtcaaacagtatagttcaacttcagactttcgtggtgcttcttctctgtcaatgtgtacaacctattgctcatgatgtgttcagatagataagattatagtgcaagatgttgccgtggaatccttgcaggtgcgtgcagtgacttgaacatgggctgcatgtgttcctgcccctgaaatacggtgagatcgatttggttaagataatcagtgttcctaaccacgtactgtagtagccgttaacgttgtcagccaattatcaaatacgctgggacatctctctgcatgacctggtgaccatcagagtagtcagtgcctcattgtgcttgtaattgatctactactagtattctcttcaaaataaactgcgaatcaaaccccaacatattcttttcttcagtaaaccccagacaaattttcatgccaggataaaatccttgtcacacgaaaacaaaaccaaaaatatgtagcttatgtctctgttagaacaacacgagatcactggagagtggagattatggccctccacggtcattcctgccgttgaaacggcgcacaatctttttggatgcttctttctttccccctctccatcttttctttttctcacacacatgcagatgcccacagatcgctcatcacttcatcagcagtagtaaccttttccttttgctatctccctttttcttccgattcgtgctcgccaaacgaaaggaacatctcgtcacattttccttttttcaagaacaatctcgtcacatcatgatgcattttccagcctatcctcaccttcatcacccagatctgtggcaggagagaaacattatttttttctctgacatccatgcctaacgagatgtgagatctggacgcatgtttcgcccatatgcctctgtactgtagtacatcttctgatcttcatcttggctgtcatctcgccattggatcaccactaaaattacccccacactaacacatgctttacaacgtcatttgtcaggctagtactacgatgcgtgtacactgaaagcagcaaaggaaaaataataattttatccatttcatcatccaaaaagaatatggtttccaacgtgacagccactctacgtggcccaatccaaaaatagtagtactgtagtagttacagtgaatctgagccgcacgatcgaaggacgatccgatcctggccgcacatcgtacggccatgtacgtcggcggcggcgccggcgatggcctcacgagctggtcgtccggagcaagcattcctccggcggggaggggaaccgcttgcggtcgtcgcagtagtcgtagatgacgaggttcctcgccacccaggcggagtcctcgcgctggccggcgtcgagcgcccacgccggcggctggtcccaccagctgttgccggtggacgccgcgcagctgggcgggctcgccgccgccgtgccccaggagcacgcgtcggcggtgaagtcgcggtaggaggagatgaacggcgccttggtccagtccgtcttctccagcccgccgcgcgtcgcccagtcgtcggcgttccagatgctggagaacacgtacatcggcttcatgatcgggaagaaggtgttgggcttgtccgagttccggtactcgcggatcggcaccttgtccacgaagaacctgatgatcaatcaccaccaccattgcaaagaacatcagaaatcgagattaattgacagaaaatggatttgggtgggcacggcacggggaagacgaaggtggtggcatggcattggcagccattgcttggttctaaacagaatgtggccaagtagcagcaacctggagtgctcgtacaagcggcagggtttggcaatatctgcaggttcaattaatcgccatcggagcgacccatttcaaggggtaggtaggtaggtgggcgcattcaactcgtagtcgtcgtcgtcgttgacggcggcggcggcggatgctatctccggcgagcccggatggccacggagtacgattgaaacaactagaagcttgattactattgttcggttgatcacttacacgatctgcttggggttccagaggatggagtaggagtggaagtcggcggtggggtcgaaccacagcgagtggcgcatctcccggccgccgacgccgctgcggtacacgttggtctggatgatgtagggctcacccgtccggttccccaggaactcgaagtccagctcgtcgcgctgcggcgccgcgtccacgtcggagcacatctgcagattacgccgtcgtcgaggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaactagttgttgtcactcatcagtcatcacgcatggtgttcgatcagatctggggcttggaccggtcagggtatctcatatatattctcatcagttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttcttcactatgatatcacaatttagctatattttaatagcaaaccaaataagatgaatataaatttattctaccaagtaattggtagtgccaaaatttacatatgttttagcactaaaaaaattagtagggcactgatccaaacaagcccttatttatttcatgcattgatgactggaaggggccgtgtttgaaagttgaaaccacacgcatgtttgttcatcggacggccacgtgctctcatgcatccggaccgttgatccgtgctcgtgtactacacgtttactcgtgctgtacttgtaagtcatcttttacagtacactggcaatgctgttagatttttcacgtcccgtttttatttaccccctttcttttggacgtctgtcctttttatccctttcttgaaaggcaaaagagatgctttcttgcaaattgcgtgggtcgtgtctggctgtaggacctcggccgacactcctgacgagggcgcaacgaataaaggagcatttgttggcttctgcgtgtggtgcacagttgcagtgttgcacaagggagatatctcaagactcgaggggcagtaaaggaaaaaaaaatgtttcagcaggagaaagaaaaaggacaactcatgtagacatctatctggtctgaatttttcaccaatatctacaaataggtcccaaaaagtttattgtagaaatggacattttctcgacaccaacatacgccgtggtacaacatgacaacgctaatgaaattgacacctatttgtaaaagaattcaataaaatctatttgtaattaaaaaaaattaaaaataggtcatcgacgccaataatatgacctatttcatattagtgacttaacttccactagagggcaaggggagatgttagaccacgtgccaataacattggcgccatgaaaatggtccatttttaaaataagttttttgggtctatttattaaatcagtttttttaattggtcaaaaggtgaaaaatccagcctacctagtactagtacattgcaagtgtactgtttcttataccttctactgtgcagctgtagcacagtacactcttctttagataatggaaaaatatatataatgcaacctatacataagtagtataaatctggaaactactgtacaattaaaaaaaagggcatatgagatgtgtttacgttactatgagtaaactttttactatgataacatggataaatatcatacgtacatttttagattttgcggtattttcaggtttgcacttaatttttttctcagaaaacatatttggtacagtacgagtaaagcgcgggaggggggggggggggttcagaaacctgaatgaactgcgagtacttcggccgtttgggcaaccatgatatcgccatacttttgtccctccgatttcaggtgtactacactctaatcatgggtcaaagcctttatttggcaactttgataaattgggcctatgatagatggctagctagatgcaaccaaaaccaaacgggctttggttctcagttcaaggctcaggtggatggacgttgggccagttgagaagttgtcatccaagggcccttcacacggtatgggctgtagttggatcacatcaactcatgggccatcacccatcggtagtttggtcttaactcagcccatctagtctacttcggccacaaaacaccaattcaatgtgacgtgtgatagttttgcggtaacgccgtaacaatatactaccttgctaagaatgaaaattttttactccagaaagaattttccatgagagatatttctcgaactaaaggaccacgcagccatggttgctggcttgctgcttgtctgttcttgtacagaggtgacaaaatggtatggtagggccaggaaactgttggtgtatgtgccaaaaacgaaaacgaattggaaaggaatcaatgatggagatatgcctttgtcaccaatatcaaatttcgaatagtctggaatatcccactagctccagacatgctgaggttgctctggctaacattgttgtgaaaatgaaaattgctataaccttattctaaacctgattagtgactgattaattcctttttctgaaactgataaatgtgtgatactaagaagggatttagcatcaattattgagagagagaagaaaatggtgagaaaaccactgttgagatttgagaaggactcgaaagcagggcagctggccagtggctttgctcttgatagctttctatatcgaccgttctcattagtgactgattaactggaccttttgtttttcgacatatttccagtgaatagaaatgctgaatgcctccagatattatgggttctggctagattttctatgagctgttgcattttcttggtcatgtggtcatgctgctgttctaaaacaaaacagagtttctcactctgtccagtgtccacatataaaaacatgcagccatcatattagcatcaacctgaccaacaaatataatggcactgaatcatttttatttcctcatcctttttattcattcctcccagagagacggatccatggaagttttcttgccctcatcaggcaagcagagcacacacacacggtggcagtggaagtgctatgaacaagacgctaatcaacatccagagctaaaacaaacaaggggatcaatgcaaatcccgaaaaaaaaacacaggggaaagtccacatcttcttctcgtccccaactcctccgtgtcaccaccacgtcttgcggatttttttttaccctgttctattcgctcaggcgtccacgatctcgccgtcgtccttcgacgccaggatcagctccgggtgcgccgccgccgccgccgccttcttgatcgtgccgtcgatggcgttcggccggccgagcgccttcagcgccaggtgcgccgccttctggccggagatcatcatggctccgaacgtcgggccctgcaacaacgaatttgttcaaatccaagaacgggggagagattatggtgaagagtttgatgtttttttggtgcgtaccattctcggggcgccgtcgatctcggcgacctccatgccggtgacgatcatgccggggacgacctcgcgggtgaggcggacgatctcgtcctcggcggtgttcatgtcgagggcgcgcatgccgggcacggcgtcgatcatgccgatgtcctgcagccgcttgacgcccgtggcgccgaacggcccgtcgtggccgcaggagctcaccaccaccctggactccatcacgttggggtccatgcacgactgcgtgtcgtggttcatcgacaccagcgcccagttggtgaccacgccgccgacgcggccctccttgacgatgaggtcctcgacggcgacggcgttgaacagcttcacgttggggcgcgccaggaggcggctcatgacggtggaggtgaagagcgccgcgtgcttgatgacgacgtagtcctcctgctcgtcgtacg

SEQ ID NO: 64699 - DNA, 6896 bp, Oryza sativa
acgtcggtgtcggcgtaggtgatcatgtcggtcatgtaccgccgggtcatctcgcgagacacgatggactccttgatggggctgaacctgatggcgttgaggtcgtaggggggagtggacgacgacgacgagatggagttgcagatggcgccgccggtgcgcggcgcgacggagacggtggggttgcgggcggcggcggggaggcgcgcgccagcgaaggaggtcttgaggaggctggacgcggtggtggccatggctgccatgcgagaggaggaggagctgagcttcttgctctgggatgaggagagtgtgtgtgagtggatagagcgtgggttggcgggggtataagaagaagaggagagcgcaaatatctgggagtgccgtccacgtgtcagcagtatgggcctctgggtttcggattgattggaggagatattttgggaaggtttagtgagggtttttggactgtcttcaggagaacgggacaagtgctgctaagtcacggactcacgggaacagtggtgctgtgttcagtgacagtgtccgtgataccgtgacgactaaggctgtgtttgcaatcctatgttcccaacccctctccctcgttttttgtgcgtacgcttttcaaactagtaaacggtgtgttttttgcaaaaagtttttatacgaaaattgcttaaaaatcatattgatctatttttgaaaaaaaatagtaaatatttaattaatcatgcggtaatgaatcgctccgttttccgtgcggggagtttagttcccaacttcccatatcggaacacaacctaataatggtttttggtgatcgattttttttatggctacctgtagtgaggggtactagtggtggagcccgggtggtcactcgacctgtacaggagctggctttgtcgctgactgtaataacatatcgagaattttttagtctgaaagaaatccaccataatatgttgttgatatcgtctaatatcgagaagtgcggttttaacttcttgtcacgcgttggtaaacctaagtgtctgtccctaagaaaactatctttgccaacttcttgatggatcgccttgactgttttgttgcacgacagtcgttgggaacaaagctcatcttcacaaattacatggaggcatggggtatactagtggtaaaggttccgggggatgaaaaccttctagttttttgggtttgacgatcgcgagcggggatcgcactacatgtttttgttgagcaacaatcatcgtttatttgttgaagttgtcatatttaggtctttggacgtagatctaggtctaatttcatatgatagcggctatctctgtttatgatagtaattgttttccctaaaaaagttgctttgttaatatatcctatcaatcaattgttttaatttctctttttttctaaataattcttttagaacttagttgtatttctctgtttttttcctacatccttgttcctaataaaagatgagaaacacccaggggtctttcggctagctccacaaggtggtgggctagacgacttggattcgaagcctcaacccttctaattatttgatattaggttattctctaatattcgcgttcctaataaaagataatgatacactttcagggataaataatggatgttttctgatctggtatatatttttttcctctcgaactaatctgatataaacgaaaagagacaaagtcatttttatttgttttttatcattgcagacaagcttaaatgatctacctaatttgaaatgtctcacagatcaatatgcatgatattgattataattagaatgattttactacagggacagtgaatttcataacttgaggctagtagatggtagcttctcttgcactgaaaaatctctggtaaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacggaggtatgattttgacttcagatattttacagcgaagtagtctgagtgggtttaaattattttacttttcttttttggaaatatcaaacctgagaagtaaaaaaaaacagagacgaagttaagttttgagtgaaaagcacagggaaaagaactttttttttcttttataaagagaactacattcaggggttgcaaggtttgttttaagggtaattttaccatccttgagaaaaatactaggtgataagttaaagtgagttcaaatttaccctttcccaacttctgctctttcgtttttatgcacacatttcctgaactagtaactatatgttttttaaaatcttctatatgaaaattgctttaaaatattatattaatccattttaagttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacatcaatagacgtgaagtagatcccttttaaatcctcttctattcctttaggtagtgtttggttgcaaggatgggatgagatgggatggaatgaacccacttttagaggtgtttggttgagaggtgagtgggacgggatggtccctagagaggaatattcctctcagatccgggatgaaacggtccgccaaaatcggccggaccaatccatcccacttcgacggagcccacggcgtcacctcccgtagcctcccgctcggctccgccgccgcctcatccgcgtcgacctccgcctccgcgaccggccgtcatctcgtccgcgaccgcctccgcgaccgaccgccgccgctcgtcgtcagctcccacagcctcccgctcagctccgctgcggcaccgccccggccgcccgtccctcccccagcgccgctccgtcctccttcgcctgctccctccaccttgcctcgcctccacgaccggccgccgcctcgtctgcgactgacctccgtcgctcgtccgcgttcgcctccgcgactggccgtcgccttgtccgcgactggccgccattgctcgtccgcgcctcgtcgcctccgggaccagtcgccgctcgtctgcgcctcgcctccacgaccggtcgccgccttgtccgcgaccgcctccgcggccgaccgccgtcgctcgtccgcgcctcgcctcgcctctccttgcctccacgaccagtcgccgcctcgtccgcgaccgaccgccgccactcgcccgcgcctcgcctcaccttgcctccgcgactggccgccgctgctcgtccgcgcccgcctccgcatctcctccgctcgcgccgacgagctcctccgtccccattctcaccactctctccaacctagccgctgggagcggacgaacctaactgtccgtgaaacattatccatcccatcccatcttaattctttctaccaaacaaaaaactataaccatcccataccacaaaccaaacacacaactagaaccattccatcctaaaaaacagggataggtctaacccatcccacttggtcaccaaaccaaacacacccggtggggggtaaaccaaccagacctacccagcctacgaggaaattcggatataagcctaaattttactacagaagaaattcttgggttcttcaagatagctgcacaacctgtatttcagtccttgcaaggagctatttgtcatatacttgtataaaaagcagggttgagaatatagttcacttggtgtaaatagcgcctacgagaacttgggcctaacaaaaagtgcaacagtttgtgtagcggttaattttggcccatggtagcggtccagatggtagctgtcctatttctatagagaaagtctatactcactcttgtccttaatcggatcgcttccctcaaccacaaaaccatgtataacgtcggggcttgctatctcgtgcgcgcaccaacaactaagctggcacacgtgccggctggcggcccacgcccctcccctacatgcgtttctttttttcttttttttgcgattttctcctattttcaagcctcttatcctaggcgtgttttaatttctttcgtgttctttttaatttttttaatctgcaggcacacttgttttcaaatctttaagttgaaagattttaaattaagttgaaagttttggaatcttgacttgaaagttttccaatctaagctgaaagtttccaaatttcgagttaaaagttttcaaatccgagttgaaagtttcaaatttgagttgaaagtttttcaaatttcagatgaaaagttgaaagtttcaaatttgagttgaaattttttaaatttaagttgaaagttttcaaatcttaacttgaaagttttccaatctaagttgaaagttttcaaatttcgagttaaaagttttcaaatctaagttgaaagtttcaaatttcagttgaaatttttaacatttaagttgaaagttttcttgacttgaaagttttctaatccaaatcggaagttttcaaattttgagttgaaagtttccaaatctgagttgaaagtttcaaattcgacttgaaagttcaaatttcaagttgtaattttttaaaatttgactttacagtttcatattttaagttgaatttttaaatttcaggaatgttttaaagttttaatataaagttttaaatttgattttaaagtttctttcacgtgtagatttctttcagcctgttagtaaaaaaatacttatagaaaaaagaaaaaaactaccttaaattttaggtttgtttttaattttcaatagaaagttttaaattttatttgaaagtttctttcatgtgtagatttctttcggtctgttagtaaaaaaactcccagacaaaaaaaaaacttaccttgaatatcatcaatatccaatactagacagagttagttacaagagttagttacagtagatgcgcgcgtctcccggaaaaaggaaaaagtccgattgcggattgggtgacatcgtgtgtgtgctacttctcttcccgacgtgtactcacggtacaagaattatgtgtaacgtctcccccaactcaaaaaaccggtgcaaaatcgattcctcaatggttcggtaagaggttgtgcggtgggcctcacctatcagttacactttttccccttaccccacctctccctctctcctctatcctatgagataggctatagggaaagcggctgccgccaaggaacaccggcagtagagacgaaatggcgcatggaggaatacaggagggcagagaatgaaattttaaaatatgcactattttcctcgattttgtatatatacatatatgcttttgaaaattttatagaaatatacatccgcatcaccgtgccgtcggcgcagctcgaagacgcgccgcagcgccaacacacgtgaccgggacggtcccgtgaggcccggcgccgcgtcggcccgttcctctgatgcacgtctgccagagcctggcagtggcgcagaactggcatgcactacgggtgcgtttggttgctcgtattcccttagcctggctcatctcttccatccaggctgagtctggcctggttgagaggatacacatgcagctgtttggttgcccgcatctgatgaacctggatctgttgagatgatgtttggttggttgcagcaaaggattggtggaatggttgcatgcaggagatgttgtttggttggatggatgcatcttgggtgtaaacaccctctcctatgagtggtgaggttaccctcataagtttgtggtgtgaaaattttctcaagtgtctacttctgtgcggtgaggttactccatgaggtcgtgttaaaattttatttgctctttggcttactattatttgtgagctaaattgcttaaaatattgctatgcacgtctattttatttggttggtctttgagttatacaaggaacagatcaaatttttggtctttgagtatatacaattacattgatgttatacaaactaaa

SEQ ID NO: 64700 - DNA, 1759 bp, Oryza sativa
  unsure (1)..(1759): unsure at all n locations
tatgtggtgtccactaccaccttaatctgcatctaagcaatattacataatatggtgtcccagtaccaccctctccataatagttagttaaatagttagatgctctcagggtgatgctcattcaggaacttcctaacccaacgagcacgacaagcctcattcttctgaatgtatacaaggctttcagccttctccttagttagataagctagaataaggtccagctgatcctcactgaaacctggaagatccatcactgtgttgcacaaatcagggtgaacctcagtatgtgcagtagcgcctattgctgaagccatgttgttcactgaatctgtcatattgctgatgagagcaacttcaccttcattcaaagcagatgctctcttcctcttcttatctgaggtagaatcctcatcagtaggcccaacaccacttgctcgagcagcaattccaggaccttcagcacccacaccacttggtccagcagcaataccatccccaatagtgccatcaagaggtcccagaccactgtcagcctcaccagcagggtttccaagcgcttcatttgaccccatagcaaatctcccagtggcttgcctatttgaaaaaattattgccatttgtgtatagttctctaaaggcacattgagaaactcagcatccttagggtgttcctatatgagaacattagatttaaagtgagatatgatgtgtactaatgcagtgtgttttgtatgtgatagttagacacaaaccttgacatgtcccatgtagtgctcctcttctaggataatcgttgaggtctgatcatcccaaagagccccactaaggtctttgagcctagtgatacgcacccacctttgacgccatttgcgaagatggttatacacttgggttccactaatttcaattccatagtgatcagacaaagatctagcaacttggttaaggtgagcttcattgaaacccttgtcagtcctaacacctgttgctataagctcaaccatgcgccttagcattaagctagacatgttggttgtccaatgcaaggctccatggtgtccaccatggccaccattcccgccaccagcctcagccatcctatatttaccacatgcaaatgaacaaataaatttaacataaatcgatagatgtaataaacagcatcattgcaaatatctcgaggtctcaaattaatagataacagtgcaacagggtacaacaatcatcatgcatgaatagataacagtgcaacaccatcctaagttcacagatagagagttacaaattaatccctaagcatgttagaccctggacgaccctctattgttccacatagcaccagccaaatcatccctaatttgcgccattcccctattgtcttcatctaagtcatcgggctcctcatcatcgctatctgagttccaatcactctctagtggcacatggtcatccatcccaaactgaagtatccagttatgaagtatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64701 - DNA, 3292 bp, Oryza sativa
gttggtatgctttctagttataagttaatcatctctaggattcgtgagcagggttatgttggagcttctaatatgagaggggaatttaatggtgtgcagaaattgattagggatgaaaacccttttgcttattttgtccattgttttgcccatcaattacagttagtggttgttactgtttcatcttctactgcagccacgatagatttttttaactatgtgcctttaatagtcaacactgtgggtgcatcttgcatgcgaaaggatgccttgcttgcaaaacatcatgatgtattgttagaaaaggtagagaatggtgagattaccacgggaagagggctgaaccaagaatgtagcctagctaggcctggagatactagatggggatcacatcttaaaactttgcttcgcattatggtaatgtgggaagctatcatattgtcagggttatggataccacatacctaatagtagttgactaaatctcggcaggacccaccacataccatgtcttatacggaaacaaccttcggatataggaggagttccgcataaggaaagatgagtatagttctacatggaaacgacaaggactactcggattgtatccatattggtttccctagttctacttggacaaggggacacctatgggtataaatacaaggccccctaggaggagaggggacacggaacaatagatcaagacacaagatcaacatacaagccaacatacgctaagacaagatgccggatatcgacttcagagataagcatgcctagtcccctatggtgtctacggatactgtcaggagagacaaaagcgctgtctttgatctcgccggatgcggattcgaggaggaaggctaccctgttgttgactacgagtcaacacttcagaccgccaagtcgacaacagatagataggctaccccaaatattgtattggtgtgattatgatgaataagagcaacgaccggcttcggccaacaggagtagggtcattacctgacaattcaggggcccgaacctatataaaaatcttcgtccccatctcttttattacaatctcgcatataccctggtaccaacgatccccatactatgcaaatactggaatcgcgacatcaaacgtcgacacatatatgtgcttgagaatgttaagaaagattctactaaaccaacatttattggtggagcatttggtttgatgggtaaaatgcaatggtttgattttgtgttcataatgcatttgatgatagacatcttgagtataacagatgacatgtcacgtgctttgcaaaggaaggatcaatacattgttgaggcaatgaatttaatcatttatgttacacaagggagaatggatgggagcctttgatgaatagagtagcatcattttgtgttaaacatgagattgaagttcccaaaatggacaaggaggtaaatgaaagtgggacatctctatgtcgaaagcacaaggtaacaaataagcattattaccatgttgagatctttcttgcagccatagatgcaattttggcagaaatgaatcgtcagtttagtgaagttagttcaaagttactaagtatgcatgtcagcctttaatccatggattttcttatctaattttgatgtggataagcttgtgaggcttgctgaaatttatagtcaagattttttggttggtgatcttatgcttctacggcctcaacttgcaaattttattaccaatattaggagagctaaagaatttgttggatgtaaagatcttgcaaaggtggcagaattaatggttcaaacaggaaagaacaaaacttatccattggtgtataggctcattgagttagtattgatacttccggtggcaacgacttcagttgagagggttttttcaaccatgtctcttataaagacaaatttgagaaacaaaatgggggatgaatggctaaatgacttgatgatatgctatactgagaagcaaatttttagaagtattagtaatgaaaaaatcatccaaaggtttgaagatatgaaagcgcgtcggatgttactacctaaaaataattatttgaagctattgtttgtcaattgtcattattcattaatttgacatttcttttttatagactacccctgatgaagaataattggcgatagggtgtactagtgtcgcacatcatgcatcatctattggacatttcaatattgctttgatatggataatgtttatttttcggtaactctatatatttatactttgtattagacatatagccaatttatatgagacatatctcaacttttattggccacttttggtttagcccctactataattttatcctggctccgccactatgtataactagacttgtttttaccatcacatatttgcaagcggttaaatagtcacattttttcaaagtattgtgtcatcttttcagctttcataaaaccagaatacgactcctatatttgcttggtaagtcctataaacaaaaaaaaaagagaatatattgagccacacatattataccaattgcacactacctccccgttttccgcgcgatagggcaatttcccaacttctaacttctcgtttttcgtgtgcatgctttctaaactattagatgtgtttttttcaataaaattctatagaaaaattgctttagaaattcatatcaatccattttttaagtttttcagctaatacttaaataatcatacactaatgagtcgctccgttttacatgagagaagtttctaatccttacattagaacgcacctaaggaatgtactccgtacttatcactagaccactttactgttgacaactatcaaaccggactagcggaccaatgttgctttggttcagtttattgtaaggacaaaatttaaaaggttcagtttctagctggaagagacctcctatcatatatttctagcaggaagagacctctgatcatatatttctagcaggaaaagacctgtgatcatatatttgggtgtcagataaattcagctgaactaaaagcttgtcataccttcagttacctactacaagtctacaaccatgagtccatgatcaactctgaattcagataggtggaaacatactgctgaacaacatagttttctatagataaatgcatgcacaaggagagcctcaaggtagaatctgattgaaacgtcttcacaagaccggtggcatttattcaaggagaaaaatcgtcctgcatttgtttcggatgcaataggatcataagtcccattttagttcttggagtt

SEQ ID NO: 64702 - DNA, 3741 bp, Oryza sativa
aattgaaaagcttgaatttctaacaagtaagagacctgtcatcacatatttggggtcagtgaatttcatttgaacttaagcttatcataaacaagcatttgaccaactgtggtgcttgcagatgggtttggacaattttctatggatcctaattgatggaagacaaatgcaaaggtcaagagccatgctcaggaagaaattcaagtttcaacctgattggaatgcgccatggcaacattcccctcctccatgtccttgagaaattcagcgaatgcagtgcacgatgatcccccttccttccatgctgccgctgcgctctccttcatcgccatgacccgctccaggactccctgctgcgcatccgattccatgatccgcctcaagatggcatcgacgatgtcggcctggacaagtgccccgggtttataccctctgacctcgatgccaatcttcatctcctccacgatgaacaccttgttcatccactgctccgcgtcgagcggccagcacaccattggaacgccggctgcgacagcctccagcgtcgagttccatccacagtgcgtcacgaatgcgcccgtggatgcgtgctgcagcaccgccacctgcggcacccaggacgcggtcaccacgacgcctctgtcggctgtccgcgccaagaatccgtcaggaagaagagacatcgcggcgtccggcttcgtgcccgcgggcgcgcgcagcgcccacaagaatctctgctcggacctctcgaggcccgtggccatctcgctgacctgctccggcgagagcgcgccgcggctcccgaagcagaggaacacgacgctgcgctccggctgcgcgtccagccaagcgaggcacgggtgcctctcctcctccgcgccgccgtcggtgatcaatggcccgacgcagtagaccggcggcgtggcgcggttggagaggcagcggccgtccctcagcgccgccaccccgggaccctccagcgcgtcgaaggtgttcaccagaatgccgcgcgcgtccgccatccggtcgaacgcgtccagcatggccgcgcttatgtccgtcccacggtcgagcacctcctcgggcaagtgcgacgccggcagcgggcgcacgccgggaaacgacacgggcgcgtcgccgagctccctcaagcttccgctgctcccggcgcaaaaccgtggcaaacggaggaaaacggcgaggttggtggcgccggtgcagaagaggaggtacccggggacgccgagctcggcggcgacgtcgagggcgtagacggagaacatgtcggccacgagcgcccgagcggcatgggggccacgcagcaggtccccgagggcgggcgcgtgggcgcggaggacggcgagcatacggaggagcgggtgagcggcggcatcggcgccggaggaggcaggaggatgaggaggaggagggagtggatggacggagagggaggggaggcgggatgcgtacttgcggagcgcggcggagaaggcgggggcggtggtggccgggtcagggacggcgaccgtgacggcgaggccgtggcggatgcaaaccgcggcgagctccagcatgggggcgagatggcccacgccgaggctggggaacaagaccactctccttgcagccgccattggaggatcgctgctcacctctgctcttgcctttcttgaattcttggtgggcaatccgcgacggatagagacgatgcactactaatcaatctgagggactttctgccctttctttttcatttttttccccttctttcgtgtggactagcgtggcgtggttgcttttccgtttttgtttaatcatcactgtcaaatatatacacatatcactgtatctgttcaactaatgacctaactttctacttcgtactaaaatgatccaaatggatttggggaagactgcaaattgtgcgttcgatttctgaaaatttaggcgttgtttcaccacttctatgtaaattattttattacttttaaatgtatcaactaattacacattaaaaaaatatcgcccttaaatcaataaccactacattaaacattaaacccaattaccaaaatatcgaaaatattgaatgtgcaacgagtcgtataaatattggcttctcacacacggatcattaaatttgaacggttgattttttttctttaacatataatcctatggcctctttcaaattaatcaaaatgaatacaaccgtataattgtataattgagcaaatactttagggaaaaattagaacatactaatagggtacttggatggatcaaaagcatgggtgtcagcttctagccttccacagaccacagctaacacgctggatccggcaggtggcaattatggtggaaagaccgcttctcaatcactccacaaattttctctaaaattactctgaattgggccatctatctatctattatatactaaaaatccattaaactttatataaacgcttctaaaccaccatatggtatcctataaaagctcctaagctaccacatggcactctcataaatcggtggacccactatttttaactattaaatttctttttagaaaaaaaataaaacccccataagcaatctctctccttttccctattggcctatatggtacatgatccttcacttctccgctggcggccccaagagaaaaaagcaagaaaaaaaataatatgcacgtacgtaaatatatacacgtattcatggggaaaaaaaggaaaataaaatatgtacgtacataccccagaaaaaataacaaaactgagcacagtatcgatggaaaaaagaattaaagaacatgtacctacgtacatatgcacctaccatcgagaaaaacaacgatcaataaaacatagaacatccatgctctctataataaaagaaaaaaaatactacatcacgtattaacaatattttaattaaaaaatcacaaactgtattatacctttttatgccttttctcacaaaatagagttaataattacggaacaccacattcatttccaaacatttccatctacttcacctccccctccccttcccctcatgtatatccctgtttgctccttcctcttgcttgaactggcactatttattcttttcccccattcctattatttggttatccaactaaaatagaaataatttgtaattgtaattttcaaatgatgataatttttaaactacgtgctacacgtatgatttctaatataactatttctctatttataattaaccaaacaaattaagattcatatacctatgtttttctatatatgaaatatatatagtcaatgcatgtattatatatgccatccaaataacaaagaaatatgataaagaatatcaacaaatattacatcattacatagatcattctataaatatgcatagctaaactaaattagtagaataaaaaatatatatttataaattcaagtatgaaagaatacttttatcgatagacaacacttgcctttttacatgtcgtctgaattgcaataaaaagctacaaaataattcaacaacacatgttgcgccctcatatatcatatgtagattttttctacatctttcagtatgaacacaattccatttatttctttgtgcatgaaccattaaaaacaattgtcatatattatacacacaaattataataaatttattcagactttggaacccagacattttcttgcgcaaacaagtgcatgggagagaaagaga

SEQ ID NO: 64703 - DNA, 1947 bp, Oryza sativa
  unsure (1)..(1947): unsure at all n locations
ttttaaaaaaattaaaaaaacataagccacgcttaaagtgctagtcattttttatcatctaataacaataaaaatattaatcataatttttttatataaaacgaactattaaagttggacatggaaaatcattggctgacgtttaaaatgggacagtgggagtacctaataatagctcatctctaggctaataacctatctaattatttaggggatagatgttactatcgagcaaggtaaagagtttcctacattaccaacacctaacaggctaacacacatagaatatgtcctcatcaattggttcttcctgtagtgatgttggtaaattggcatctcttacacgcatcatattcacccaacgcgcaccatctcaaatgcaacttccattattacaatgttgagccatatcattattatatgttagaaatctggatctttatctaattaaatctaggaaggcagaactttatgacacctgacacctcctaattggagcctggatcaagattagccatgtccaaggaaaaagttgtctcagtgccaaaattacctatatccaggaatgggtcaagtgagtcccactcagtaccagacacgcctgaagcatcacaaatcggtgcggtgtgccttgccacattctggctacttgaagcggcacctgaaatggtccttccatgctggtcgtctttattgtttgaaaatgtagcacccccaagatcctgagtatcaggtggtgttatgctgatgcgagctgaatcaacattgaaaaagtgagtaggataacccaccatgtaatcagcagggctgttgtatgttcctccttttgttcctgcaatagccacatcggcatcaattctactggacgttggaaccagcaattccccatgaaacttatttaaaacaatttcttgatgttctccgatgacagtgtccttctgcaccaaatgatctctggacatctccttcacttcatggttctccgcagtattgtcttccacaaaagcatcaattggagcatcgtcagtagagaatagccattcattgacttcatctcctgaattctcggtagcttggtttttacatgcagagtggaggttcttacatctcccggaatctaatacttcattgtctgaagcaatcgacagggatccttgatcaccatgagctgctcttctgagaggaatctttggatcatattgtagacaatgttcacgagggtgtacaaggacatccaaagccagcaaagcatgtgaacaaaattttgcaagctcggtaccagtctctagcctccctgttatgacaagaaaagataaatactacaacaaacaaaattaacacgttttgagaattacatggatgtaattaagtaaatgaactgctatatgaaatgcatgatttatttagctagcttaacaaatttcatgcgtatgtgtcctagtgggtttcttctgtatatcgttaactctacgttttaccaatgaattagcaaaactggaatgcatgtggaaatagatgataaatacagcaaatacagattggctcagaacctggaagaaggtattacctttgttgaagagctcaagacctcgttctaaataaggacaattgtcaggagaagaaagaaaggatgccaatagagattttaacaaggctaactggaagtctgaaaaagttggatctcctgccaatagtggtcttagttcatacatccccatagtacagaaagactctcttgcaacattaataagaagcaggtctatttgtgtcctccagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64704 - DNA, 11890 bp, Oryza sativa
ctagcgcctcccgccatctggcttcacgtggacggctcggatttcccctatggcggttgtagggtgcccgaaagtttggcgctctctccgacttttttctcgacgagtgtagcttcctaggaggaattctggaggagtaccggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagatattaacgatatataatcatcttcttaaaatatatttgaaccatgtgattgggacagatcgaacagcaagtcgagacagtataaatcacttatactcaaaagtactttaagatgaagattatatatacatttatagcatagccgatcaaatagatctaatatgtatcggctaatactccgataccactctatactaagatattgaaacaaacaagatatattagataataaacctaattctctttaatgcaataagatcttaacataaagggcagatttatcatgtcaatcaagcatacaaaggacaaaatagctaaatcaggtaagatcggctgaaacaccgatactatctctattgatgatcataaaagagctagatattagtagttataaatattacttaatagatcgaactcaaccaatgcagcattaagcataagaataaatacaagatctaagcaagatgatgaaaatctctaaaagatggtagatatgctatataatctagattaataacgaaatctaactctatcgaatgctcttcggtaacagatatcaatcgatcagaggttaaatcgtgaaactaatgaagattatgaagcatatatgataactcgacgatttatataaacaatattagagtatcataaagatggaagcactaatcccgagaacgcaagccgccatgacaagtttacctctttttgaagatcgaaatcgatgcagctcaacccaaaagcaagaactcgtcgaaaacaatgaaagtagaaaagggtgacaatgcgccgaaagtgttactgaattgttgttgttaattacatggttttggatcatatttatacccgagatacatgataagtccttgccggacatgactcttatctctaacaaactctaagatacaaacgaatctttacggcagactcttgccgaaacatatctctaaagaaactattcaaaatatcctaattagtagatacaattgtctatctgcgagcttatctctatcgtggcaatcctgatgtagcacgtcggtcgattccggaaacagtgtcatcactatctcaacgaaatcggctatattggctgtatcggctatctcctgtccgatccatctcagctgatgccatcttcagccgatgcccttgcagccgatacgcactctgtttcctaaatacgatccttcactgaatccactttgtttccgatgttgaacctggttcatggtttaccaaatttggtcgttaacacacccattccctgagttcgatatccgtttggggtcacccgaaggtgaagtgctgcagcggtattccgtgcgcttgtggatttatctatggtcgtaagaaataccaacactgggctgggtcggcttggctagattgggccgggaagggaaggaaaaaggagttgggcaccaaggaggtaaagtagactttttgtaaaaagtagggcacccttttacagactgtttgaaaattggttaaggaccttaaaaagactttgggttataccttttaccaaaacaaattttctttttctaaaaaataaaaaataatcataagtagataatttttatttatcaaacccttagggtttaattttaccttatttttggcaccggcaaataacagaacaaaatttggaagagccagcatgatgcaaatttttgtaagaattttttgagcaataaatttggattatgaaatttttatttactagaaaaatatctgtgtgttgcaacggatgaaggctattttaattttattattgttatatggtttagttaaggtgaaattcactgtgcgaattcacttggatatatattttttagaaaatcatgagctgcagttaggagactagtcgtctcaagttagcatgcgagttttttaaaaaagaaatttcttatacgactcctgtacttttaaaattgaacgaacctaaaaacatatttaattttttataatatttttatttatgaaattttcaaggtgttactttaggattgacatcgtatcctatgttactgtaaatttaatgtccactaacttctaaagcttaacatacaagtatgccacatcattacatactagcaattattatatagaacattttaaatatcatgcaaatatgacatattattcataatttttattgcatttttaaaacttaatatgcaagtaatgccaaatcattatctccacatcatttttacattatttaggcatatatgtttatcatttctataaggaaaaagtacaaattaccccccaaactattgcggtcaaccaaattacccctctaaacccaaaaactatacatcgttcaccctgaactttcaataccggacaaattacccccctcgacccaatccagaacggttttatcctatatggctacacgtggaagtcaagtcagcattccatttataaaaaaaaatgtgggagccacctatcatgctttctcttctctctcactcttcctctctcttctctcggcgcggggtttggcaggccggcctctaggtcgatggagaaggggcgccattgtccagcgggatcgagccccgttccccccgagaaggcggagtccagacggcggcggtctcatacggaggagaggtccctgtagccggcggcgggcgcccatcgtcggtgcgggatttgggtgggcgagaggcagcagctgcggaggagctggccagcggtggagttaggggcaccgtcggagcggcacggtggagggggcccgacaacgccagccgtgcaccttgtcgcagtgaagaggtggctgtttcccttggcgggggcaaaggattcccccgagtggcagaggagcggcgtggcagagagggcctgacgacggagatccatgcgtcgacggtcgccatcggaggtgcgggcggcggatggccacagggccggatgtcggaggactgtggggctgggcgccaggcggtcggtggcctccatccggaagaacaaggccgcgaccgaccctcgcttgccgttgtcccactgccatctgccgttgtcctcgacgccccgagcgacctccgccgccatgccaccgccccaagctgtgtccgcccctgccgccgtcccgccgcccttgtcctccaacgccctcctcggtgccgcccactgccgccgcgtcctccttgcactccgccaccgcccgcacaccgccgagagggaggggggaagcgcgccgagcggccgcctcctcatcccctgccgccgctgctctgtgtccccccctccccccgccggccgctgacctgtgagagagagagaggaagagtgagacagagagtgagagagagagaagagagagaggaagagtgagagattgaggaagagtggaaggagtataataggtgggtcccatattttttttataaatagaatgctgactggactaccacgcatacgccatgtagaccaaaaccaccgcggattgagtcgagggggggtaattcgtccggtttatatagttcggggtgaagaatgttcggttctgttgttcggggggtaatttgatcgaccgcgatagttcgggggtgggggtaattcgtactttttcctttctatgatgtactccctccgtattttaatgtatgacgccgttgacttttcgaccaacgtttgaccattcgttttatttaatatttgtgtgcaaatatgaaaatatttatgtcatacttaaagaacatttgatgacgaatcaagtcataataaaataaatgataattacataaatatttttgaataagacgaatggtcaaacgttagacaaaaaatcaacagcgtcatacattaaaatatggagatagtatataatatgcattcagtcacatgtcccgtagcaaagcaaggcgcggagtatcgactggttctaaatatattcattacctcgtctagggagcttccaaaagcttgagcatccctttcctttatctcccgcttcagtaagcaccgatatgccttagtaattaatgtccccacctcaagaatcaaattcttttcgtgttcattttttgatatggccccacccatcctgccttatggggcgcactatttctctcaactccttttaaaagatcattaagaaattagaggggctcttcttcttctatcactaacaagacaaggtttctaccaccagctataggcacatttccataaccaatcgaagttgtatgcatctgtgtaactagctctgccatttggttggaactgcccaaagaaatctacggtatgcgttactatatataaaccgatttatagtcttgtttgtggcttgctgcttaatttcctgtaaccgtacatattttattatatgaatcaatatggtctgtcaaatttgtgtatactatatcattagctagctaggtggcattgtctgagatcttacttaagcaattaactagctagtgtacgaggtctcaaattaaacaattgcatgcatagccaatgaatgcaaaatgctgaacttcaatcaagccatgatctgcagttgctgtctctttctgttttttctaactattttaagctaatgatgctgatgccaactaaaaataacattgctacataaatcgtaatcaacggacgcatattttgattgggactggaaatacaggggatcatgtagttggtaagcatattgatattgatagaccggtagcgctacatgacttgtagcgtgctaggaaaccgctagcacgcctcacaggaggctctttggtattttctcttttttctcctcctgcttcctgagttatctgttgctcctcacatccctcatgcatgcacctgtcagagcattaaaaaagttacttttctctgaatccgtatgcatccatcgcctagtaagaaaaaaaaatacttgtttgcttcagtaaaaaaattactttcttgcttcatttaaaaaagatattttcccattaaagcaaatagtttttattggttacaacatttgtgatgtttttagtggttcctttgtaattatcattttgtaaatacttttcttttaatgaaattaaatggcagaatagctactttagtccctaaagtttctccgtaggatcagtttagtccctaaccttttaaatggttcaaagaaatccttaaactttatcataaggcctagaatagtcattgggtccaccaaaatcatcatatagatatgccatgtcatcattcatgcaaaatctatgatgaattgtccaatttactcttacttatatcatagaaaaataaatataagggtgaattagacataaccataggaaaaaaatactcatccttttttttcaccgttttgaggtatacttttgctcttacattttaccttttgtctttttattttgctatgatatatataagggtaaattggacaaattatatagattttgcataggaatatgacatggcatgtccatgtggcgattttggtgggaccaaggactatatcagcccacgtgacaaaattaaaggacttgtttgaacaatatgaaagattaaggactaaaatgatccagaagcgaaactttagggaccatattggctattctcccaaattaaatcacactacaagataaagccctggcagtgattaaattaaaaaaaatattttcttgcttcctgcattgcatgcatcaatcgcccaaaagttaaaaaaaaaagggtcaatgccagattaggtcccgttaacatttccatgtcttgtcgctcttaattagtttcatccatagcaaatttatttactgaggtttattgtaagtagtaatataattacttggatgtttctcaacaccatacatacgagtataataatttatttactgtagagagtacacaaaaacaagaaaaatagatatgtgtctcctgcacgcgagcatagatagcagcagtcgaaacgcatccgatgtaaggatggcgacaggtaccgctgcgcatggtctgcttgcttctctcgccagcaccgtgcgtcgtccaccgtcgctcacgatagaccgcctcctatccgataaagagtcccaccggcggtggcgaggatcctgcatcaatgtggatctgccgtccatggccgacttctccgactcggataccacctcccaggcgacggggacggtccccagctctgccctcaccacccctctccctcagcccttcctgttcatggtggttatcgacggccaccgcaattgagcgcgaggggagcgacaccaatgtcttttttatttttttttttaaaaaagaagggcagaagctttgtcgcttatgtactgatagagaaggatgcggcttataaggagtacaagtgtacaacaaaactacataatatttaccgagtccaggcacaagaaaccaagcgggcccgcaaaagaaaccgatgggacctactctgctggggtaatctctgtgagttttatcgcacccgcaacgatccaggttcacgcctctttgttctcgacgatgatggtggccggcatagaagccacttgcctgaaaattctaccatttctttcgcaccaaagctcccacgctattaggatgatcaacgatttaagtgcctttcttgaactgttcactgtgcgcgagattttgtaccaccaatcttctaccgttgcgcagtctttcccactcttgtagtcaaaggtccacccttgtccatctttgtatttccgcccagatcattttggacagtgtagggctgatacaggcacggtgcgacagagggtgcaaaaatgttgattagcttccaccctctcttctgtataatctgtcagccgtcatactctaatttcgattttcagccaagagaagaacttgcatttggacggagccaagcaattccaaatagtctggttgtaaattgttctgaccgctccaatgaattggagtctaagcgagcgaagatgtagtgcaacgttaaagtcgggaggcagtgatggcagtcgcggtgagggggttgggcgcggatttgcggcgccaaagaagaacagaggcagagggtatgacgacgaacatgggtgtgaaattgcggcaccggggcaggaccattacgttgtccatggagttctgcaccgaagggggggggggagggggtaggaggaatgccaatttgctgaattgcgacgatagaagtcttcgtcgcagcgtctcaaacacgatagcaagcagcgtggcatcgtcttgatgtcaacaaaagcaagtgatcgtaagcaagcaggccgctgtggtgccagtgcacagttcacgtgggcaggactacacattagccttggcgaacacctccaggagcccgtcggcgtccgatgggcctacatatgcagtggaggcatcggccttggatgacctcaggcggcaaaggagtgttgaacattgccttgtactccgcaagggcttgatcagtgagtttccctttcagttggaatgaagccaagctgctggcacaaattaagttgcgccttgatcgccaccggcactttcatttagccagtggcttcttggctagtcgcctgctcctacgcaccccgttgccttctatggcatcgtccccaatggcatgttttggatagggcacccgtggcataggcaggattgctagggccactggcttgaacaaggcgcatagggtctctccattgtcgtcatcatcctcagcattcctcagggccggttgctctggtgccatctgttctggtcccggcgtccatcggttgcattggagttcacgccggcgatggcgaggtgagctgctgtagcagcaactgctgggtgtcgtccccagcggtcggtggcgcttctcctgctccaggcaatgtgaaagctatcagctccggtccctccgggtcgtccacaaggaggccccgctcctgcctttcctaaagggcatcatcaacctcccacaacgatggaggcccttctagatcggtcttgatgcgcttaaagaccttgcgaaccgggatggttgctccggaccaggcttcactgcctagcatgtgtagtgagagctttcccatgatcgtagcaaggcggtcaacgaccatggaggggctgagggttcacaccgtgatagctgtagaatgttgcaaggctgagagcttaaggtggaaaaaacttgttaaattcgcgtgcatgtagatcttcatcggttggcaggctcttgtgcacgggagggaggaccagcagctcattggccaccgtcaccgctgtcatcatgacgtatgccgtggcggctgctttctccagcattcaacaccgcagcgagtacgtgtgctggagcgcaccgttgagcccctcgcatctatttgattcactgccacgccccacgtccttgcctctatcgtctttgtcgtcgtcgcggtatgaccggcgtcagggatggtcccatagcttgtcggggtggtcatcgttgtagcagcttcggcagctactgctctccttgcggcccttatccttgtttccacttcgcagcccattgtgctccttggggagacgcggcggctatgggtgatgggggaactcctcaaacacgcaggccagcgactgctcgccatcgatcaccccaaggtgccaggccaggaggcttctcttcattggctcgcacttgaccgggttgaggaggtcgacggtcaccgtggtgttgtcatggatttcgtcgtagtggaggagcaccggatacttgtcgccgtgttgccattgttctagcgatgtctctatcaccaagacggacttcgtcgagccatcccacacttttttggtgaagatgagccaaacgtgtttagggatcatgctcgggttcgccatccatgtccagagcttgatgaagcgcgtgtcgaccggctgcacgaggttcatatcaactgattccaaggcgcatcggcgggcaatgacttgtttgatgatgtctaggatccaagcatggcggggaactctatcgagcactaggcacacacaaaacatgagggctgtgtcgagcgcatccttgaggctcctccacttgatgaagtgtatctcgataccccaacgattgtcgtaccccttccagagtgcgtcggcggagtgtcgactatggaggaactttatgaggaaagcctttgggtggtgtttcgtcaccgccaccacatcaccgcgtaggtcgaactcatcctttagcacttactccacctacttggccgtcgtggtcgacagggccttctttgcccaggagaccatagcaatttcctcctactcacgacgctcctgctcaagggcgaaggaggaagggttgatgcattcatcatgcatgggccttgtagtggcatttcctagaagcgccatattcccggtcagggcacacggcgacggaggtggcaggcgctctgggtgggctggctaggccagctaagagcttttccagtgtggcggccaaagctgatgagggacggggtggaggtgtgggcggcggggcatggaggatttgtgtggcaaggagcaacggcgagggcacgcagtagtgcggcaatcgcaatcgcgaacccagtggactgagtgcctgcaggagaagcatcggaccgggtctctgcaggtggacgcacgatggtttttatctaggcagatgaagcacctaccctaggtcttctcttgaaaaggcacgaagcgaggacgtggggtgggcgttgagcttgaatggggatgtgaaggccgtgccgtcctccactgaccatgggcctttacctgagtccatctgtcgtttgtagcattaagaccaccgcgattggtctacgtgcggaggtgacgccttgtgctaggctgcgcgttcgtagcctcataggagggtgggtggatggcacccgtattctccctgaggatggcaaagtaattgctccggacgggcacagtaatgactgatttcaaacttggccatgctagagttttggtagggagcgggattggagacttagcacattgcgggttgacggccgctggatccagagtctctggcacctccacgacctatatgtgtgtactggaaaaaccattttaatcgtattattattagattttttttaaaaaaaagtatatgggatttttatttgaagatagtactgatatctaatttggaatccttctagcttagcatttatattttctaagatcttatcattggcagctagcttcttgcttaaagcatcattagttttagcttgtgcaaagatgagatccttcgagaaaggctggttattgaagttaccactgttgttgttgttgcctccttggtaaaacggcgggcctggttccacccctgacctccttgtggatgatatccattgttcatgaacaccgcctcttcacgggtctcaagacagtctgtctcggaatgacccgagttgccgtagacctcgcacgtgatgtgtgcatccaaggccttaacggtgccttggggcatgttcttctcttggtcttcaaggcgattcatgaggaggtcaagcttagcagccagcatttctatctccttgacagtatgcatgccacactggcgggtctggagtcgttcttcgctctagcccatgtttgaaaccatcttctctatcagatcgacgacacctctgaccgttttggagaagaacgcccctccagctgcagcgtccaggtgatcccgggacaagggagtgagtccgttataaaaattctgcaggatcagccagtcgtccatcccatgatgaggataggcggccacgtactcctgtagcatttcccatgcttcaggaatcgactcgtcccttctttgctagaagcttaagattcttatgtgaagggcattagttttgcccttcgggaagaatttggagagaaatgccgtagagcatttgttccaggtatccaccgttgcatggttgtcgtagaaccactgcttcgccttccctagaagggaaatgccatagagcatttgttccaggtatccaacgatgca

SEQ ID NO: 64705 - DNA, 24814 bp, Oryza sativa
tagcatatagtaatctctttattaatcttcccagcaagggcgccaaaaatgtttgttagtgtttcttaacgacattatagaaatataaatcccagcaatggcgcataaatattcctggtatattacggttagtgcgcagaaagatccgcaagcgcacggatataccattgtagcatttcaccccgaagtattccaaggtatcgtatttatttaatctcaatggaagattgataagagaagactatactaataattaataatttatatgttacctatataagtcacagtctaagcttgtgttaattaattcaagggtagagtgacacgaagaagaagaagtaagttactctcattaaataaatcctaggctaagtggagaaagaataagaaaagaattcatcctaatacttccagtatacaggtatctttaatttacactatctagtatacaatcatgtagccaataccccctaactaagccctcctggtatttcaagtgaccacccctgattgtcgagtcccttacgacaacccgtcatggccgtccaaccgaaaataaatatggaggagtacccataccatgaaattaacttaggattatatactaacatggaggaatactcgtactgagctgtcaccatcagcggccaacctttgttgtcccgcagcatataacccaaaataatgatatttaataatctaagcaccatgcttaaattatcaaatactactctatatccgctaccatgacatagagcaatcatttgcatggtcattatacccacaccattgcatatctctggtaagctagctacacaattatatcgagataaatgtaaagtgaagtcggtacccaaataataagagtgaagtaaaataccaaaactgaataaagaagcatattccattaattgtgtaagtcttacaaaagagagagaagatactagagccatacccgaattctcctgaagactcgaggactaagaaaactattctatttcctactccactagcactagaatactaactaaacttgagagagagctttgatcttcttgttgagtctgtggagaagtgagtgaggtgagctccttttatagactgagtatgatggttattgcagatggaaaggtcggaaatgccctacagccgttgttggaagtgaatcctgaatgtccatgccaaacactagccttaacggctgtgatgggggtttggccgaaccgtgacctggcccaatctgcccaatttttggcaggcctcctccccgttgattcctcagtccagtgacgtggtgttttgggccttttgagattatttctctggatttgtaggcccatctatccacaaatctacctctcgacggctttcgattggttgttcgtttgttttccgtcgattctccttctctttatatagcaatctctgaaatcaaatagaatccaagtacaagtaaattattctaaaacaaatatacattgtaagcatatctagttctcctttattttgagtatattgacggttgaaattggtctataacgaccatcaacaggcgtcaagcggctgttgatttgtttagcgcttaaacattcttcgtaggcgacaacataacttagttggtcacccgcctttgaaaatagcctttgatcgtagacggagcagctggccgcatgcaaagaagatctactttggccacatgcgaaaatagttttcgtagcagtgattactgcatataaagtaagagtggttaaagcattttcctatgaaggatatttagttgataatatcacaataaaagatatacattgccaatatggcccatcacgatttgcacaagtacgttgggattttgtattattaatattgattttattgaagagatagattaggtttccaacatatgacgctaaatttgcaaagagaagcattgaatcaaatattttgattttacgccattattttttaataaacaactaggtgattcctcgcactttgctgtgggaattactaagtaattttaaatatatatgtttttttcaataatcgagcaaggagtaagcttgatgttaattattagtaacaaataaaactgatttgtctggccatgtttggagagaaataaatttaataggctttgtaaaagattatacatgaaatttaggttgttggccaagatttatatcacaagaaacaaaagatagggaaaaaagaaataaaaagcaaggatttattagtagtaaacatgtaacaaactaaataatatctctgctttgatacgggatatatggatgaatgtatgttaactattataaaaatgatggatatatttgttgaaatattgcggaaatgatgagagaggtgatgattggatctatttgcattttgatttgtagaattaaataaattatggatgatattgcatgtttgcatgagcttttttgataagtagttattgctcgtggatgacgaggtggcatatttgcatattgagctttagacttagtgagctttaactttatagaaaatatagatatgaaaacacaaaacaaaccacatatgcgcttttccacactttccatggatttgatgtatgctacatttgttttaatcattttaatactttcttcaatgattttggtacgtgaaatacatagtttattgttgagaaaattatttagttcatactaattaaaaaagttataaatgacctatgtgattgcattacttgtaatatatggctttttaatattttcagtacatgattttgtcactaacatttgaacatatgcaacaaacagtagcccaagggacagataccatcatcgatcattgattacagtatgaagcgaacatgagccaatctggtgcaactatggagtggatgggaaatccaattgatgattcttttgagtctattccttcagctctttctcttcttcactggaggcctccgacgccgtagaaccaacaaattgatactgatattcatttggctggcctatgtgggagcagacctagttgctgtttatgcccttggtctcctctctcgatatgaatacaaatccaaaattggaagtgactccttgacagtcatctgggttccatttctccttgttcatcttggtgggcaagataccatcactgccttctctatcgaagacaacaatctatggctaagacacctattgaatctcgttgttcaggtcagtctagccttgtatgccttctgcaattcatttggtcagatcagtttgcagctagtagttcctgcaattttcatatttgttgctggtataatcaagtatggggagaggacatgggcactcaagtgcgggagcatagatggccttcaaagctcagctggtggttacaaagacaaagaacaggaagagcaaaaggataataaatatggaagctatcttagcaaggtattctatgctcatcaaatggtgctatatgctcgaggattatttgcgggggtcacggtctcacaacttggccaaaaagtaagaaaggaactaacacatggtataagaaggtgtgaaaaatatgtgaaagcaaagataatagagctggagcttagcatgatgtatgacatcctctacaccaaggcaatgatactccagacatggatcggttgcatactacggtgtatttcccacatcgctatggttgttgcatttgtgctattcctagtaaccccaaagcatggccatagaatggctgatgttgcaatcacctacacactatttgctggtgcccttcttatggaagcatgtgccattggtgtggtagtggcatctccactaacatgggcacgttggagaaggcacaattatgttaatttgcttgctattgggaagatcattggagcaaaggaggagaggtcagttgtgccaatttctttggggcaatttagcctagcaacatgtgctttacatgatgggtccacacccaggataatgtccaatgcgttgtatgcatttggcttggagaagatctatagagatgtacgtcatgtgaaacacgttgaggccactgagattgttggttgttttgtggattgtttcaataatagaccatccaataatgatcaggatgaggtaattatgggggtctctaaagaagggaatgtggatgtcaggttgaacttgttgagcatatctcagcgttttgaggtcggcatcattcaactgcatttgttcacagatatttatacaacttcagtactattacttgaaccaggcatctgggaagaaaagacaggcattgtatgggaatgtgtgatgctatcaaactatatgatgtacctcctgttagcacacccctccatgttgcctgttagcagtgattacgctgtgatggaacatttgaactatatggctaaattagtggacatgtacaaatatgctggtggcaagctggatcctcacgcaaggatggacttactgctcaaagctcttgagcaaatgacaagcaacacaaactctgacctcattgttgttgctagggaactcatttatattactagggtcagtggcacattattgaagttggtgaaggagacgtggatactcctcctcatctatgctgccagcaagagccgcggtgagctccacgcgcgtcggttggacaacggatcggagctcctcaccttcatctggctgctcttggttcatcatggcctcggcaatgtggcagagtttgggttaacactaggccgctatgtcacaagtgaagccccgccaagcttatctgaaattatcgacatcccgtgagtattgaacgttatgacttttgaggtgttttcagccgtctgatcatagcaaacggacaagatcgattgctacagtaaagtgtatccctgtcacgccctaaaaatcgactaaattaataatccatattttaaatcatttctagaaattattttaaaaagccttcaagttaaactctaataatctaggagaaattgtaacataaaactgagttagataaaatctcgataatactttgcttgtttatttattttctagatttttctgggaattatttgagcaaggaaagtatttttaaaagtttttaaaatcctctcctaagctgttggcaacatctctccccctcgtgtgcgtgctgtgcagcccaagccggcccaagccgagctgctcttccccttctcagcccagccgaaaatctaatttgcctccctcagcactgttcatcttctacctctagcagccgaactgagaccgaattggctcggtttttctcctccaaatccaaccttttctcttgtgttttcctaaaatttgttgaggggaaatatttcccttatctacctctttcgtttcccccaagaatcggtttatctctccaaactaacccgaagattttccggtttcgattcctctcgtttggagtcgatctctctcacccatgcctatataaagcatcccctagtcgtcctctttcgtttgccccaagtcccgagccccgccgtcgcttgtagcgcagccgccgcgacgccctagccgccgccgttgccatcgtcgttccagccgccccgcgccgtcgctgtggtggtcgtcgccggtcgccgtcgctatctccgggttcgcgaggagaagccgcgcaccgtccgccccttcgctgccgttgcaagcagccggagcgccgccgtcggcgaggtcgccatccgagccggccgccattgatgacgtcatgctgacgtcatcatctcctatttttcagttttttttaatagattaaaacttcggaaaatcataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaatgctatatatgtataattgcttagccatgcttagaaacataagctcattaatgggatgaatcatactacattattacttatggttatacttaatggtagctcacgatggttaatcgtgttatgttaattaattaataattaaaacctgattaaaggtgggttgtgagcgcatggttttgatggtcgtgctcatgacaattaaggaccggttcacgagctactgttgtgaaacatttaccgtgccaaccacaagccagcgtgggcaacggctttaccttttgtatagcatggttcattatggggtgccagactgagaagcggcgagaagtccgtggggggtcgctggggagtccatgcctctggttgtagagggggtgattatgatccaggtatggtgcactgtggtgagttgtgttgtgcgaggggtattgtcacagttcctttccgaggtaccgtggtggtattgaggcgcatggtaacatgttgtggaactgtgtcttgtgggtacagtggtacatctctggccagagtaaaactattcgaatagccgtgcccgcggttatgggcgggtctaacaatgtttttcgtaattagtctcacattattcattgatggtaattgtgataattaatttgactcctggtttggaatggtatattcctggtatggaggtttgatttgtacaaccggggttggttgttcagatgaggttgggcatatgcaacacgggtgtgttgtatggtgtttacttaatactgattaattattcaactgttttactattctcttaaatatttattaaatgctgtttatgcaaatgagctatattatgccatcctttgttatcctatgcacttgcatatttgctgtgtggcttgttgagtatgtcatatgctcattcttgcaatattcattcattagaggaggtgtacttgagtgaaggtgatgatctggaggactaggcttggtccgggttaagttgcctgtggagtggagtcgccatagctgttccgtagtttgttttattttctgctgcgtagaattttattttttgagaggaactatccacctctgtaataatttgctattttgcgaatattaattagttgtttaagagtactctattatcaatttgttattgtgtgcctcggctgattcctggacgaggatttaacacacatgtaagcgtttggaattttggatagaagttccgggcgtgacaatccctgaccttattgattagattggatgttacttgtatatatgtattagcaattcttatcgattcttacttattttgtagttctattctacatacttatgtgttggcggatggcatgaggcccttcgactaaatctgccgaaacccgtggcgaaggctatgaagcaagaacggcacgaggcgaagagtcgtacgagtgccttgccaggtcagaggcgtcttaggcgaagggtgtaagccgaagactacctgccgaaggaagacgacttcgccatggcaagttcgcccccgcgagggccgaggaagcctttccggcccatcaagcctaagggctatagggccggcgatcgccagacggcccatcaggggcccatgagcccctataacattatgtacccctataaatgtcccttttgtaagggtaatcatgtaaatttccctgtacaacctaaaccctagtagtaagaacctgtaatggagctataaatagtcccctagggccatgtaatggggggatcccaagtgaaattcaaaatttaatacatttcatttttccaaccactgttgagtaatcacgtctttcgacgtatgcagttgtcctttcgacaacagctggcgccgaccgtggggaactccgagcgaaaccactgagagcgaatgccaccgaagagggtcatgaaggagaaggttgccaggcggaaggagaacgacgctggaccggacatggctgccgaggaaggagcagagcctgcggcgcccgtggccgaagatggaggagcacaagcgccatcacaaccgccttcggcccctgcaacctctgtgcaagtgccgaacgcggccgacgtggcgaaggcggctgcggcggcaagggcactccagaccaaggcggagatcctttcgacaagccaaccggtggtgccccaagccaccccatcgcagccggcagcggccccaactgcgctcgccgttgtacaggcccaagtcagccttgaccccgaagcacaagccgaaggcgacatggaagccatgcggcagaacatgagacggctccaagacatgcttcgccaaatgcaagaacaacaacaagcatacgaggcggcaaggcggaccaaggccacgtcggctccaatccttcagtattcggcaggctatgtcccacctcaagtccgtccgcaagtgacgacccagccctctccgccacaagccgcacaggcgccggtgtacttcgccgggcagcatcaaccacctggccaagcgccacaatcagtggcggaaggggcttcggctctgtaggcgcaactcctagctttccttcagcaactcaaccaaccccactgcatttcaagtacaaccccatcggcccgcccggaggggaatacaagtcaaggtacgcttaattggttgccaccgattcagctgggcctgggagtttcgccgtggaatcaaggaccgcagttcgacttcgtcaacgctgctcaggcgccaaccgttcggcagcaagctccgactccaggcttcggaacaaaccaagcaccaattcaagctgccatgatgtggtcacagccaatttttgacccgtccatggcggctcagcaagtaccactagttggagccgggcagccgaacgccatggcccaacctcacgcacaagctgcgatttcgccacaccgtacccgcagcaaggtgcggtaaacagggtgggaggcgaaaaggggctaccgctgagtgggggaatcaagactcgtccaatcccaccctagttcaagttcccacccgtcccgcgctattcgggcgaaactgactcgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcaattgcgcgatgtttttgtccttaactttcgaggcacctacgaggagccgaagacgcagcaacacttactcggcattcgccaaaggccgggggagtcgataagggagtacatgcgtcgcttctcgcaagcccggtgccaagttcaagacataaccgaggcgtcggttataaatgccgcatcggccggtttgctcgagggcgaactcacgagaaaaatcgccaacaaggaaccacagacgcttgagcacctacttcggatcattgacgggttcgcaaggggcgaggaggattccaagcgactgtcacgtcctgataaattcatcccgaaattaaaaatcattcgctaaaaggaataatagaattaattaaaattcggaaaaaaattggcaaacactaaaatacgtacaagaaaaattcaaatgtggcctggagaatttttgttaaattctctttggtctaaaaggagccctcaaattttacttgaattttcagagcaccaaaaatatttattaaacaacaacaacaattatcaaagtttactaaaaagaaaaactaaaaataaatccccctcctccctttgggccaagtttggcccaaagacccctctctctttctctctctcggcccgcggccaaagtcctctcttcctccctctattcctctccctctcctcctctccctccttctcttgggcctcctctccttcccctcggcccactccctcctcctccctctctcccccaggccgcctccccctcctctcctcctgggccggccgcccggcccaagacgagcggcaccctcccgcccgtgccgcgcacgtgcgcgcgctgatgacgcgtgcctgaccggtgggtcccacctgctcggtcgtctccttcctcccgcccggcatcctctctctctcttctctcccgtgaaacctagcgtcgattcctcccctaaatccacgcgattcaaaccgggaattccaaaattgattagggggaattaatcccctctccctcctctctctttcccccttaatttccccttgaatggctcccccaatcgctgggaacggacgcgccaactccggccaccttccatggccgccggccatgtttcccgtcgccgttccgccctctcccgtgcccggctccctcccccatcctataaaacggaaacccctcgctccgttctatcgttttagccccctcccgcgatctcccgtggtccctagccacctccccgccgtcgtcccctctctcccgtgccgccggccatcttcagccgcccctgccgccgcgttagcacgccggccggccgtgccgtcgcctcctccagcatcgcagccgcctcctcttcgccggcctgccctctgttttccgcggagacctccggaagtgcctccccgccggcgacagtggcgttgccgccactgttccgcctccggccgcctctgccgcgtcccctgtgcgccggccgacgtcgccatcacctctcccggcaccggagcgccgtcctctttcccggccaggccacgacgtcgcccgaatttcgccggaacgccgtcgctcgcgctggcctctccttcctcctcgtcggcatctcctctggcagaccctttcgccatgcccgtgcgtcagccggcgctgccgtcccctccctcggcacggtgacgtagccctccacctcgtccacccctcggtttcgcccggaagccgttcttgtccgtcgccgcgaacctctccatccgcctcaccggagttgttcggccgcccgtccctcctcgcccgtgcaccggtcggccgcacctccaccaccttcggcatcgcagccgcgacgtcgtcctcggcatcgcttccccttcggccgaacaccgccggtgtccgtcgtcgtcttcaccgttcatccttgccggctcgtcgtctcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgtcctcggtgtttcgtcaaggtcgctgtagccgtcgtcgtcttcgtcctcggctccgcgtcgtcaagcctcgtgccggccgcgtctcgccttcgtccaaggatcgccgccgaagtcgtcccctcgccgttcgtcttcgtagttcccggccgtctccgccgcgcccgttcgtcgttgtcgttcccacgcctcgtcgcgtggtggtaaggatctctcctctcgctgccccgtcctcgtcctttcggtgtcgccccgtacccgttgtgcggttgtcgaccccggtatccgtgtaccggtgtcggtagtcgttcacgtgtgcgggtggtgaccgtgtagtgtccgtgttagtgtgcccgctcggtagccgcgtggtttccacgtgtgcagcccgtgtggtgtctagtagagtccgtttgtcggccactcgcctcggttgacacacgggatctgcttccgtcgacccgtggaccgtctctgtgtactcggtctaccgcggtcctttaggttgacatgtggggtccgcatgtcaacggcgcagccttcctgtcttttccaggctagcgtttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcccgcgttatcactgttttatctagccatgcctatttacctttgttatgaccttatcattgttgttattgttactattaccttgttcaccctaggataaacaaaaccccaactagtgggtactctattcatggtcccactagtatgaatttaggtagatgcttcgctgattaattaggcaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtggaaagtagcaccccggccactataaggatgaagctcgggcctctgttgcaaagcactaccgtacttccacatgtctagtgggtaaggcttagtttgtggctcagtctggttataaacaaaagtacacggatggagatggacgaagtcgggggtcgatggacatatctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaagtgcaaaacctaacccttatattattaccccttgtacccccttgcattagtcatgcatctgccggtgtggcttgctgagtactgtggttgtactcatttttgctcaatctttccccccccccccttcagtaagagaagctttggagatgaagtcctaggtggagtcctggcttataccccagttgagcgcctgtgaagatggagccgtaggcccgctagtccgctgctgtttattttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcagtcgtgacagcgacggcatgctatacaagctgagtacgacaaagcctccgtcgccgctgctcaagctcaagcacaagtgcaagttgccgaaccacctcccctctctgtccgccagtctcagccggcgatccaaggacagccaccaaggcaaagccaaacccccataacttggagaaagttcagaatagaccgtgcaggcaaggcggtgatggctgtcgaagaagtgcaagccctccgcaaggaggtcgacacccagcaagcgagcaactatcagcagccagcccgcaagaaggtccgaaaggacctctactgcgcctttcacggacgctcttcgcacagcacggagcaatgccgaaacattaggcaacgtggcaacgcgcaagacgcaaggccgcagcaaggaacaactgtcgaagcaccccgcgaagcaattcaggaacaaacacccctagccgatcaacgccattatgcacagcgaagggtaatccaagtgattacaagagctgacccgccaagccagttgtcgaaacggcagaagaagatgcagacccgtatggtccacagcatcacttcggagggtgaaggagcgccgcaatatctgaaccagctaatttcttttgggccagaagacgcagaaggagttatgttcccacatcaagatcccctggtaatctgagctgaaatagctggtttcgaagtccgacgaatcctggtagacggagggagttcggccgatgttatcttcgccgaagcatatgccaagatggggttgcctacccaagcccttaccccagcaccagcatcgctccgcggtttcggcggggaaccagttcaagttctcggccaagcactcttgctgatagcctttggctcgggggagaacagacgtgaagagcaaatactgttcgacgtcattgacatcccgtacaactacaacgccatcttcggccgcgcaaccctgaacaagttcgaagccatttcccaccataattatctcaagctcaagatgcccggcccgacaggggtgattatagtcaaggaggttcagttttcggctgcttcaaaaggcgatctagccataattaacagagcagtgcacagtgttgagaccgaactgcatgaacggccgaagcacacgccaaagcctacccctcacggcaagataacaaaaatgcagattgatgatgccgaccccacaaagctcgtatcactgggggcgacatggaagaagaagttgagaatatcctagaggtgctcaaaaagaacatcgatatcttcgcctggagccctgacgaggtggggggcgtcccggcggatctcatcatgcatcacctagcagtcaagccggacattaagccaagaaaacaaaagttgcgcaagatgtctgccgatcgccaagaagcggcgaaggccgaagtacaaaaattactccgggcaggggttatccaagagattgaccatccagagtggttggcgaatccagtgctggtgcagaagtcaaatggcaaatggcgcatgtgtgtcgatttcacagacctgaacaaagcgtgtccgaaagacgatttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaaggaatgcaggagcaactttcgccagactggtgtacaaggtccttagcaagcagttggggcggaatgtggaagcttacgtcgatgacatcgtcgtaaaaagccgcaaggctttcgaccatgcgatcaacctgcaggagacgttcgacagcttgcacgcggcaggcataaagctgaatccggagaagtgcgttttcggcatccggcgcaggcaagttgttgggtttccttgtttccgtaagaggcatcgaggcaaatccagagaaaatcgatgccatccagcaaatgaagcctccgtcaagtgtacatgaagtacaaaagctcgcaggccgaattgcggcactcagtcgattcctctcaaaggcggccgaaagaggtttgcccttcttcaagaccctccggggcgcgggaaagtttaattggacaccagagtgccaagcagcattctacgagctaaagcaatacttgcaaagcccgccagctctgataagcccacccccaggaagcgaactgctattatacttagcagcttcgccggtggcagtcattgctgcactcgtccaagaaacagagtccggacagaaaccggtctacttcgtctccgaagcactgcaaggagcgaagacaaggtacattgaaatggaaaagctcgcttacgctctagtgatggcttcgcgcaagcttaagcactacttccaggcccacaaagtcatagtgccatcacagtaccccttgggcgaaatactccgaggcaaggaagtcactggccggctcagcaagtgggcggcagagctatccccgttcgacttgcattttgttgcacgctctgctatcaagtctcaagtgctagctgactcgtagctgaatggacactagtacttgcccccgaccccgagcccgccgaacaattctgggtgatgtgctctgacggttcgtggtcgcacaggggggcaggcgttgcggcagtcctcttctcgccgaatggtgtgccgattcggtacgcagcaagactgcagttcgacacaaccaacaatgcagcagaatacgaagctgttctcctgggcctaagaaaggcgaaagcactgggagtccagcgcctgctaattcgaactgactccaagttggtagcaggccatgttgacaaatcctttgaggcaaaagaagagggaatgaagaggtatctggaggctgttcggtccatggaaaaatgcttcaccggcataacggtcgaacacttacctagagactagaacggggaagcagacgccttggcgaaatccgctgcttgtggtggcccacattcgccgggcatctttttcgaagttctgcatgctccgagtgtgcccatggactgctccgaagtcatggcaatcgaccaggagaaactgggcgaagacccatatgactggcgaaccccatttgtgaaacaccttgaaactggctggcttccggtagacgaagcagaagcgaagcgtttgcaactcagagccacgaaatataagatggtctcgggtcagctttaccgctccggggtgcttcaacccttatttcattgcatctcttttgccgaaggcaaagaaatggcaaaggacatacactaggggctatgtggcgcgcactaggctgcaagaacagtggcctccaaagtatttaggcaaggagtttattggcccactgtgttgaaagtctgtgttgagcaaataatgaagtgcgaaagttgccagcgtcatggccgaagccaatctgcgccccagtatgatcggcagcccattgcgccaatatggcccttcgccagatgggggctggacatcatggggccgttcccggtggcgcgaaacgggtataaattcgcaattgtagctgtggaatatttctctcgatggattgaagccgaaccccttggggcaatcacttcggcagcagtacagaagtttgtatggaaaaacattgtttgtcgtttcagagtgccaaaagagttcattactgactatggcaagcagtttgactctgataagttcagaaaaatgtgcgaagggcttaacctggaaattaggttcgcgtcggtcgcacttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggatgccaaaggatggcataatataggctcatttgcaaaagcagcatttagcaaagagttaagagtaataaaacggtagagttattgattagaaattttaatcaacactgaacagcacacccatgctgcacaggcccaaccatccaaaacaaccatacctggctgtacagatctaactccaaaccaggagctaaacaaattattaccagttatagcatcaataattattgtgagaggtgtgagactaatcatgaaaaacattgctcaacccgcccataaccgcgggcacagctattcgaatagttttactctggccagaggtgtaccactgtacccacaagacacagcctcaacatcatgtctaccatgcgtcgcgatattggaaagtacccgaatagaggctgtgacaataccctctgcacaacataactcaccacagtgcaccattcctggatcataatcacccccttataaaacaaggcatggactccccagtgacccccgtgggcttatctccgccacttctcagtctggtgctccgcaatgaatcatgctatacaaaagataaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatcaagctgaaccaatatataaagctcaactagtcaagttataataacccaaggtatcaaggaataaagtaatcaatgcaaacaggccataacaaaggaatagattcacaccacccaatggcattcgaaaataaatgcacagttgaaataaatagagaatttaaatataggaacaacatgttcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcatgattttagatgaattatgagacttgaacggcctcattctgacttcatatgaatttattatgaattttacaagattaaatctaattaaagcccatttaaaaggaattaaataaatttaattcaatttatggataattttaatatgtagatctttattttatataacttttgcaacttgaaccacattaaactgagttacaatgaattagttatgaatttttaaagattaaatcggattaaaacacttatatggattttaattgaattatgacgcaataatgaattatttttgaaaaggaaaagggaattattgcgtcagcggctagggtttgcggtggaccgggtgcacggcggcggctcacgggaacgaacggccgagatcgatcctatccaaaacggacggccgagatcgatcagtccacgaccgggccacggcagacggtcccgatgacgtcagcgatgacatcaacaccggcggcggctcggcaacgcatgctcgccggcgaacgacggctcgacgacgcaaacggaggacaccaacgggtagagggcgacacggcgaactcaccggtgaccaaaacaacggcggaaaagcaacggacggcgccgacgacgaggaagaagcggcggcggtcttcgggtcgacggtgacggcggtgctccggcgatcgacagcgacggcggaggggcggacgaggacggcgacgcgacggcgaccacgacggtgacctccccgagcgacggcggcgactggagcgatggcgaagcacggctggagcggcggcgacgacaacggcacaaggttacacggggctagggtgctaccgacggcgagagacgaaggcgagggtggcggcgggtagagggaagctcgggggtccttttataggggcaaggaggtggaggcgaaagcccacggcgaccggcggcgagatggaaagctagggttcggaggagagagatcgatccgaatcgaactcgaatccacggatttccaaacgaaattagccgacgattccataagagaaaagatagagtggatcgcggggatcttttcccctctatcgattcggccggagatggaaaggagcgatggaatttggaagggcggcggcggcttgcgcgcggctagggcacggctgcggcggcgcgaggaggacgacgaccccgacaggtgggtcccgcctgtcagcggctgagagagaggaggaaggggcgcggcggactgggccgactggaccggggagggagagagaaagagagaggttttgggccggctttcggcccaaagccaaaagagacttttaaaaacctttttcaatttaaattattcatgaaatacaattccatttattaaaaatacttccttagctcaaataaatcccagaaaaatctaggaattatagaattaagcaaagtatttaacaaaattttatctagcccaattttatattgagatttagcaaattaaaattagatcttatcttttaggcttttaagatcatttctaattattccttttaaacaacagtttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccacccatgctttatatttaggaaattttatttcccacatttaacttcacttgtaaattaatgaagatttaatataaattctaataataatttattaaataatttataaatcctgaaacgaaaatcaggatgtgacaacacccgcagtcaaatggggcggccgaacgtacaaatggcaagatcctaaaagcactaaagaaaagactcgagggggcagcgaaaggcaaatggccagaggaattgctatcggttctctgggcccttcggacgacccccacaagaccaaccaagtttagtccgtttatgcttctttattgcgatgaggcaatgaccccagcagagctaggggctaactcaccaagggtgatgttctctgggggcgaagaaggacgcgaagtatcgctcgaactcttgaaaggagtaagagtcgaggcgcttgagcacatgcacaagtatgccacaagcacttcggcaacttacaacaaaaaagttcgacccacggagctgatgcctggtcatttcgtcctaaagaacaaggcgaacccagtagcggttggcaaacttgaatcaaagtgggaagggccataccttatcaaacacaagtccaggatgggatctttttgcctagcgacactcgaaggcgtggagttcgaccattcctagaacgctgcctctctcaagcgcttctatgtctagaatgggtggcacccaaatcgccaaattgtaaaaatgtacatactgtcatgtaagcccttcagcactatataagcccttcggcactatgtaagcctttcggcaagaaaaaaaagaagaaagagagaaaaagaaaaaaaaaactagatgtagggctattatccaccatggaggccctaaccagtataaaatctctgtgtcctccgccttcttcttatttttcgtgtgattgataatttgtggaaaaaccccaaggaaaacgcctgatcagcgaaaaaggccaggggggcgaaacgaatcggccgaagcatcgctcgccgaacgttgaaaccgcaacagcttgtctcggaaaataaatagccgaacgacattacgtccgatcagcataaaagcaaaagcgcttctctcgacacagaacgctacagatcaaagatgaacgacgaaaagctgaaaagtcagtacacctatttcgctaatatatgcaaaggggccggcatgttccgacctaacggaagcacaaaatgtgacgatgcaaacaatagcgaaaaggaaataaaacacgtctttattaacttcgaaaaaaataatcgaagaatagaagtttcacaacacgacataattcaccttacaagtaaattacatcttcgtccccataatcactatccctctctaaggaatgataaggcgaactaggttcgtcatcactactaatatcgtacacaaccttaagaggagtggggggtgcaacacaaactaaactgtaacgacgctgaaagttcgttccctgacgattagtcttctgatggtttcgccaaaagcgagccatatcctccaaacgttttgaatgaacaagatcgtaatcttctaaggttcgcccggggtgcgcccgcagccagttggcaaccttgaaaaccttataactgcgaccgtttatctccatttcgcgataaacaggccgaaatggacatcgcaccttcggcagacccttcactgccacaaatttctcattttgacttcgccagctcccgaaagggggccggatgaacgactttcggcgaaccccctgatggacagtgcagaaaaagcaaaacgcagcttacatagtaagaataggcggaagaagggggaggtatggcataatgcgagacgagcgaaataataatacgccaaagacttcgatcatcaaaaagtaattaagattgtcacacattccaaatatacaaaaaaaaaagccttttttttttaaggtttggcgacagcctgccgaatgtacaccattcgcctctccaggcaaactcaaaaaaggaagcaaaactacaaaaacctaaggaaagggcggagggcctcacacctctaggtgatcctaggcatcgcctccaacctcttcgcccaccgcgtcctctccttcgccctgatctgccgcctccgccttcgccagttgctccagaaggcgcgccttggcagcggaccggccgtctttctgccagaattgttttcgccacgcgcgaagagcgggcgaaatattctgcgcactaatctcccagtcccacttcgcgtaggtagggaactcggcgacgtgctcgcagccgaactgctgcaagaggcctaaggtgaaagccgccgatacacgtgcacagcaatcgcgccgtacgcggtggcgcagtccgaaaccaatccgccagcctgctgggtccactcggagaagtcgaaggctgaggcatcctcgatagggaccccccgcaccttcgcgcccatgtcggtaagggcgaggcggagtgtttggcaagctgttctcgcagattcggtggtcttcgccatctcctgcgaaaaccgctgcgactcctccgcggcactcgcttcggccctgctagccttctggcgaagagactccatcttcggcttagtaaggttgtaatagcgatgagcaccgccgaatgggccttctccttctccagttcggccgtgaggcgatcaacctcggcccaggcctctttccccttgtccaattcggactgaaggcgtttgacctcagttttcgccttcttgagggtgcggaccagggactccacctccaggttcttgcggcttatttcatcatccttggcccgaagacggctcttaaaaccgtcaaaacgggcccgcacggttcgctctttcgaacagtgagccgcaagaatctagatgaaagataggagcgggcgaaaagaaaaaaaggttaactgcgagacgtaaaaaaaagagggaagaggaaaacgaagaaggaagaaaaggcatacccgaaccgccagacttttgatggtggaacacccctcgtcgaactcgttaagttcggtgaacaggctcggggtgccggcgggcaagaaagattgcttactccctccacaaagggaataaggtccggccgggtctcgaagtcaccaggggcgaagtggggcgccgcaagggaatactccgaggcaaatgcttcggcggccgcacacttccccttcgccttggccagcggcgaaatggctggctcgcgcacagggctcccgaaaaccctcgccgcagccgacaagatccgttcggcggaggcggaagccccggcggcggcgctaccgcctgccccagcaacgccgagcggagcaaggggagcagccgaaaggtccaaactgcggccagcaggtgaggtcggagtctcgtcagaagactcgtcgtcgctgaaaacgcgagcgatgtcgaggaatcccttcttttttaagatcttcttgaccagacctcctttcgccgccttgcccgacgagaacgcaactaaggccttcgccccttccaaatcctttcggcgaagaggggagctgttcgactccaccccagtctcgttgtgatctggacttggggtaggagtgtagccgggggtgtcgacgcggtcttcggtcgcctcgttcgcggccttatcagccacagcctccacctcctcctcttcctctccttcctccttgccgtcacgttcttcggcatcatcctcgtcatcggcgtcggagtcagacgaagcaggaacccttcgcttcctgggggcaagcttcacttgtccacgcatccgctttcgcgaagggcccgcatcgtcatcggctttttggggattcgcccagggaggcagttcgccgttgtaaacccggttcgcccgcccagccgcttgtcacgttagcagctggctatactcgactaccgaaacat

SEQ ID NO: 64706 - DNA, 1798 bp, Oryza sativa
gaaccagccgcgaaagggatggtgtgatagaaccacctcgacatggcagcgttcaccggccagagatcggaccgctcggggcgaacaccgtcttcttcgttccagccggggtaatcaccgtcttcgagttcacggtggcgatgaatatggcgccgaagagctcggcgctaggctcaaacccggaagtccggcatgcccagtcaaagatggagattcaaactagcgccgccgggctcaactgcggaagctccacctggaaaaggcgaaggatctccggcaacaacacgttgcacggaaaccgtagccccacctcaaaaaaggcggcgaacaccaccgtccggttgtcgataggctttggcaccacggccttccctggggcgaaagcttgccccgcgaccaacgccccagagctgaccagcttcgccagctcaacgtcgtccacaagagagacccccaaaaaggcggtgctgtcatcatcgactcggccgggatccagccctttcgctgaagcagggtttggcttgcgaggggccatggagaacggtgcgtttacggtgacgaaaaaagagattgggcgaaacgcctgaggggtcgaaagatgctgtggaaggaagagacggaggaagagagcgcgcacggtaaaatggcaagtgtggtggtgaaaaggaaagagcagtgggaatatatagcccacccaggcgaccgttcgcctacccaccagtaataaagcgccacgtgtcgcaaaggtaggcgaaacggtaaattcccaccgatcgagcagcacagtaaaaagcccacgatgggaaggcccaatactgttctgttcggcccaggaaaagagaatatatataaccaccaatcgcaggaggcgaagcgcggcaaaataataccagccgcacaagtaacaaacttcattcgcaggaataatgtaggtttcggcaggagcatcggtcgaaagggggcgctgcataccataccacatggtttgcacggtctcggccgaagctccaatctcacccttacccgtgaggggcttgttggcggatggcatgaggcccttcgactaaatctgccgaaacccgtggcgaaggctatgaagcaagaacggcgcgaggcgaagagtcgtacgagtgccttgccaggccagaggcgtctcaggcgaatggtgtaaggcgaagactacctgccgaaggaagacgacttcgccatgacaagttcgcccccgcgagggccgaggaagcctttccggcccatcaagcctaagggctatagggccggcgatcgccagacggcccatcaggggcccatgagcccctataacattatgtacccctataaatgtcccttttataagggtaatcatgtaaattcccctgtacaacctaaaccctggtagtaagaacctgtaatggggctataaatagtcccctagggccatgtaatggggggatcccaagtgaaattcaaaatttaatacatttcatttttccaaccactgttgagtaaccacgtctttcgacgtatgcagttgtcgtttcgacaacattatgtatctgctagcatactgtttggtagcattaaaacaaacaaacaaattaaacaatagtaataatgcttgttcttttttgtaattattattactgtttgctctagggccattcacagtgcaaaatactactacgagaagcctcgtagtgccacataggacagagacacatgtctcaaatgactttctccccacagtgcaaagtagctttttagagatgtttcagtcttgcatgccagacccctttttttt

SEQ ID NO: 64707 - DNA, 3334 bp, Oryza sativa
  unsure (1)..(3334): unsure at all n locations
tccaagggaaaaagtgggggtgatctagtactactatggtgtttagtccacatctctatggtagttgcttttgcaccatttgtagcagcctcaaagtatatatggccaatcttgcaatcacctactcattgtttgttggtgcctttcttatggaagtatgtgctatcggcattgtgatattgtcatcaatgacataggcacattcgagaacccatatgtcttagtttatctatcaggaagaccattgaggagcagagaagttagtggtgtcaatttctatggggcaacttagcctaacaacatatgtaaattttacatcataggtccacacccaggatgatgttgaaggcacgtttcctctaatttcagaggataaacttttggattaaaatgacacgcttttcaaactgctaaacggtgcatttcgtgcgaaaactttctatatgaaagttgatataaaatatcagattaatccattttttaagtttgtaataattaaaacttaattaatcacacgctattaccacctcgttttacgtgaaacacttaatctttatcttcatcttcatcttcaggagattcaaacaccactggcttggatacgatccatatagatgaatcatgaatggcacgtacaaacacgtccagtggtggtggcaattaatgaattttcatacaactttatagtaatccttattatatgctgatgttggagttcagatgctttcctgctgcttattattgaatgtaagtcattgatattgtttgatttgtcttcagttttgatgtgttctttgttcttggttttcttcggctatatgatatctctcggctatatgctagcttcaaaattttcactaaggtggccactaatagaataaacaggtggctgaccgtatagtgagtccaactcaaacagctttcatgagaggtcgcaacatcctagatagggttgttgtcatacatgaaactgttcgtgagttgcatcgcaggaaattgagtggggtcatccttaagattgactttgagaaggcttatgacaaagtaaaatggcctttcctactacaaactcttcgcatgaaaggtttctcgccaagatggatttcttggattgagtccttcatttcgggaggaagtgtagcaatcaaagttaatgatgacattggacggttctttcaaacaaagaaaggccttcgacaaggtgatccgctatctcccattttattcaatattatagcggacatgctagcggttatgatccagagagcaaataatgcaggacagcttgttggactggtgcatcatctcattgatggtggattgtccatcctccaatatgctgatgatattatactctttatggaacatgatctagagaaagcttgtaatctaaaaatgttgttgaacgttttcgaagaatatctggcttgaagattaatttccataagagcgagctttactgctntggtgaagcccanacagctcangatcaatatactaatctntntcaatgtgaggttggttcttttccattccattaccttggcattcctatacatcataggagacttcgtaattcggagtggaaggaagtgattgaatggcttgaaaaacggttggcaagttggaaaggcaaacttttatcacttggagggtgactaacactaatcaattcagtgcttaccagcctaccaatgtatatgatgtcctttttggaaatacctaaaggagtgatcaagaagattgattatttccgatcaaggttcttttggcaaggggatggacacaaaaggaaatatagactagcaaggtgggacatcatatgttgtcctaaagaccaaggggggttgggaattcaagatcttgaaattaagaacaaggctctccttagcaagtggttgtataaactactcactacagatggtgtgtggcaacaaatgctaaggaataaatatttggggtcacagcctttgtctcaagctcagtggaaagcaggagactgacacttttgggctagtctaatgaaggccaagcctgattttctcaggtttggctccttcaacatcaaagatggctctcaagttcggttttgggaagataaatggttggagaatgcctgtttaagagaacaatatcattgtctctataacgttgttaggcataaacatgcaactatttcagaaattttccaaaccagtcctataagcttttcttggcgcagggaccttactggctctaagttagtggcgtggaatcaccttctctcacgcatcgctaatattatattatctcacgaccaagatgagtttaaatggaatctaaccactgatgggagattctcggttaaatctctttatcttgcgttggtgcagaccgatgttcccaatataaacaaaagaatcaggaagatcaaagcccctctaaagattaagatcttcttatggtacttacgtcatggagtagtcttaacaaaaaataatcttattaaaaggaattggagaggaaacaagtcttgttctttctgccacaaagatgaaactattaatcatttgttgtttgattgtcgttttgcccgcgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgtagaaataatgtggtttttgaaagaaaaaacatatcttctcctttgcaggttatcttggctccgctcataggctatccttcagaaggtcaatttgcggggtactatcattgcggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgggtgcagaagccggaggtgctctcagaataattgtttcacttgatagaattttactgagattaataaagcttccattatcttaaaaaaaaatatgatatctcttaactgagctttctagctcttccgatttcggttcttagtctttatttttgcggattgtcaggccaacgaatcaacctcaatgtaacttactgagttcaagaaagcttttactattaaaaaaacaaatcaacctatttggttgtttgatttctgggttagaaataagatttttgccgtagaaatgcagcctgcagggctgaataaacaacggacggctgctgctgtttt

SEQ ID NO: 64708 - DNA, 3035 bp, Oryza sativa
ggcgtacaagttaatcacattgatgcatctacaagcctgcatgaggctccacatcaattttaagaagatgcatatatctttctagtaagatgtaagagaagaacaaaagctaaagcaatacaatagtactagacaattattgcaaattatgtttttctagaatataaacaaaggatttattaatttacgcaattaaaaagaattgctcgccaacctagacctctggaagctgtaatctagacgagatcgtaatttcatttgttctcgagagaaagcatgtctcagaaatgctgctcataattatgtaagtaaatcacaactaaggatcttgttactccttatatgggacataagcagtaaaaattaattcacttatttgaacctaagcagatattactatgcttcttctacagttggaaattgctagggtaaggatacaaaatagcgaataagtcaaaacaaaacaaatggaaaggtagtgtaaaatccagtatcaataccatctttcgtgacagactcttcatgctgccgtagtctcataactaaagcttgcgtgactctctggaaatgttcttcggttataaccaacttcttcttaccagtatctgccgcttgctcattttctacattttacattaaaaacaaggtaccggaatgatcagaataatagcaagaacacacaaaaaagccattttaataataaggggaaacctacctggaccgtcttgttgaggagcagcatccatttctgttggctgaccagcatcattatcggctggtacatttgtgccatcatcagcatcttggaaatcagagagatcaacttcacttgattccacgctgcacaattaataagattttgttagcaaatcatcatgcaaatgatggatggatgtcttgagcaatttcaagaaacttgcctgatgatggatgtcttgagcaatttaactgccatgcgaacatgggctgggagaacctgtgaaattaatcccaaatgaagtcagcagaaatattatgccgtaaggtgaaaaaccccaatgcaaagggagggaacaaatgtcagccttttaaatttaacaccacaaccaactaataatactattcctgattgttgaacttaagttaatttatttagacaccatactgcataatctaaaaaacatgcaatatatgaatgaggattttacttacaactctttccaaatgacttcgggcaatagcttctgaaagcctgattaatgcctctagttgcctaactgtcatcctataagcaaccctagtaccaggggtactatctcctctacgaagggtaacatatgattcaaccagaactttctttgcttcagaactcagctgcattgacataaagcatctataagttgatgacaagttgaaagttatatatgaagtgcataaagatataaacctgaggtttcaaggacttcgcaaaagcaatgtaacgtttcaattctgccgtgctaaatgcaggggcaagtgcttcttcacgtttctgatggaccctcacaatgtgatgagcaatgtggtagtcagtgttttcatcaggctcatcgatcattatgtataccagatcaaatcttgaaagaatagctggaggcaatgccacgttatactgataaggattgcaacgattgaaatattagatctcagcactgaaattttaccacaacatgtcaacaaaatacagggatgcaaaagtttttcagaagtacttggaagtacaattttttataatttgttaggcttaccttgagtggttttgacttgtcataacgccctcctgtgggatttgctgctgccaaaattgaagtccttgcattcaaagttgcttgtattcctgcttttgttatgctaatggtttgctgttccattgcttcatgtatagcaacctacaatggagaaatgaaattgggacactcacgttcaataagaaaagaggcaacaataggtaaaagtcggcaagcctacctgatctttgatgtccattttatcaaattcatcaatgcagcagatgccattatcagctaacatgagtgctcctgcctgcaaaaataaccagtagcagcagaggaggtaaggcaatagaacagaagaactaggaagattgcacacaaagtgcatccaagctcattggagttcaatttagttgaagcatgcaattcaaagcaaaggtgcacttctaaatatgtattagcaatacaaatggatggaatcgcaaaattttgataatacctcaatgcaaaattcgccagtctctggttctttagcaacagttgctgtcaaaccagcagcagatgaggacttccctgatgtgtaaacagatcgtggaacaataccagcggtatatctgaggattggattaatagcacatttgtgatgattcatgaataaatttcattaagatgaatggaacttataacaagataggaagtccaatccaagaacaaaattacatgagcaacttctggattttatgtcaagttgtcaacccataaatatcattcagaaaaacattgttaaaaagcttatagtaacttaaattcaactagtagactaatcaagatgtattgcatcatgctgagggacccttatcagaaagcaatggtcgtttatgcacactaacatatgatctggtgaagcagcagaatagattttatatatcccagaatgacaacattgaatgatggaacttaaattttattcatcacagaaaaagaaaataagaatcatgacaatgagaatacaatgagaagcttactttaagaactgagacttcgcacaacttggatcaccaacaatacagacattgatgtcacctctaaggtttatcccttcatgtgttatcttgtgaacaccacccaaaagcatgagaaggattgctctcttaatttcttgatgcccaaagacagtgggacatatgctatcaactatcttattgaaaaaatcaggaacgttcctcatcctaacaacttcatcttcctcttcttcctgtaagagagaggggggagggagataat

SEQ ID NO: 64709 - DNA, 11434 bp, Oryza sativa
  unsure (1)..(11434): unsure at all n locations
cctgctagcatgcaacagaatgttcgaataccatgtaaacagaatttctcatagttctttttacaaggctagtcccttttccttcttcgaaacagagtaactagtctcgagtctgaattgaacttacagtgaacttctgtctttcgctgtcatctccatctatgtccctgtcccggatgtcgacttctctccttccatccgccacctaataacattaaagagaaaggttaaccttgtaataaaaatattataaccaagctaaccagatcgatatttattgctggaaagaggtcatacctgcactgagtttgctacaaaagcaaggcgatatgacagatctcgtactcctagtgatttcaagcccttgacaccttcttggacaccagacccattctttcgctgaggagcctcccggcgacactctgctctctcaccaggtgaagttagagccataacatcaggaacagcaacaacagttccagtaaatatgaccctgaaaatgaccgaaacagaatactttaatgtgaagccaatccagtgggtacaaagcagttccagcaagagttcctcacgtgtctccagctctagccttctcaacaatctcatgcctcagaatgacatccagggagcgtggtagtgaaccagcaggtatttcttttgatgtctcctgcatcctgacccgctgccaatctgtgaacttgctctcttgtcggagaagggcccattttgatcgattttggcatgttgcattgacacatattattggctgaagttaaggagcagaaacctttcattagacacattgcatgagagaaaaaagtagaacataaggttcacagttacaacctcagtatacttgaactgctgctcaacattctttacaacatttccacagtcaaggcacttgaaggtgccttgcagtaactcaggccggacctcacttgtccgtgtaaccacccccattacagccgtgagcttaccaatctctgctgttccaagctccctcaacctattacaacaacaatttaagtcaattgttatggcaaccatcatacaatttagcataaaacctatgacaaattagaaatgcaagataaaaagtgagacataattttctaccaaatgtgggaaacgtactaacatgaaattccaggggcaatgagccccacccttgaatatatgtatatatcacacttttgtagtgaatttcaggacatttgcagaattcgttcatttgccgtcagataactgttatttccagagttaattttacagggaaaaaaaaactgttacacctggaggagcaagtgcggacctcttcagcattggtatgttgtagaaggcaatgttaatgtccttgttagggctatcatcagagatgattggtgcacggttctcgccagtcctctgctccatcacaaacctcttgcacgcattccggaggtacggctcgaacctgatgcaatgaaatccacataagcagtcagttccaaattgtcgtcacagatgagcaaattaatttgtattttttctaggaaaaaaattctatttgtgctaagtacacatcaaccgagttctctgaacaaatccgagcaaatccagggacagatcccaaaatttcccaatctgaactccccaccaaaaaaaaaatttcaaatcaaatcaaatctcacctgagatactcctcggagatggccttctggaggacgtcgttgaatcgcatgacgtgggcgaagtcgacgtacatggtggtggactcccgcgaccgcatcgcctccagctccgtctcgtagaacgcctccgccgcatccgcctccttgaacctacagatccaagtttcaacaaaaataaaataaaataatcccccacctcacgcgtcagacgaaccggaaccccgcttaaaccctagaaatggaatggaaggagacggctccggccttaccgcctgaggaactcgaggaagatgttctccacccgcgccgccttctcgtccacgaagaacccgccgaacgcctccatctccgacgagacctctcgaaaccttgcgcggggtgggggggatttgcgctgtgcggctgcgcgggtggtgcggcgggggcgcgagggttttggttgggggaacaagtagaagaagaacaaggtgggtgggggtggtgttcttggcgggaaggaggaggcggcttggcgccaattcttcccgccaaaaatgaggtggtggtgttccgtggaccgcgtccggtgaaccggaggcagttggctgtcgctggcatgtgggggcccaagagttgacgagatgagaccaccagtccaccagcgtgtgtgcacgtgatgctattggattgggccgtgatgcttttgttgttctccagatgggctgtggtccaacaggccgcattctgcaataataaatgggctgccgttgttctagccttctatgtggtttttcaaatagcattaccgtttcctctaaacaaagttttttttttaacgaaccggcacatgattgtgtcaatttcattgaatatagtagagaaaaaacataaactctgggatgctataatcaagaaaacaaaaaggaaaataaaaacacaccatcaccacatgctaacagctccaaacacacccttggggaaaataaatagtatataacaaaagtattgcaaataaaattacactacagttcttgtgctctttctaagaaagaaaagacgtaaatattagaaaatgacataatattaattaattagaaggggtgagccttcgaactcaagtcatctagctcaccatcttgtggagctaaccagaaaacccctggacgtttctctactctttctaagggaatgtacatgcattttaccctcgaaatattgaaattttacatataccttggtcgaaatctacaacctcactaagatcggccattcgaaattacaatgtcccggaacaaaaaggattccgagattttaaccaatttaatcttctctcgaattctttagttctcttgatctcggagagaaaggctcattgatcgaaatatggctgtacataaggaaaagcaatatgaaacctaaaagagtgagaattctcaaagttgtcaaggacaacttattcctacaatttttataagaaaaatgagcttggggtcttacatcttgtacttcttctttgcatctcaaatattttgcattgggatggaactgttcagtaagtttgcatcatgggcattagagcctgcatgctattgacaaagaagctgttgcgcacgaacagcaatccctgccttagcttgattgagtatcccagtgcgtaagggtttgcagtgataatggaattgaactagatgcatattctttccatggattctataacgtcccaatgcctaccattctcatgcatgctaactcatagctaacacacagttattctatggtggatggaagtaatatatacatccctaggaagcaaaagatatgataagttgagaacaaacctaaaatgcaatttggagcaccattttattccctatctcagtgagacaccatatgtgttggttacaacttatgaggagctagctgcctgtctgtgctaatatattcaccaatgggagaaccaaagtgttactagggataaggatttgtttctaccatctacggtctgcaatcaatttacgcctatcacatagaattaattgttttcacagagaaatggtatcagctcagtcctgagacttgtggttcttcggttgggcttgggtccaataagagcatctccaacagattggctattttgatctctccaaatactcatttggccagccataaaataattggagagctaaatttgccttttactccaatagcctctctattcacattctccaatttaacatcgggtcccacatgtcagtctctcattcctcctcctccttcacattctctccgatgcgggcatggaggtcgacgacggctaggggcagcggtcggcggccggtggctggcgtcgcaggcgaagtagagagagatgcggtgacggcgaatgcgcataggttggcggtcacggccagcggcggcggcggaggctcgcgacgatgactacctcggcaacacgacctcaacgacgacctgggtcgcggacggcggcagcggtcacggccgggaacggcaaggagggcggcggtcggcgacggcgcggagggcggcggtcgtggccggccaatgcaagagaggactggacgaggcgagagaggagtggacaagcagacgaggagacgagacaggggcggcaccgcggaagagaggcgcagaggggcggtgctggcggagtggcgtcgccggcgcgctggatctggcgagcggtgggagtagtactagtacacgggagggagagagagtgagagggggaaaagcgtggggcctacaaatggctaggccttttttgctggccaaatttggccagtgcgaggagcactttggccagccggatggcttggccatacggttggccagtccgttggagcacgaatttttgtcaaaattgctaaaatttaacttggagagtagactaaggaggctgttggagatgctctaagcggtcttatgcaaatgggctaccgtgccttgttcgttctagccttctacccattgtcggttttgaaattacattaacatttcctcaaaacaaataaatttcaaataaaaattacatcacaagccttgtttctttcttagggaaaaacatgatattccccctctggagatattgaagtttctacctttaatcaaaatttacaacctcattatccacctaaagaaaatactacttgactgggtcgaaaatactacctgactaggtcgacaatcaatattgcaatgtttcataagaaaagaaaattcaaaaatgtaattattctttggtttttcttgaccttggtgtgaatattcatctatcgaaggtagggctgcattatggacagttataaggaaaaacaaaggagttgttatttttctacaaagttgtcaaggactaattacccatgagttttataggaaaaatagcatgaattcttaggcccttacatatcattttcctctctttgtgcctagaatggattgctatttacgacaattctatgacgtattacattcggtcaaggctggctctatattttagagaacaaccagcctaggcctctaagatggccctgcttttagttgacctgcaattttccaatttttctttaaaattggaactaaaccaggctttatagcaattttagaggtttagttcccaactttttctttaaacttccaatttttccatcacatcaaaactttcctacacacacaaaacttccaacttttccatcacatcgttccaattttaattaaactttcaattttagcgtgaagtaaatacacccttagttggatgctatagggttgcatgttgttgacgaacatactttggtgtcgcaatagcaatccatgtctttgattgcgtatctcacaccgcataaggctgtgcagaaagaattgggttgaactagcttcatgttatatttctggatagtatggcatcccaatgccttccattctcatgctaattaactcactacttaacacgcagtcaataattatcacttttgattctatggtggatggaagtatccctaaaaagcaaagccatgaaaaccagcctaaatgaaaatttgtgagcgacatttctgaatacatagctcagggaggcaccatatgtgttgtctgaggaactctctactatgcctaaaatatttacatggaggagaaccaaagtgttaactagggacagggatattgaaggctttgtttccaccctctacagtttgcactcaatttatatctaccatgtgaattgaatgttgtcctagaaaaatgatactccctcattccctaaatgtttgacgccattgacttttttaaacatgtttgaccgttcgtcttattcaaaaaatttaagtaattattaatttgtttctattatttgatttattgctaaatatacttttatgtatacatatagttttacatatttcataaaagtttttgaaataatacgaatggtcaaacatgtttaaaaaagtcaacggcgtcaaacatttaggaaagaagggagtaatacctagaccaggaagttatatgttgctccacaatactgaaccgaagcaggcatccctagtatcaactgattaaccacaacgctctcgagcggaggagcaaaacaacctgtgaggccgccgtcatgttaatgactcaagaggcagttgctgcaagacggagcaattgtagaatttcgtctcagaggcagcttggtcctggcggatccacacacattagtgttggctgctcgcgtagtcgaactaactagttatagctacagaaccttccatatctgaggcctgtaacatttctagaattagcgggccatcacaagaaagtcatctcaatcgggtcgaaaaaatgcccgattgagatatggtcgtatagacatgttagatgggcataaaactcaggcccatcacagatgacacatatcagtgtcgggccgtagtttagacctgattgagataacatttcatatctcaatcgggtcttaagttggcgcccgccacggatgactgtcccgggtgcacagagtgaggataaagtgtgtagaaaagactagcccggcctatgagaggcacatgaggctagaaaaaaacaaaatttattttttttggattatactcatccttgacaagctatagtttagacccgttagagatgtgagtcatctgtgacgggctatcgtttaggcccgttagagatgagagtcatccgtgacgggtttttgtgttggcacgattaagatgtgtgtcatccgtgatggccggatgcccgattgagatattttaccacatcagcgacctttgctctgcgacggggccctacccaatagagatgaggcttgcagcccgttacagatcaccgaacccgtgctagtgtagacgacacctccgcgctttgccgcggaaaatatatacgcttaaaatgcacaaatttatattgaaaaaatatatttaaaaattataatagcctttctacttataaacatgacttttgttatgttattatccacatggcgtgtcacttcgcccataagatttcaaattctccaaatcatcatgttgtcacattttttggtattatatttcaaacatgaggtatgttgcgtgagaatggtaatgaattaatcaaccatccgttttaaaatacactacatgaatttttcatgtataaatcattcctcaattccccgccgttttgttgaaaaggacctttctacaaactttcaggagatagagcccatcattttgtttatacgtatgtttatccgtctgatttattagcaacaaaaaataatttgtaactaagacttttatatatgtgttcttagtaatttaaaaacaaatgttataaaataaactctaaaataactttttaaattttaaattttggcttataagtataagtataagtatgagaaaaaaatgaggttgtgacactcatgccacccgtgcaccaagatgacaaaaaaatattcttgtcaagaattaaagatgtgccaacaaaattccttgtcaagaattaagatgtgcttcggaggggtaggtggatggatcatcaatcaatcaataactcccctaaccgtactgtttttctcctttttttgaatttttttctggctacctcatttttttacacgtcgtcgtcttgtgattacggctcctcacgagcgtgtctgcgaccgggaaaatgcggtttgctggtaatctcactgttaatcttgcctttgactataccgcgtgactgtttcttccaccgctggtgcccgttttcactgtgcatgtatgccacgtgggatctggttattttgcaaaaaaaaaactgcttgtccatatataaccctcgaattgcctgacagcctgttatggttttccccaaaaaccccttatcctttagagaaatactatgcgaagaagaagagaaaattccgttttgtaaacataataaacacaaggggttttattgaaaaacaaccacacctacccccaatcgcttcccattccccacctcctcccgcccggccaccgtatcgtcacaccaccggtggctgccctcctcgtcgcggatcctgcctccgcttcgttcgccctccccccaccggatcaagccttctgcggtggagggtgagttccggtgtctccggcagtgcgtggagtgtccaaccaggaggaggagccgctgatccggcgggtggtcggcagcggcgacaacgagcttgagctgaacatggagcaccacctcgccagcttcgtgcaagtcctacagggacgccgacgagcacgcgtactgactgtctgcttggcccttccgcagtccacgttgtgccgcgccttcctgtaggagctcggcgggtcgtcctccccaccgacgacttcgcttggagggaccacgatgccgtcagctccatcaacaaccaggtctattccaaaatttcccccaaaccaaagaactccccctttgactcatcgaccgctctattccaagttttttttttgcagggatcgtgcagctcgcgtcctggcaacaggcagtagatggtcgattgcgaccatgaggtgaggcttttgcctctccctcttgtggtataatacttgaaaataagtaacaagatttaactcgagatatcatttagactcaaagctcacagctgcttaagcacaattttactgaagaaatgacagtgtgttggttggattagaaacattttaattagaaaaaagaataggcatcaaattcttgaggcatcaatggttattggggcaatcttgggaggtcgctcttatgagcagattgaacgtttgcgcatgtatgcgatgtcgataggattgttgatgatatacttgatgtgaccatgtcttctgacgagcttggcaagacagcggggaaggacttggcgagtgacaagacgatatacccaaaattacttgggctagagaaatcacgggggtttgcagaaaagttgctttctgatgcaagggaacaacttttttcaggatttgatcaagagaaggcagcaccacttctacacctggccaattatattacctatatcgacagaactgaggtgatggttactccattgattattgttgatttgtaagttgtaactttgtaggttcattaagattcagatttgaagaaaatctaaattatcttgtgatacgattgcttgattcttgacaattgcacacattatgttatgaaggaagaacatattttatcttcaatgttttgattgattctcgtagttcatgttcatacctgtttcagtgtttatcccgtgcaattaatttgttttatgtgactatatcaggctcgttttaccatgagtgtcagtgtaagttttgattcagggatgagcttgtcttggaaattgttctgttgaacatgtgtttcagtgatgtacttctacttacagcaattgggatcaatgtttctctaacagctatatatatatatatatatatatattcttggttccaagcatgcaggaaactttcagagaaagtgtttagttacattgccatagtaaataaattggtaatataattgattcctgtctacgggtgcgcattcagtcaaaatttggctagtcaaaactcaaggaatgaattgttattaggaaaaggcaagaccgaattcggttaatcctgtctattgctcaaagcctttcatagtgaatgtagccacgccgctcctctctccatgaggtgaggcttttgcttctccctcttgtggtataatacttgaaaataagtaacaagatttaactcgagatatcatttaggctcaaatctcacagctgcttaagcacaattttactgaagagattacattgtcttggttggattagtaacattttaattagaaaaaagaataggcatcaaattcttgaggcatcaatggatattggggcaatcttgggaggttgctcttatgagcagattgaacggttgcgcatgtatgcgaggttgataggattgttgatgatataattgatgtgaccaagtcttctgaggaggttggcaagacagcaggggaggacttggcgagtgacaagacgacatacccgaaattacttgggctggagaaatcacgggggtttgcagaaaagttgctttctgatgcaagggaacaacttttttcaggatttgatcaagagaaggcagcatgacttctacacctggccaattatattgcctatcgacaaaaccgaggtgatggttactccattcattattgttgatttgtaagttgtaactttgtaagctcattaagaatcatatttgaggaatatctgaattatcttgtgatacgattgcttgattcttgacaattgcacaaattatgttatgaaggaagaaaatattttatcttcaatgttttgattgattctcgtagttcatgttcatacctgtttcaatgtttatcctgcgcaattgattttgttttatgtgattgtatcaggctcgttttaccatgagtgtcattgtaagttttgattcagggatgagcttgtcttggaaattgttctgttgaacatgtgtttcagtgatgtacttctacttacaacaattgggatcaatgtttctctaacagctatatatatatatatatatatatatatatatatatattcttggttccaagcatgcaggaaactttcagagaaagtgtttagttacagtgccatagtaaataaattggctatataattgattcctgtctacgggtgcgcattcaatcaaaatttggttagtcaaaactcaaggaatgaattgttattaggaaaaggcaagaccgaattcggttaatcctgtttattgctcaaagcctttcatagtgaatgtagccacgctgctcctttctccccaccggccgcctttgggaatggagcggggagagggtacaaggtagagtgccagccagatgaggaaaccaccggagttggcagtgacattggctgccgttgccacgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 64710 - DNA, 4716 bp, Oryza sativa
  unsure (1)..(4716): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccgccatagatcaaaaggttcgtggacactatcaacagcagataatggatggtgtgtatctgattgtactgctgaagcacttaaggtaaatgtatattagttgttacattatttttctttagaaatttgagaaactttatttcctaatgaaaaatagaatatataatggaagtaaaactctttgattttttggtaaaaaaatatagttgtgccattctaattgcttcggggaaatattgattttgttatcttatgcctctagaagtgttgtacagatcaaaacaccaccctacgttcaaatagttaggtggctttgttttgtgttaattggatgactgagcggtctaaacgagccagttactaagaccaggccttcatagatgggcgagataggttagcaaaacatatagatcactggtttacaaacaagcccttctagattaacccttttacacaaagaaaattttgtgcatttatgggcttgccgcattgatgggttgccttgcgcattaagcataagttagaagttgcggaattacatcctacttgatgtaaaggtccaattctgcataataattggaggcgatagaattgttgctactgcaatgtcaagtgaatatgttttaactatcatagatgagtttaaagaaaagggaacatctactacctccatccaaaaatatagcaacttctagctatgaatctaggaacacagttgtccagactcatagctagaaatgcttttattttggaacagagggagtaggtgttacagtaatatctctgaaactatcaaaataccaataaatgtgaattaaagaaagagatacatataggcaaaactcatatgcatagtaaaatgttcatggtgttgaatatcgatgccttcaaatttatatattgaatatgttatcacattgtagcaaaaaagtctattggtgtacttgcacaactgcaatgatgatacattatatttgttgaattgctaaactgtacaaacttttacagttcatcatttgttgattccaatatatgtacatgttacattttttttcctgctaatgcttgcttttttattctttaggccttacttatgctatcaaagatctctccagatctcgcaggagatgccataaatggagaaaggttgtatgatgcagtggatggcatgctctctttcatggtataacttgtacttgaattgttcgccatgttcatatatctagttttctgaatttatcctcccatctttgtcattgtttcccaaattcggacgaataagggaataatttgagcaaagaatactttagggacaatcttgtgtgggccattttatatcatatatggacatttagatattttagtactagcatataagctcacctattccgacaacaactctaagactaaacatttcacaacacattaagtgtaagcgacgggctatgtgtatgtgggcctacagctacggaaagggttgagttgatgcagattttgaagcaatgtttttctcatgtgttattagtgtaaattttattacatggatgattgtggttatggaccttttgaccatgggtttgtggtgcggtctgggacaagaacatccacccttaattaatagagtaggtgaatgcaatacacttgctcattagtggaggtatttgtgcttcaccggcatataaacccatgtgttgtcaccacaccacatgcaagtatacacatatgtgagctagaacctaccaatttttttgggttattgcaaattttggaagctgggaagttaggaaagtcattcaaaatatgttcaaaatattgatgtgtaactttgaccctatggttgttagggcccagtctatacaatacatgagtcatattttcttgtacttgctttgctgaaacattcctttatgcggggccaatattactgggacaagtgtaaaaaaaattgctcatatcttccttcatgcatttcgtaaaacatgagaaaatatatcctatgccattgactatgtcatgttctattttataccatcaaattttccatatattatatgctatccccataagtgacaacgaaaaaagttgttattaatgcatcagaaaagaccatatcgcccttcgtttgcagtgttaatcctcgcaaatcaaatttcatcttaagaaatagttccaggagcgatggtggtacactagtttcattaatccataagaaaagacttggtatcattgagttcaactgtcctcatagtatcattctttccccatgtaaaatgatacttttatatttttgccacgatttttccaacactcactcaggtttaattaatcaggtctttcctctgggctaaatcaacccctttagtggacgctaaacggggatggtataaaatagaagttaagggaaaacttgatgctatgatgtagaaccgtaacaaagtcgatggtgtatgatagatttctctatcaacattattagggaaaaattggtgttgtttgcagcagcaacatgaatatgatgttgcttacttctgcatatcggtcatatattgttgtaacttgtcaagtaattttagcccgggtaactaaggttaataataatcttagctacaaaagtgtttctcaactttctcatctcgaatttatgatctttgagcaaagtttaagtggcaaacaggagtaccacaatcactcatgcaaatatttgttaggtttaaattattatgcattttggtttctttgctaatgattttctaaattttgtacatttctgtcctctactaaaacagtgcaattcaagtggataacatttcatgccattgttttgatccctattttgtttcattgaagaatnagatggcaccttttnaacatatgagtgcgagaagactacacattggttagaggtaagtactatatagtcctacttcggttttaggtaattaaagtgataaaccaagtgcatccatcatatttaaatcacgtaaaaatgctcatataagactaagaagaatgaaaacccataagcaaacataaaacttcagctccatattacaaatgaaattataaaaaaatgatagggtttagaggtacttcttttcatccattcaaatttatttttgaggtaaaatggtctaattacaacataatagtacttcctagaccatttatgaaaacaataacttagtttcactcactacaataatagcttagaagcaataaatgggtctagttgttgcaaatggtatactccataaaaaagcattaactctgtggatgcaaactcttcttttgtaagggcaaaatatattttcattataaggatttacattctattgctttgccacacatccacctcatctaaattactacctccatttcatattataagtcgctttgacctttttcctaggcaaactttgttaggtttgaccaaggttattatcaaaatatatccaatattaaatttaatgatacgtatttggtgtcacaaatgttgctaaaattttctataaacctggtcaaacccaaagcagttagactaggaaaaaggttacaacgacttaagtgttatatctattgagaattgtccaaatgttatatacttgttttactgatgttatacttaagtgtacactagtctattttttaagagagaaatgtaagaatgctcttgattttcttttcataggttctcaacccgtctaaaacttttctgaacattattgttgattatccgtaagtgtgctctcttgtttgaagaaaataccattggtttcacctcacaacatgtgtagagagctaactcaactgccttgaatgaattaatagatctgttgaatgcacatcatcggtacttcaagctctaatcatgtttagtgagtgctatccagtgtaccgcaaagaagagattggaaaatgtattaaaaatgcttccaagtttattgagaacaaacaaaggaaggatggatcatggtttgttgttcttatttgttgctacatattattatttttttatgtttacaatcaaccgtttgattactttttaactatgtcacaggtttggtacttggggtatatgtttcacttatggaacattctttgccataaaaggattagttgctgctggaagaacatatgaaaatagctcttccattaaaaaagcatgcaactttattttgtcaaaacaacttagtacaggtggatggggagagacatacctttcaagtgaaaccgaggtaattcttaccattcattttcacataattgacatagttacctcaaaagttgtgaccaaatatatttttgcaacacatatataatgtttagttccgcatttttccttacatttaacaaatatatccatcgaatctaaaacaactaagaaaatgaagcagacctatataaatttcatttagttaagtgctaggtctggcaacataaaaatatctaacaccccactcatcagcctgcatgcatatgtaat

SEQ ID NO: 64711 - DNA, 19796 bp, Oryza sativa
  unsure (1)..(19796): unsure at all n locations
aaacggcgcagacggctccacttcacaggcagcttgaccaaggctacacctaatcctccacaccttcggcaacattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaacaatattaatccaacgctatacaacataccctgttgtataggcccaaccattttgaacaaccatcccggctgtacagttctatctccaaaccaggaatataccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttatagacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcatgaactatcatttagcagggctaagcaattatacctaatatctagctgaaccaatatatataaagctcaactagtcaagttttaataacccaaggtatcaaggaataaagtaatcaagaacaaaagggctataacaaagaataggttaattccacccaatgacattcgaaaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaaacaccaaaacagcacataaacaagcatgaacagtacatgtggatatttttaacatgtagatctcaattttagaaaaatttagagacttgaaccaactaaaacggagctaagatgaattagttatgaatttttgaagattaaatcggattaaaacacttatattgattttaattgaattatgacgcaataatgaattatttttgaaaaggaaaaagggaattattgcgtcagcggctagggtttcgcggtggaccgggcgcacggcggcggttcacgcgaacggacggccgaaatcgatccatccaaaacggacggccgagatcgatcgggtccacggcggctcacgacgaacgaccacgatgacgtcggcgatgacgtcacctaccggcggcggtggctcggcggttcgtacgcgcaagcccgccggtgaacggcggcgcttcggcacgaacggaggacaccaacgggtagcggacggcacggcgaactcaccggcgaccaaagcgacggcggaagatcaacggacggcgacggcgacgaagaaagaacggcggcggtcttcgggtcgatggcggcgacggtgctccggcggtctccggcggcggcgaaggggtggacgaggacggcgacaacttggcgatcacgacggtggccttcccgagggacgacgacgaccgagacggcggcggcgcacggctggagcgacggcggcgacggcggagctagggcacacggcgctagggcgtttccgacgacgagaggcgaaggcgagggtggcggcgggtagaggagacaccggggatccttttaaaggggctaggaggcaacggcgaaggcccacggcggccggcgacgagaaggaaagttcgggaaaaacgaatccgaaacaaactcgaatccacgaatttccaaacgattttagccggtgtttccaaaggagaaaaggtagaggagatcccgaagatcatttcccctctattgattcggccggagaaggaaaggatcggccgaattggaaagcggcggcggcggcacggcgctagggtttcggccggaggaagacgatgatcccgacaggtgggacccacctgtcagcgacagcgcgctcgcgcgggcggctgcggctgcggactgggccggctgggccgaggagagagagaggggttttgggccgactttcggcccaaagccaaaagagactttttaaaacctttttcaatttaaattatttcttaaatgcaattccatttattaaaaatacttcctcaactcaaataaatcccagaaaaatctaggaattatagaattaagcaaagtatttaatgaaattttatctggccccattttatattggaatttattaattaaaattagatcttctcttctaggcttttacaataaattctaaaaattcgatttaaacaacaatttatatattttgaattttcagggtgtgacaaagggccaaatggtcacattgattgagcaatataattgtctttgttctgtgccctggccatagctgttaactagttaaagtacaaaacctatgtatgtttgcaggtcttgagaaatgcacttgatttttttcgtcaatccctgtcacgcccgaaaattacctttcccgaatgctagtgtattaatccttgtcccagaaaaagccggggtataccgcaagaaacatgatagaaaagacacatctttaataattatcatgatagtatttacactattttaaacgcacattaagcctaacaacgaaagataaacaacagcggacaagcgggcctacgactccatattcacagacgctcaactagggtttgatcctatactccacctaacacttcttctgcaaagcttctttaactggagtgggaaagattaaacaagaaagagtacaactactatactcagcaagccacaccggaatatgcacataatacaagggggtactaggagtaatctattaggggttaagttttttgtaaaaccatctttcaaatagttaaagtataatgcacatttcaaagcacgatactaatctagtcaaaatattaatcaagccgcacacctgtaggaacttgccttaacccagcccatcaggtcatagttccaagcaatccagtttaacagagtaaaatatctaacctggatatattgctaagcttgctagtaatgggcacacggagagagggcagagaggataaggatgacggaagagaggagatcggcttggcgtataggtggctcggtgtttttttccacatatgtgttggtttaattaaaaaccgagacgaatggtaattttataggattcaacatgcttagattatgatatgactttccatgctcaacgatacggattgccaagacttctatgacggatttgaactgcacaacagaaacatttgaaactactgcacctacatgaacaagaaaacaagctacaactgaatataaagacaacatttaagttataacataaattgagcaacttaaacgggccaatttggagctcgtatggctgagaaactacaatccaaaattatatgcaattcaagtgaatatttctgaactacttaattatgattataccattaaattatgtccaatgcatcagcgctcgaggaaaggaaggatcaagcgaccagtagccaagtcccatgggtcaaatggctagttcatcatacacataaatattcactgagacggtccactaaaaaagcagagtgagacccatgtgtaagcctcagagaagagaccaacaagtggatcccatgggacaccaaacaagaggccacatgcacaaacacgcggctatgcgcaggagggatgcactgaccggtgccggtggcccatgacagaggtcaacgatgcacagaagcatggcaaaaggcgagggcaatgggagggagatattggaaaatagatcctcgccacgaaaatgaagatgaccgaatagtgaggaggggactggcggtgtggtcttgaaggcgatgaactcggggcagcgacgatgcttcagcttgacagcgatgatgtagcttcggtgatcttctcgcttgctaaagaggcagacagtggagggcttggcattgcagacttcatgacgacaatgacagacgaggacgtcaacagttggcgcttcgacaaagcgggagagatggtcatggaagcttcgagttgacgactcacgtcgctcctatgggcttcgggtcatgaggaggtcaggctgggaactagctcgacaaggagaaccgaacgcaacgacggtgtagcgagatgatgcatatagtgtagagttcattgacgagtacacccagcataatcgaaatcgtttgtgtgcttcagaagagagtcggggaggtccaaagtgcaacaagggtgagattaccctgtcaaaagtgaaaacatcggttaaagggtggtacaaaatgaaacatcagtaataaaatgtggcccaaagtaaaatttactctaaatttccatatgtgctagttggtcctaaataatcggtgaatcaataatcaaccaaacctgatctaaacaaaaagtaacataatgcacacaatgccttgaaattgatgtattggtcattctctctcagtcatgcattcacagccatggatgtcctagtcaacacgactttgtatttgcatgcagacacacacaagtcacacaacataggtactagcatatgaacataagtcttgataatgttagattacattcttttattgaacaagtttatgttggggctagtagatctcatgttgtgaacactgcttgggcaatgttagctttaatatatgctggttaggtgtgttttgttcattattcattttagtaggtactaattgtctattatattatttattgtactacaatgttatttcataatgcctcaatgaaaatcaggttgaaagagatccatcgccactatatcatgcagcaaaagaattgattaatatgcaactagaaacgggcgagtttccacaacaagtgagtattcaattgattaaatgattttctattttctttagcacaaacatgttcagtatatggattttctatttcttgtaacacaaacatacatagtcaataatgaattaatatactaactgcacataaatattatttttggattgctcatcacttcattttatttggattgttgttttggtatccacaagaatgaaatgggaaaaaatagaatcatcaagttatgtagtttgtggcctggcatttatggcatgcatgaatactctaccatccactcttgatagataatagtagtctaatattccaactttaattacaggaacacgttggatgcttcaacagctccatttatttcaattacagcaattatcgcaatttattccccatttgggctcttggggagtttcgtcgtcgattggttctacgaaagaactgagcctcataaaatgacataattatttgatgccgaacaaaagtttgaactatttaaatatgcaaatgttttaagtgtaaaaatatcatatacaaaaaataaattgctatctgatgtagcaaaactactgtggagattatggataccccatacccacacggcatgtatatccgactaggtataagggtaccatatttacatagaatatctttaaaggacttgggataaattcgtaacttgtgtatcaaggaaatatccgagatcctagtcggttacaattgtattttatctttacttgcctattccgttaggaatatgggttgtatcttgtaatacggacacctccccatatataaggaggggtccgagtgcctcttggggtataacttttcctctagatcatacgatcaataacacactcggcggatcaatccccggacaggagtaggatattacttatcattgagagggcctgaacctctctgatcccaagattaccaccagccaagcctctctgcacggcacaagccaagccttagcgttgctgcctcgggatccaatcgcaggagcagggatcatgcaaaatgctctgttcactcgccagctaatgaacatagagatcgccgcgctgagcagcctcactctccgcgtcgccggcaacccatcgatcttcgtgatacactcaatcaacgccatgcagaaagaggccaccaaccacactgttcaccaaatcgacatcacgacgacgaagttggcgttgtagcttttacaagcgacctgcgtcgagtggattggctggctagcttcaagccgactggtatcgagaagtatgacggcaaaaccaatcccgagtcatggcttgtcatgcccagaaattcactcgtaatttctgaacttatcacgcccagaaatttactagtaattactaaacttttttgtgcgtaaaatcctcgtccaggaatcagccgaggtacacaaactgacaatttaatatacatattcatcaaaataactaaagcatctaatacttactgaagaggtacttagtcctcacaacgaagaaaactgtagcggaaaaataaaatctagcaaagctccggctccactcccacaggcaactcaactggggtataagccaaacgtcttctccttctggatcatttttcttcaactgaggttgcttgattattgcaaggtgagcatatgacatactcaacaagccacactgcaaatatgcaagtgtacaggataacaaaggatggcataatatagnnnnnnnnnnnnnnnnnnnnnnnnnnnnnnatttaagaacaataaaaaagtagaataatcatcaattctaatcaacactgaacagcacacccatactgctcaggcccaaccatcctgaacaaccatacccggctgtacagatctaactccaaaccaggagctaattattgtgagaggtgtgagactaatcacgaaaaacattgctcaacctgcctatgaccgtgggcacggctattcaaatagttttactctggccagaggtgtaccactgtacccacaagacacagccccaaaacatgtcaccatgctctcagtaccaccacggtacctcgaaacgggattgtgacagtacccctcgtacaacacaactcaccacagtgcgccattcctggatcataatcaccccctcaataaccagaggcatggactccccaacgacccccatggacttctcgccgcttctcagtctggcaccctgtaatgaaccatactatacgaaaggtaaagccattgcccacgctagcttgtggttggcacggttaatgtttctcaacagtaacattgcagtcatgagcacgtccatcaaaaccatgtgctcacaacccaccattaatcaaattttaattatcaattgattatcataacacgattaaccatcgtgagctaccattaaatataatcataagtaataatatagtatgattcatcttattaatgagctaatgtttctaagcatggctaagcaattatatatatatatatatatatatatatatatatatatatatatatatatgatttagctgaaccaaaccaatatataaggttcaagctaatcaatttattacccgaggtatcaaggaatagggcattcaatgcaaattgaccataacaaaggaataggttcacaccacccggtgacattcgaaaataaatacacagttgaaataaatagagaatttgaatataggatcaacatgctcaaaggattgtgtttgggatctccttgcaataatcggtcttcaattagtcttctgaacaacttccgacgcactcacgatccttcgcaatgacagaaacgacaagctaacacgccaaaccgagaaaaagactaataaaaacaaaatatacagcacataaaaataaacaaacatggagatcatgattttagatgaattagagacttgaatggcctcatgtgaattagttatgaattttacaagattaaactgattttagccttatacagaaaaggattcacgatttattttagaaaagaaaagggctttatgacatcattgatgacgtcatcaccggcgggaggctcgggttccaacgtttgccggcaacctagggcacgacgtcgcgaaccgaaggcaccggaagaaagagcacgacgaggagaactcactgaggggcggcacgacgacgaccgacgacgggagacagccggcgacgaactccgaagggcggtgaggtactggtcgacgatgacagcggcgttccggcaatctttagcggaggaaaaccagtggacgggcttcaccttggctctgcgatgccgaagaaagcgacgacgacgtccagaaaccacggagtcgacggcgaggctcggccggaggtggagtagatcggattcacgccgtcgaggggcttccagcgggttacggcgaaaaggaactagtggccgggcttcttctcctccttgcgaacccggtggtgatgacggcgaccggaggcgacggctacaccggatgctagggacggctggagcggctgccggcggcggagagagaaggcggctgcggggagagacggctagggaacgggagctcgagctaggggttggaaacgaaagaggaggtcttgggggttctatttatagccaaagctggaggagatcggctcggacccgagaggatttggcggcggattggttaaggttcgccggttcggggataaggtttatccgaccgatttgaactcgaatcaaagggataaaatccgattccttagaagaaacggaagagaagaaaaagggaaacaaatcccctcaactaattctggaaaagatcgaaaggggaggccggatttggagggaaaagcggcggctgcacaggcacaggacggctgggtcgggctctgtctggagctggaagatgatactgtagcgcgggggaagcaaaacagattttttgctgggctaaaaacaaaagaagggagggataagaaatagacttccccggaagacaaagagacaggaagcaggcaaagaggaagaataggccgaggataaataaatagacttttccagtttcagcccaaaaaggaaaagggaatttaatttactttttcaaataaattaaccaccgaaatgatctttgaattgttaaaaatacttccatttcccgaataatttcaagaaaaatcatgaaaccaattggacactcaaaatacttaacaagattataatcagaccatttaatgactaatttaatatgtgaataattactgaaatgttctttgtatgattaaaattaagaattgagctccgaaaaatccgagaaaatttcagagagtataattaatcatggagaatttaataaaacataaatcctatatttagaaaattttatttcccacatttagcttcacttgtaaattaatgaacattcaatataaattctaataataatttattaaataatttataaatccttagacgaaaatcaggatgtgacacggcttaccgtctacggcctcgcaatccgcgcagcaggaggagacagtaaagctatggcaaattatttgccggcggcccttgctaactctgcccgatcctggctccatgggttaaccagtggtacaattggatcttgggcagagctccgtgagcacttcatcgccaattttcaaggcactttcgaacgtccgggcacctacttcaacctctacaatgcgatccagaagctcggtgaatcccttcgggactacatccggtttttttctgagcaacacaacaagatttcaaacatcaccgatgacgtcatcatagctacattcaccaagggtgtttgtcataagctcttggttggcaaatttggacgcaaacctcccaggacagttaagcaaatgtttgaaaaagccaacgagtatgccaagtctgatgatgccgtcaacgcctctaagcagtcgagcatcaattggaagtccaagaaagatacgccagccgtcagggggaatggaagtaacaacaataaggatctcaagcgtaagcttgaagaccttgtggcacttgcatcaccatcttcccgacagcgttcgcgtatcaacacttttgacaaggtcatgaacgcccaatgttcacatcatccaaattccaaccatgcagccaaagattgtttcatctacaagtagtttgtggagcaatacaccaagcaagcaaagaagccgacagatcgggagcaaagaacctcaaagaagaaggatgacgaagacgatggtccgactggttttcaagattctcgcaaagagctcaatcctatcttcggtgggccgcaagcttacgagtccaagcggaaacaaaagctgactgatagggagatcaacgtcgtccagcccgacacgccacaataccttcgctgatcagaaacaacaatcaagtttgaccgctcggatcatcctgaccgagtggtccacctggggcggtatcccctggtactagacctggtggttcgcaatgtcaagctccgacgatcactaatcgacggtggcagtgcactcaatatcctttttgacaaaactctggacgatatgtagatcccgcgcactaagctgaagccgagtagcgctcccttccatggaatcatcccagggctgtcttctactccactcggccagatcaccttgcctatcaccttcggcactcgggagaactttcgcacagagaatatttgctttgaggttgctgactttgaaacggcataccatgccatactcggacgcccggcgttagccaaattcatggcagtcccacattacacctacatgatgatgaagatgccacgacctcgaggagtcatatctttgcggagcgacatcaagcaagccgtcacctacgataaggaaagctgtgagatggcccagacccgtgagattgcacttgctcggaatgagatccgactggctgcatcaaccgcaaccgaaggagaagtgcttgtgaccaagtcaccgaagactggagaaggcgataccaagaccaagaaaattcccctagatccatctgatccatccaaaactgttgtaataggtgctgagttagattgtaaataggaaagcacgctcatcacctttcttcaagctaataaagatatttttgcatggaaaccatcggatatgcctggtattcctagagagatgattgagcactccttaaatgttaaagaagatgctagacctatcaaacaacgactccgccgtttcgcacaagacaggaaagacgcaatcaaggaagaattaaccaagctgttagcagcaggcttcattatggaagttttacatcccgactggctggcaaacccagttttggtttggaagaagacaggacaatggcgcatgtgtgttgactacatcgacctcaacaaatcgtgtcgtaaggatccctttgggttaccttgcattgaccaggtggttgattcaacagccggctgtaagctactcagctttttggattgctactcgggttatcaccagatcagtttgaaggaattcgactgcttgaagacctcgttcatcacaccatttggagcttactgctattcaccatgcctttcggattaaagaacgctggggcaacctatcaacgcatgattcagagatgtttttcaactcagattggtcgcaatgttgaagcctacgttgatgatgtagctgtcaaaaccatacaaaaagatgacctaatcgctgatctggaagaaacctttgctagcatctgcgcttttaggatgaagttgaatcccgaaaagtgcaccttcggagtatcgtcagggaagccgcttggctttatggtgtctcgtaggggcatacaagccaacccggaaaaaatcaatgacatcctcaacatgaaaccgcctagttcccagaaagatgtccagaagctgtctgggtgtatggcggcgctcgaccggtttatttcaagactcggcgagcgggggatgccatttttcaagctactcaagaagactgacaatttccagtggggacccgaagcccagcaagcttttggtgatttcaaaaaacttctcacaactccactagtcatggcatcaccacatccgcaagagctgctattattatatgtgtcggcaacatcgcaagttgtgagcacggtcttagttgtggaccgagaggaagacagccatgttcaaaaagttcaacagccaatctactttgttagcgaggtcttggccgactccaaaacaggatatcccttggtatagaagttgttatatggtgttttaattaccgtcaggaaattatcccattattttcagagtcacttggtcacggtggtcacatcgtttccactcagagacatacttcataatcgcgaggcaaacgggcgaatcacgaagtgggccctagagttgatgtctttggatttatccttcaagccacgcacttcaatcaagtcccaagccttagcagatttcgttgccgaatggactgagtgtcaagaagatacacttgtggagaagctggagtattggactatgcattttgacgggtcaaagaggctatcaggcactggagctggggttgtgttgatttccccgactggagagagattgagctatgtattatggatacacttttctgcgtcgcacaatgtggcagaatatgaagcacttctccatggactaaggattgttgtttctctagggattcggtgtctggtggttcctggcgattcccagttggtcctcaatcaagttatgaaagagtggtcctgcctagatgataatatggctgcatattgacaagaagtccataaattggaagacaaatttgatggtttagagttaactcatgtgcttcggcacgacaacgaagcggccgacagactagccaattttggttcaaagcgagaagcggctccttcagatgtttttgttgagcacctttatgagccaacagtaccaagaaaggatgtaatcgagaaggtagggacccaagaagtcagcgtgattgataccgattggagagaacccttcatcaaatttttgactaagcaagagcttcctcaagacaaagacaaagccgagcggatttgtcgacgtagcaggctttatgttatgattgagaccgagttatacaagaaaagtccgtcaggaattctgcaacgctgtttctctttagatgaaggaaggcaattgttacaggacatacattctggcatttgtggaaatcacgctgccgcacgaacaatcgttggcaaagcttacagatagggttttttctgccccaccgcagtatccgatgctgagaaggttgtgcgaacatgtgaaggttgtcaattctttgctagacaaattcatctaccagctcaaaagttgaaaactatccctctttcctgtccttttgcggtttgggggctcgatatggttggtcctttcaaaagggctaccggtggtttcactcatctttctgtatcagtggataaattttccaagtggatcgaagctaagccggttgttacaatcactgccgacaatgctcgagattttttcatcaacatagtgcatcggtttggggttcctaatcgtatcattacagataatggcacccaatttactggtggagtgtttaaagacttctgcgaagattttggtatcaagatttgttacacatctatagcacatcctatgagcaatggacaggttgaacacgccaatggtatggtacttcaaggcatcaaagcatgagtttttgactgactgcgtccctatgccagcaaatgggctgatcagctgccataagttctttggtctcttcgcactacacccagtcggcctatgggccaatcaccgtttttcttagtctatggtgcagaagcaatgttgccaagtgaggtggaatttgaatctctgtgatttcgtaatttcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctccctcatgggaaggaccatttatcatctcccatctaaatccgaccttttctcttgtgttttcctaaaattagttgaggggaaatatttcctttatcttcctctctcgttttccctaagaatcggaacctaaatccttgtattttatccgaatcaaactcgttttcgagtttatctctccaaactaaccctcggattttccggttaaaatcctctcattttgagttcaatctctctcacccgtgcctatataaagcatcccttagtcgtcctcttccgtttgcctcaagttccaagctctaccgttgcccgtagcgccgtcgctgtcattgtcgtcgttccagccgcgccgggccgtggttgtggtcgccgtcgccgcttagcgtcgtcgccgttgggttcgcgcggaggaggagcacctcggccgcccctttgcagccgctgaagaccatcggagagccgtcgtcgctgtcaagtcaagtcgagccgccgttggagttcgtcgccggccttcgttcgtcgtcgtccgtcgttgtttttcgcaccggtgagttcacgtcgccgtcctcttcgcatgggtgtcctcggaagacccagccgagtcctctagctccggcgacctcatggttcagagccatggccggcgatgtgatgacgtcataaatccttttattagtttttctgtattagataaaatcttattaaacttcggaaattcataactaaatcatcgtaactcggattcaagtggttcaagttgctaaattcatctaaaatcgagatctacatgttaaaaatatccacatgtactgtttatgcttttttttgtactgttttgttgattttgttcatttcctttagtttccgacgttccggaggagagcgtttatgttgaggaaggttcagaagcgtttgaggaagctcaaggcaagtcacacagatcccaaacaaccctttgagcatgttgaacccgtttaaagctaatgttttatttcaacttatgcatttttttcgaatgtcatcgggtggtgagcctttcccaattaattatggccgaagatgactttattttcctatgggttataatttgatttgctagaaccttatatattggtttggttcagctaaatgctacatatgataagctcattaatgggatgaatcatatatactgcgttattatttatggttatatttaatggtagctcacgatggttaatcgtgttatgataattaattgataattaaaacttgattaatggtgggttgtgagcacatggttttgatggtcgtgctcatgacaattaaggaccggttcgcgagctactgttgtgaaacatttaccgtgccaaccacaagccagcgtgggcaacggctttaccttttgtatagcatgattcattatggggtgccagactgaaaagcggcgagaagtccgtgggggtcgctagggagtccatgcctctggttttgagggggagattatgatccaggaacggtgcactgtggtgagttgtgttgtgcgaggagtattgtcacagttcctttccgaggtaccgtggtggtattgaggcgcatggtgacatatcgtggagctgtgtcttgtgggtacagtggtacatctctggccagagtaaaactattcgaatagccgtgcccgcggttatgggtgggttaacaatgtttttcgtgattagtcccacactactcattattggtgataatttgtgataattaaattgactcctggtttggaatggtatattcctggtgtggaggtttgatttgtacaaccggggttggttgttcagatgaggttaggcctatgcaacacgggtgtgttgtatggtgtttatttaatattgcgtaattacttaactgttttactattctcttaaatgtttattaaatgttgtttaagcacataagctatattataccatcctttgttatcctgtgcacttgcatatttgctgtgtggcttgttgagtatgtcatatgctcattcttgcaatattcattcatcagaggaggagtatttcagtgaaggtgatgatctggaggattaggctttgtacgggtcaagttgcttgtggagtggagtcgccatagctgtttagtctttttttgtaaggaagctgtttagtcttttgtttttccgctgcgtagaattttattcttttgagaggaactatccacctctgtaataatttattattttgcgaatattaattagtagtttgatagtactctattatcaatttgttattgtgtgcctcagctgattcctggacgaggatttaacacacatgtaagcgtttggaattttggatagaaattccgggcgtgacattccatgaggtaataaattgttgtacataaatggtataattccaacataaacaactttataatattatttaatggcatgtcaatcaagacatttttctgtattgttaacaaatgttactcacctaagtgcacagtgagcccaaaactcctatcacaaaggtgctggtgaaggatagatgatcacaaaatggtgtcaaacgattccggtcacccaacttcaccaagacaagccaaatcgaggaggtgccctttcctagcccagccaacctagcccaatcctcaatcgactttggccacacgtggggagtattcgagaagcgataccgacttcaaggtgcgattggaaccgtctatgacaccaatcgacctaatgaagggatccaaccagtgccacatgctcagatgacctaacccaggtaggccagaccactaacctaggtcgaccgagaaatcgacttacccccaggctataaattacccctcccctccacattatttgcaaaacaccggtagctaaagatcaagctctagttagcaccatgttgtccaaatagagtagaaatgtaatactccaacccattttaagcctatagttataggtgtggtggtggttcaataccacctaggaagtttaggtgggtaaaggtttgcttataagcatttgtgctccaaccatggtacccctagtcaacctttttacacgaaacgaggacgaaattataagcagggtaccatatgagcgtggcccgctcaatgtgtagagcaaacaactgtagatgttggagatacggtgttacaggaaataggggagtggggagtttggatgagaacgctacggttgtcggacttcgccgactctctaatgcgaagaagttgggaaattttggcctcgtcaacattcggtggttgatctctggtttgtcagtagtcgaattttgatcggtcgatggtcgtcatccaatcaaaatgaccgtcttcatcttcctggttcgacaatgtgaatcttactgttttgcattacttatcaagtcatcttaatgattccatacttatcgattcttgcttcaatttatataaaggtcttactttatttatctttattgctttgctagtatgtgcacttgagcaaagtagtagcatgatacgttagcgtggggcttagctacaagtttatttgggaaggtagtctagatcaacgggggaccataggcgacaagttgtgacaaccctatccatcccttatagttagccaagttagactagatcccttcccaatcaatattccctcatgtctaggcataagtatcccaatggcatttacatccttatgtaacatatacaacactcaattacctctttggttgtgcatccttctaggtgtgcccgattgtgcacatactctttgattgtgcacgattgagcttgtttcggacgtcgaggattgcatgtggtttatggaggaagcttcactttggtcgtgaagattaagtctagtttattttgtttttccgctgcgtatgtgagtttctttttgttatttttgtaagacgtggatctgtctatcaaattgtcgtttatgtactctgactgatcctggacagagatttaatatagattctgcttgaaattcgggttagcgaatttctgggcgtgacaaacagcgtcatacatttttcgatggagggagtatcaatcaatattagtagccatcaggtttccaatcaactcaattgttgtttggtgacgcaaagtccgaaattagaccatactcaaatgcaaagtcaacttcctttaaggtaatttgtctaaattactagtactaaccgtgacatccaataatatatatgaaggaaaaactatggtggctattaattttaactacttataactcaagtaacatccatatcaccgtcggccagaattcttcatttcaaatagagtttgtgctgccaacagcacctcaaggtcaatatccctgatttccaactgtacaccctccataactacctccactccatgatgtggctccggcgcacctccctggacaccagtctccccggccatgacggccgctatctccagctcgacagcgctaaccacgtggctcctcctgtggcaaagcctccgtaaccgcatcatgcgatgaggactcaccctcatgttttttcttcctcttcttgggcgcaagcagtagtagctcctcgttggccttgaaggcggcgtcagcatgtggagcatcacctttgaagtagtgcaccataaccagcccgaggcggccgtcattgtggtcgtctttgccatggctcaacttctgagaacgaaacacccatagatcgatcatggcctcgttagcaatggcaacctttttcacctttttgatggccttcttaccctttttcttggcgtcttcttggagggtaagactgcaattcttcagaaatgtcttccatggacgacccatgagacgatacgagttattagctttaatgtacttcagcgtgaggatgtactcctcgccggtgcggtcgtaggcctgcacgaacagcccatcatcaccattgttaggctcattgttaggcttgttcgtgccattgtcattgtactctttatgctcatccttcttctctttagactcaccgttcttcttatttttaggcttgctggatttctttttgcgcttacttgtggcggctgacttctccgccagcgttaggatgctatcaaacggggataactcgccatccttcttgcgtgatatttgtaaacggttttggcttttcaaacggtcggaacgccacatcatcttgccgtagacgcgcaccggcggcgagacggcgccgaggccgttgaggaggctgcgcagccggtcgtggacgacggcaatgtcgtcaagcggcacgaccatgtcggaccctgccgaagacgtcgacgcgccgtctctgcctaggctggcccagaacttgccgtggccgcgccgcttggtgttcttgcaggttccgatcgctgtcgtcacgtgctgtcgtcggccacctcggatggcgtcacccatgagcttgtcggcggcgggcaggccgattggcatgccgccgccactggcggttgatgggctctctt

SEQ ID NO: 64712 - DNA, 6536 bp, Oryza sativa
cgcgtataccaaaccaaaccatcgcggtttcctcttccctacgagccggagactcctcctcgcacgcgaatacgcgatcaccttccctctcagcggtcggcggcggcggcgcggcgctcctcctccctaccctccctctcgcgtcgtgcgtcctgcagtcttcccaggcagtgtgatgcagatccgatcgcccattgatcggagaagccgatgtggcaccaagttgatcgaacacgctagctaggagatggatttgaacggaaggtattttcatcttcttcttcgatctgctgttgctttggagtggagatgtttcttttctgttcttgcacatttgttttgtcagaaagatgcattgaaggtgtttgtgtttatgcctgactactgtacttctgtcgtcccaaattaaattatttcatggattaataatgttcactttcatatttctagaggaattggaagcagatcttttttttttcttgtttgatcaacgttcccttcgaatcaattaattttctgatggtatacgtgctgatattcatgcattgtcgatgggtttaaccggtgtcattgtttgaattcagaattatctctctaattcattgcgtccaaatagacctattctaaagtttttcattgtgtctactgtattagaattttcagatatacaggagtacgtaaattacactgttcattgctgaaaatatcagaaatattgttgatatctaactgacttgccactaatgaggacacaatctttaagatgtaaagtacaccatctgtgtcaaaaccagtgccatgtaatttgaaggttgtggcagtccatgattaatgaaatcttgaagtacattgaaaagtttggagagtgcaattgtttctagaatcttgacaaatgatatgctccagaaatacagagatctggtgctagcagaataggtgaatttgcttggtttattagatttttctgttgctaatcacatacctgcttcatactgtgaggaataagaacgtttctgttactctatggaaaaatagtatgaattgtcttggggagtcaagtatagtggtgcatctaaaaaggatctctggaggaaggagcagccatatctaaagtatggtttgagagaatatataattgcacagattttgctaaaaggtgtgtttaattgaactgtatcgtgaaagggcatgtagcctagtggttgcagtgacctgagtagcaccctgagttcaaatctccataggagcgaatttcagattggattatttgagagctaagttccctattcgataggctaagttcctaatttaaaaaaactatatatatccggttggatatagaggccgggtaaaaatacccttctctaaaaaagataaaaaaaaattgaactgtatcagtgcatatatttcctaattgcggatattagttgtataaatatgcatataattcttgttataaatctacatgaaacactgtaataaaagattgaacaaaagtgcaaaacttaactttcttaattttgtcctgtcactcaacctggtattattcattgtatatttagagctgtattataagctccctgacaagccatatgttttttttcatccattgcatatttgcataacaaaattcgcatagctgttgatttgcaattgcactcagtgatggcaacttggtaggactcgactccatggatttactactctctatggatcaataatacagaacgaggttttcgtggacagagggatcacttgcactccaccacaccaataagtttttaactaacattttgctttttttatattttatttttttagagaatggtattttttacccggcctctacatccaactggatatatacggcttgctgcaagttagtcccttcaaaagaagtgcatgcttggttcatagacattaatcggcttatggaagtttaaaggtacattaagaatatgaagatgcattatttagtaggtagctatgagccatatatatattgctttgagttggctagaattagatgtcatttctatatatactgttaaggtcatcttatcggttttaacctgtggtttatatcttctaaaatcctgatcatgcccatattatatcctgtaattgaagcgttttcttcagatatatcacctgtctcaagaaacttcagttcaattatttgccttcgactttatctctctctataatatgtcatcgactttatcaaatttttatataatatgctattgggggtggatacttttcaaaaaacacctaaaatgcccttcgaacatataagggtcgacaattgattgacatactagaagtatcgaaaaatatgaaaatgttcacatagcattcgcacataatatagaagtctatgtatatttcaagattttcaatttgcaaaatgaaatttatgtttcatatgctaatagaatattcttgtattgatgctctttacgtaaatcatccttcatatgctacataaaattatttttctaatccagctatcttttgtgtatgtggttcctctttcacatgccacataaaaatagtttttcaaaagaaatcatgacagaaaatcttaaaatatatacacaaacttttatattgtgtaagaaagctaacaaaaacttttatacttttttgaaacttctaattagtcaatcaattgtgaaagagaatggcttgaaggaaattttaggcattttttgagaagtacccaccccagtggtatattctagaaaaaaattacaaagtcggtggcttattatagagggagacaaagtcgatggcaaattgttgaactagtataaaaaattaggggtatataatagattctctcatttttataatgatttataatttgaataattaaacaaaatattggtcattgtaggaaaattaagccaaaaattagcaccaagtatactatcattttgtatcaatacagtaatgaaggcactattcttcagtgtgaaatatttagaattacaggggtatcgtccattgtacttaaggcttacgaatttagttgtgctcagtaattgtgaaagtcccttgctatttttttccccttatttatgaataatgtcagttatactcattcaagaatgtatatatgacatgttaggcatgattttcttcccaaagatattattctttagagtatacaaaatcagttggatagtgaaaattttgatgctcttgccttagctgccctttttctctaggtgttgattactgaatttagaaatggcttagagttgacgctgtttgataacggctattttttttaatggtagaacactcatgttatgtgttgcgaaaacgattctagtcatgtagctgtatatgaagcttctaatgtacaattgttagcgacacggtggcaagtcccaacccagccgccaccctcccctcatccgcctcgccagcagccaccggcaaagctgggcagcagtgtggccttctagctcgctccaagacccggtggctggggcatcaacgggacacgggcggaggggccgcgatgtgtcgacgacgggttctgacgccgtttgggctggacacggccgatccggtgctgacggaggtagaattggccccctcgcgaccggatcgagagggagcacaccggccgcgccgcattcaggaccggcggaggaggtcatggtgtcggtggaggagatcatggcaccggcagaggagaccatggcgtgctcgcgcggaggaggcgcgggatggccaggttcggctcctccgagaaggacgaggtggtgaggaggccgtggaggtgcgggcagcctgggagaagcaggcggcacagctggtggcgacggtaggccggcatggcgcgagatgcgtggcggcagcaacgtgaggctggcgtggcgtgagatgcgcggccggaggcagcgggaagtcagcgcggtgcgagttgcgcagccggcggcggaaggtccgtgcggcgcgaggatgcgcgtaggaggccggtctggcgtggaggcacagccgacgccggtgggaggccggcgcaagacagggaggctgacctagccaacgccacggaaggacgcaacgatggcagggaggccagagtggcgagtgtgccatagaggcatgcggtggctgtccggcgggagggcatcgggtcagcggtgtcctcacgctgatggcggatggtcggtagtggagcaatggagcaattagttgtggatagacagtgacaggcgacagccgcaaaacctagctcggtgttagttgttccaaaaaacaaaaataatacctatgaacttgaggagcaattgattatttcttagaggacgtaggataaatattgacaaaaaaaaatctcttgcccagagaaatatcaagatagaacccgtgcttacatcaaatccaatttaacttgaaaacctacctttgctcaaaatagcatatgaaatctaacaattaaactgaagtatatacacgtactaaaatcacgtgttagtttgaacatatactacaataacaagtaacagatgttcacatataacaaaccaatcaaatgaaatcgctacattttcatatgaattttaggtttacaatgaatctaccatagtccaagaatgagttagtacaacttaattatcacgaatcgagttctcatacttcacaaccatcgatcaaaacaatctggtgtgcacaacaatattgtcaggaataaatatatagtactaattaaaaatactcaaagtcagtgtaggactcgccggtgctcgagttggccgcgccgccaccatccgccgcggcgggggcggcggcggcggcggcgttctccggcggcttcttgtccttgggagtggtggcggacgcggcggcggcgtactgccggaagtcgaccggctccggcaccgacggcggcgtgaggctcctgacgagcgcccagttgacgccgtcgaagaaggggtgctgcttgatctcggtggcgcccctggtgaaggcgatccgcttgtggggctccttgacgagcaggccgcggatgaggtcacgcgcgacggcgctggcgccgccgtcggaggggaagcggagcggctgctcgatgacgttgcagagcgtggcgcggttgccggcgcccttgaacggggtggcgccgtggatgagctcgtagaggaagattcccagcgtccaccagtcgacggcgctgccgtggccctcgccgcggatgatctccggggccaggtactcgtgcgtgcccacgaacgacatggaccgcgcctccgtcggctccgcgttgaactccaccgccgccgcgccgttgagcagcaggcccatgtcgctcttggacgccttgcggctgcgccgcggcaggatgcgcgggaagaaggaggagggctggatgcagccctggttcgccggcatgctctcgccgccgtcgatggcgtctcctctgctgcctatgccgccgccgctgccggtggcgtggacggaggaggacttgacgagggtggggcagacggtgcagcggagggagaggtcgaagtcggagagcatgatgtggccgtcgtccctcaccaggacgttctccggcttgaggtccctgtacacgatccccagcatgtgcaggtactccagcgccagtagcacctctgccacgtaaaacctgacgacgcatcaaagttcaaattttcccacgtaagtttcatattttttttagatcaaattatcggacgcaagtttcaattttcagatcaaatctacaatagaatgatgatacatgaggtacaggcaatagatatattttgttgtcaatcgtgatacatgactatagataaatgtaccaaaatttatactagaaaatagtgtgcttcatggtacatcctcgagcgtaggaaaatcactcgttgatttttcaagcaactaataaggttagtattgtgcaaattccttctaaaattattctgcaaattttagcacctcctgccagggctggaaatttcccctacaatacaatattacttcggctgaaatttttaaacttttcaattttttcattaattttagtaatatttatttaaattcaactaaattttggaaatttcggtgacctccgatcaaaaggggttaaccgatggagtgaaccctgcctcctggtaccaaagttactgctgtctaaatttgttcaaacttgacggaggttaatttcctcaaactgctccaagctccgtggaaacaatttgttaaaattccgaagtggaacctgacctggcggcgggctcggagaagtgcttggagggctgcttctgccggagggaatggaggttgccgccggagcagtactccatgacgaggcagtagaacttgtcggtctcgaagtgggtgtagagcgtggggaggaaggggtggtcgaggaggcccaggatctcgcgctccgtctccgcgcgcgccatcttgttccggctcgcgatcgacgccttgtccatcaccttcatggcgaagaaggccgacgtgccgcggagctccaccaggtacacgctcccgatgtcgcc

SEQ ID NO: 64713 - DNA, 6431 bp, Oryza sativa
  unsure (1)..(6431): unsure at all n locations
cgccgcggcgccggtgctgctgctctccaggctgttgctccgtgtgctgccgctgctgatgctgtccaggctgccgttgctgacggcctcgccacggtttgttcctgctgttgctgctgctgcggtcgtcgtcaccagcgccgccgtcgtctcgggcctctgcggcggcgggttcgccgtcttgtcggagtgatgattcggcttgttcttgggcttcgatttcttgtctggagatggtttggagggtgctgatcgaatgctgaattgatcatcttcttcaaagctggttcgattctgttctgtgctatttttatgagggctgaaatccatgccgtcctccatcgttgttagtttattgaaagcttgagtttctaggtaatctgaaacttcacagggcagaatgtcaaaatttgataggtaatttgagtgaaagtgtaaaaactggaaaatgaaaaaaaaattacaatgcaggtaaaactgaagaagaaaacgagtcttggagttttactctacttttggttggaattttagaagaagaatcgaagcttaatcttttgttcttctttccggatctgttaaacttagttttttttcccatgtaatggcaaaatcttacgtactcgtgactttgtttggctgtatataccccacaaaggtgcagaggccggatttaatctaatctattttttttaaaaaaaaggaaaaacttaaattaggagtagtcttagtataattttatcaccgggatgaaattgtctgagattaagaaagcttcatttatcaaaaagaaatgaaaaaaaatgttctgctactctcaggcctccttgacaagttgctagccacttgatgaacagtttaggttgattgtgcttattctttgtttattgaaatctaaaatgaatttgaaactgaacatttagcaagcttttacaactttaaatgtattaaactcataatttcgaaacttttaggtcatttgcactatggtgaatcctgtaagggatgttgaaattgcattgcgctaagactactcattatggaggaaattctgaaaggctatggctatcaacatcaaataaaaccggtaccacagcatggggaacctcattatcagaagaaaacaacttgaagatcagatagggaaatacaaacctggaatcaaatcttgataagggcttcagacaacaaataatctgaacaatgcttcatgtcataccaggaaaatcaaagctgaaagggaatgatcaaacaaaattaaggaaaagggtctcttattcgtcttgccatgcttgaaagctgcaattggcagcaaaacaggggaatgattgctttgttgggaggaaaagagtaaaaatgcgtgcagacttcgcgttgaatggttcgtggggttgagagaataatccgttaggatggagggcatgaatggaccaagaatgcacttctaagtttagtgcaaaacaagggagttattctgggtcatccatggtctctccctattcttgttctggttgggtcttccgttacagagttgattcgaaacgtgaggaattgtcaattgtgcatgaattttgggtgacccatggaaacataggttagctacagtaaaaaatttgatcatataccttctccttatatctcaattgaggaaggagtctcagcgacctcacatgacctcacatgtcaacttttttaaaatctaaacggaggttatatgatccaaatctcccaagaaggttaactagaaacaattcccctccatgcgttggtccaacgacttagacatgatatattttggttgtaataatccagttttacttaaacttgagttttgtcctggttttacgagaaattactactccctttgtttcatattataattcgttttgactttttttttatagtcaacttttttaagtttgatcagtctgtagaaaaatatagaaatattttcaacacaaaacaaatgtattatcaatatatattgcatattagttttaatgaaactaattaggtattataaatgttgctaaatttttctataaactaattaggaaataggtcaaaacgacttataataagaaacagaggtagtacataccaatattggtcgttctgttgttcacttaccggtcaagagtatcaaaggccatcacaagagttatcgatgcagttatgttcaaaaaatcctttcctggttgaacaactgtctccagagtacagacatcagtgctgatatctttttggttgatccttcttgttcaagttcttgacctctttcatttccttgttgtgacttgtgagccttctctctttcatgcctggaacctggctaattcagagaggcagcattatccagcccttcttgtttttctccatcttccttctaatatacccaatatgcagagagattccaagaataatgcatcaatgatcatgtcgttttcatccctataatcatgcgatgatagaatacctaagggtaaactgtcacattgctacagcttgctttcttgctggttactgccgccattgattgtgcaagcgaaatccaactacaatattgcagaaaaaccacttttgatcacttccattccacacctggtggctggtgttaccatgagccattttccatctcagctgaagaagtacgatgcaaggtaggcttttagcattcttttagaaaagtagccatgatggctccaaccaccataaccaccattgcaaactacccagcttttctcttcctcccactcaaagcatcagtccagaaatatagaatcaatcatcatgcaacaactccacatgagcccattacttcatcccaacagtagggttcattgctcctatgatcttattgtaacatcctctacctctagctggtagttgctcctttctctacatcaacatagatggctgtgccaaggcgagttcatgtcgtcttgtttgtgtacatcacagtgatcctcactgcagtggccgtccatgcacagagggatacctgtggtgccgagctgaacactttccttcccgcgcctttcaattcatccgcgctcctctgcaaatcagtctggaacagcttcatactccgggtaacattccttatctagccaaagttatcatctgtaaaagaaaaatgaattcaaaaaagattgttgtagcttcctaacatagatattcctgacttattgtcaaatgttaatcacaatttttaccatcaaatgtagagaaaaaggcaagaatcagcaaagttctagtatgcttagttataataaaagtatcagtgcctcttaatggtacaaaggttgtctctctgcattgtgcatacatttgtatctgaatccataatcctaatcgatcatcatcacttttgctggaatgaccgaaggaggtcattcaatgtaattaagataggaagaaaaatgttacaagaaaagttttacatcgacagctggctgtcgaggaaggatgtgcaccagagcacacgccccgaaccatatgccaaccgcccaaacacacgctacagagagggaagccaagcaccgaaccggccatcgctatgcgagaccgatcgccaccgggccaacaacaccaccacgacacgaatactctaaaacgacgccttcacgagggttgcgacgccgaaagacgccgtcgtcatccgtccaaggaattggacaaggttttcacccagagctccttgccgagggaggatgggtacctcaacagtgccctcagaagggttaccacgcctgaaggcgaagtcactgttggcccaaagaaattgggctaagctttcgctcagaaccccctaccgccgtggtccgtcgcccaatccgaaaccaccatctaaacatcggcggcacatggcttccgccacacttgaccgacgcccctccgctggccagcttccagtcctgccaacaacaggactgccaccacacagcaccgacgccccaccatcgactgacttcaacgaacctccatccctgagaactggcccaggacccttccgatccaccacccgccagtctcctcgccaattctgcccaaaggagaaccctggactgggtggcattgcttcagcaacctgggcttcccccgttgacaagctgccgcctcaatctaacctagaaactccccacaaagaaggggaggagctccaagaagggcgagggtgccgaccggcaacgaggaagacgacccactgccgccagctccctttgcactaccatctaggcctgcgccgacgccggaaacgctgccgctccgtctccggcgccacctttgtccagcctccttgcctcacctagccacgcataggccaccacgggcgaagagggagctcacccgcattggtcagcgctggtgatagccaccccgcacacgcctgaccgtacgcgtgctgccggccgccgcagcgcctccaccacggtgctggcctccgcagccgccagcctccgccgtcgccggccagccacctccgcacgagctccgccgctgcacagcggaagccacctccgcgcgcctccgtcggccgccgtcgccgcgagctgccaccacctcccctcgccggccgcagccgacgcgctgcccgcctccactggcagccggacgcagagcaccgtcatcggccacatccgcgcccgggggggtcggatccgtctccggcgtgcccggatccgtcgcagccacctccatcgaccgccgcctccgtcgaccaccgccccgtcgacgctgctccgcctccaacgccgaggaagggctccccgaggatgttctccccgccgccgccttcccggccggccgcgcggtttccggcggctggctccggcggcggcgaggcggctagaggccggcgaggtggcggcgcgggcggctagggttttctcccccgagccgcccgcgtgagggcgacgtgagggtcaccatcgatcatcatcacacaactttagtaccatatatgtgctgaatgaaagcaggatagaaataaattggcatttttgttatcaacatagctattgttaggttccttgaatactgaaagttcatactttgatcttcagataatggtgagtaatttcttctgaatgctcttcaattacaaaataaaaaattaagttactctgatactcaaatttttacatggttacttttttctttgttgtgcattgtgaacccctgttagtaacttataaccattgaaatatcttatacaaatggtagtcagtgagcaagtcagtcaaaaaataatctccatatatgttccagcaaatacttgggctgcccaagtccgttagttcttgtcccttgcacatgttcacactagtccaagatgtgaatccgatcttgtactttggttttctcttccctcgtttcacagactagtaccacggccaccaagaaaatagtggaaagcagaactattgatctttaaattgtgcaaacttactctgcagaagatatctgcgggagaattaaaattgaacactttgaaagtataatatatagccacaggtaatgaattgaaaattctgaaagcattttctaagaaacaaatttagagagaaagatattgtactagacaggaatatccaaaaatgttcagatattgaacatttcattctcaangagagtatctgactgtcattactgaaaaacatattacgaaacatgcacatgtttctaggaaaaaaatactggccatgtaaaatttgatattattcttctttcaacatcaatatttgtttattttaaacaaatactgtaaagtgctatgttccgctttcttcataataaaaagtcgccaaatctattcttagttcatgtggtctctgcacatcttgcagtattcaaaattgaagagtgaagataacatcaccagcattgtactttcagcaccctattcatctggatgggttgggattggtttctcaaatgacggaaagatggttgggtcaagtgctatggttggctggattgataatcaagggagagcatacatcaagcaatactacttaagtaatcagactagctcaggagttaaagtagatgaaggcaagttgctcacaacagacgttccttctgcagctgtgctctatggagacaatatttacttagtatttcaagtcaaattccctcttcacattgctcgacagtccgtaattttggctttttcgaagatatcaccaaataagttccacctcgcagaacatgatgacaaaacgactctgtcttttgacttctcatcaggtacagttatgttctagcacaactgaattggttttccattggagttttgtttttatgcttcattggtaacagactaatggtacatgctatgttggagtattgaacgcagcccaagaatcaactaccctgtacctaattccactccactggagattgatgatatctagtatgccaatataaat

SEQ ID NO: 64714 - DNA, 3954 bp, Oryza sativa
gaaggagaggtaagtaaaaatattgagataagggcagagtagtcgagtacctctcgttgtctcctccgctccttgcctccttgcgccgccgccaagacgagtcgcggctgaacaggggagggccgggcggcgatctccatcgcagcggaggggaggggatcctggtgcgtcctctttctgattcctctctctctctctctctcccaccccaccgggactggaatttgcttgcgcttctcttctagatcttctcctcctccttaatttgatagccttaaacctctcttaaataattcaaggaataacagtttgtttgttcacccaaaagtttgggggttcaactgaacccccatgtcccaagttggatccgcccctgatttttgggaagcctttgcaattggaacacagaagggggttctgtcccaaaaccaacttctggccagtttgatcaagcaataccacatcgaggcagtacccttcagaaagaattagcttgtaacccttatctgcccaccattgtgccgtcagtggggcaccatgactgttcacccggcctatctgacaattctatgtctaaggaagatgctatgtcaactggtgattcaacggaaagccttgatattgattgccttgatgatggggactccgaagtggtatcttccttgcaacatttggcagatgataagcttcatatttctgacaacagggatgttgcaggtttgttttcttgccggaattggcaattctgttttggccatttgtgcatcctatgaaagaattggtgattagcggtttgtttacaggtgtggcatccaaatggacgaagcatggttgtaattcagtagaaattgattatatcgtcgacattgacaacaaccatgaggatccacagctgtgtgcaactcttgcttttgacatttacaagcacttgcgagtggctgaggtgatagattcttttacatgccatattccgtcacctgtatagagtgatgcattgcgtcatccttgtctgctttccgatttagcttcttgcttagcatattcttattgtaaaatataatgctacgtagcatcactgacttggttattccctgtttgttttgctcacaaaagaatctgatattatgtttgttgctgttgtgctgtgatgctgcattttagcagaccaagaaaaggccttcaacagattttgtggaaaccattcagaagaacattgacacaagcatgagggcagtgttaatagactggcttgtggaagtaagctactctatttcaggataaaaacagggttcagaagctagaggcacagcaaatgatccatttaatttctattacattcatgactcgtaccaattcaggtcacagaagaatatcggcttgtacctgaaaccttatacctcacagtcaattacattgaccggtatctctcgagcaaggtgatcaatcggcggaaaatgcaattacttggtgtcgcttgcctgcttatagcttcgtaagatcccatttgcttctgtttatgttctcttgtttttcttttatcttcttttttatgttttattctgattcagtttatatatggtcaaatttcagtaagtatgaagagatatgcccaccccaagtagaagagctctgctatatttctgacaatacatacactaaggatgaggtctgtgtcccagtatagattgggctttgttctttttatttccttgtctcttattctcatcttctaacgaacaggttttgaaaatggaagcttctgtcctgaaatacttgaagtttgagatgactgcacctacaacaaaatgctttttgaggtagtattttctgttacaacaatgattattatcatgcctatagttactaataccaaatattgttcatggttccacaataggagatttctacgagctgctcaagtatgccatgaggtacttgttttcttcaatagcttacagactctgccactcctgcattctcatgtagcttactcaatcaacctttccttctgcaggctccagttttgcatcttgagttcctagctaattacattgcggagctatcacttctggagtacagcttaatttgctatgtaccgtcacttatagctgcgtcttctattttcttggcgaagtttatccttaagccaacagagaatccttgggtataatgctttaaactttgcagattttattgctattctgcaaactagactaaatgtattgatttctttctctcttaaattggaaacagaattcaacactttcattctacacacaatacaaaccatccgacctatgcaattgtgcaaaaggactacaccggcttttcttggttggccctggaggcaaccttcgagcagttagagaaaaatacagtcaacacaaggtgagtgaagtcaaaataaggccattgttgctggaacgcatttacttctatttggtaataaattgtttctatcacctatctatttgttctcagtacaaattcgtagcaaagaagtactctccaccatcaattccagcagagtttttcgaagatccaagcagctacaagcctgattaactccagttactccctgaagtcttgcagtagccccgaatggtaggctgatttgtacagattgctcatgcgcaaggcaagcacacgccacgcgcccttgtgttagcagattggtagattgtacattgtagatgaagtggtagagctgtacatcaagttggcctcatttgtgtatgcacggcaagtgcatttctctggcggcggcttgcttacaaccacagtgcataaagctgctagtcctttcctactctatccattttgcttgctccaagcttgtttgatatgattttaccgtgttactgtaaacaaaatggatatgctggataagagataaatgcctgagggcaagtgaagtatgaatatatttgtccttctcagtgggatgaacttgactgtagctattcctttgacctgaacaacctttgtttccatgtggtagaataattgtttggatctttttttttttaattttagttttcatttttgtacgactatatggatccatgttaactcgttaggatgttgcatcccgtttaacacttaaaaacatactatggtttagaaggttgagacttgagaggagtgacgtcctcgataacatatattcggaaacctaccgagaacgggaacgggacatttactcttggggttaaatccaaatacacgtataagtcactactctttctactcttccctctacaattctattattgttcaaaacactccacgtaagttaatttctctttcagtttcccatccctatttagttttcacgatttctactaatacactctatttcttgttatcgtgggccttaatggtgacttgcaggcacaattgcctcgtgccaacttgatggcaaaagcacacggatcttcttccactttccaatttgaaaagtggcgattgcggaatttaagcttgcgaaagatggaaaatgaaaggaggtgtgcacgcttttgccaccaagatggtacgaggcaacttaccccgtgggatgtgttgaaggcccacgataacgagaaattgagggcatcacgaaaaatcgtgaaaattgaatagtggtgggaaatcctttgaacaatattgagttgtagggaggagagtagaaagcagaaaaagtaatgaattgtaggcgggtatttggattttcccctaactcttgttatacgattcttgttcccagtgatgaaacaaagcgttggatatctcgttgatttgcacgagcctcccactttcgcagccgcatggaaggaaggaaggaggcacccctctctcctagtcctatagctgtgagtgcccctctctctttctctctctctctttctccaagtgacttatctccaatattttttggagcgtttctcgtaccatatgcatatattctgcgag

SEQ ID NO: 64715 - DNA, 1647 bp, Oryza sativa
aatcaattgtgttaacatctctatttttaagaattgggatgatgagttggcatttggagtccaccgttacatgtgccttccttgggcaacttagtgcacatcatgacctccagaaatgtggtactgattatcataacagatattatagctccataaatcactttccatgagatgttggtgtcacttaactcaataccaagaacaatgttaatggctgccaagaaaatacaaatcctacctaaccaatggtggtactggttccaacatttccgcacctgagaatccttattaggatgaaggaaaaatgcaataacctgtaacatgtagtacatccaatggcttcagacataacagaaatgaatcaaatgataggcattagcagtcaggatggcaaaattagttgcatgatcatactaacctgaagagaaccgagagcaagaactgaaatgccaaggcttctatgcgtagtaaaatttgaataggtcctgttgtacaatgcaatgccagaaacaacacccgcaaacccaatgatgtaaccaagaaattgcacgaggacatgaaggtaataccaaagtgggtccttatgtctgagataacgagcagcaattgctcccagtggtaccagaacaccccagccaaaaattgcaaatgcaccatggttcctcttcaattggtatggataataagtactaacagaatcacctgcgtagaaaaaagttaggttcaggtagtattgaaaaaacattttctaaaagaaaatttacattgcagtaaaaaatgatgtgaaaaacagataaggcttgcacttgtactatcttttatgttgaacttttgctgatgtatggtgctaatattttattacttctacaaaatcagttgaatgtagaaagtgttttttaaatgtttatgttatgatgtggtatcaccatatagttgatctggtaaacattcttcttttacgagttctaacaaacattggctgaaccttattatttaatgagattgtctttgtgacaatcaggtaactgattcagctagatcgatcgatttttttcactgtatgcattgcataatgtattagctgggatgttttttcatgttatccaatacaaatgtcaacaatttttagagacttggttttatatccaataatcaccctcttctcaactgctcaatacataccctattcctttgctgtctgctatcaaacaccccaggaatttagccatttatgtgaaggccccatttattgcatgtaaaaattactccactcctgtagaacaacggtttcctgtgatggagttcaaattcctgcattccagatggagttcaagttcctgcaaatttcttgtgacattccaagtggggctaaaattgtctctgctaatttttctacttctatttttctggcgttatcttcaggtatcactgatcagattctgttcagcggtctcaaaagtctaatgcatattccccttaatacaaagatgcgctccctgtgtattcccaaaaaaaaagtctaatgcatccttctgagatcagaatttaaatcgtatttacatatgtaggtaatattcagaaatgcaaatgcccggtttttggttaacttttctaatattttctgttttggggggcgccagatacaca

SEQ ID NO: 64716 - DNA, 875 bp, Oryza sativa
aaagcaaagaaaaaagtagtctaagggagcgttcggcaggagaagattgtgagtgagcttgtctcgtttccggcgctcgcgtttcatgaactactaaacggtgtattttttacaaaaagtttctatacgaaagttactttaaagaatcatattaatccatttttaaaatttaaaataattaatacttaattaatcatgctctaatagctcatctcgttgtgcgtatcttcccaatcttcttaatctcctcctactcaaactcagcctaagttaactcagttactctgtccgagggatggtggaaaagtattaattcagatgctcttttagctctgttcgaggatggtagaaggtacatctttacttgttctgtgaattgaggggataaactaagagttgcttgttctgacaaattgaatactgaattgaggggataaactaccttagagctcctgttacataagaacataagaatagtcagatccccctctcacccatcgggtatcagcttaatacagggttattatgtgcatatttgaaacgacgcgcacttaattaaatcctaaatagaaatcattaatattaattcatggcacatggttcaattagttggaaaacaatgacttcatgattaagtttcataaagctagaatggaaaatgggtcaatcggcactagataatttcgatttcaactacagatactcaggctcggcaaatggtaggcagttattaacctcaaaaaattaaaaaactatagaaactcaggcaagtctctctttgatcatattgatagatgatgatccttctattcttattaaggccacatatcctatgcacacaggccatcacgtgtacacacgtgcgcaccaactaa

SEQ ID NO: 64717 - DNA, 1330 bp, Oryza sativa
acatgtctcaaggacaacatagatagaaaaattgatctgctaatgattaattgttatgcatatgtcagtgtatgttcatgggaataaaatgtctgcctattcttatttttctgcagagaaataattgtactatgtgcttgtgcactgataatatgagtgtgcttgaaatctgttgttaattcatgggcttgaacttctaaacagaattatccacaccacagacacatggttattttactatggcagtaattacacctaggaactatgcatgttaatttgatgagtcgctcttcttcattgtagggtgaattggtcacagtgtatgctaacaattggagcaagataacttgcggtgagtttaatacttttgaaagttgttttatttgctcgcagtttccgtttgatacccgataaagcaaatcttggttttcgcttcccttgcgattggcttgggcgagggggaacatatcaagtatccgcctgggatcatgttttcttatgtctattctggatgtacaattccatttcggtagtcattttccatttcagttggaaaatgcaatcggatgtttggggtactataagtgatcaaggggtggtaactcatatcacagggggaaactttgcacagagttccactacgattaatgggtggctccgagatttcttgtgggcacaagcatcccaagtaattcagtcttatggttcttcattatccgcatatggtctttttttcttaggtgctcattttgtctgggccttcagtttaatgtttttattcagcggcatgcgttgctggcttgctgccatttttggaccattaattgaatggattattatattggcagtccctgcttcaattttgtttatcaacatatgggaattgttatactttcagtagcacatttttaaaattttattaaacaatggttgtattttaatacaaagtagacaaaggcatcctatggtaaaagggcaagttcaccttcacaggttgaatctttatgattttgtatgtttcactgattaacctttgacattatttaattgaaattttaccatagtggaaatataattttttggggcatatttaccttctttgtgttaactttcttgatgtaaggcctgtcatgttgtagcaaaaagaacatttcaatatagaaaacatctggattctttttgcattgctcattttactttcaggactttatttgaaaaaacataaatgcttgtattattgtttcaaccacagtgtgtggaaaaatacatgtttgcttacagcagtaaccttattgacactgaattggagatgttacatgttaacctttga

SEQ ID NO: 64718 - DNA, 826 bp, Oryza sativa
cattaaatgggtaggacattttagttttgtcgcgaagtacttttccataacttgattcagtgagctgcggaggcaagcaattgcagatattggagattaaagtggcattaccactgactttcatattaataaatgcagggtcattcgttcatgcattttcatagcgtgttaaatgcatcacaacaccgagcccaaattggaaagagatcatggccatcctatcaagaagttcttgcaggaccttggccaggtccccaaagtacctatttttaccaccttgcaatgcaaattttctccaaatggtcagttttttctatgcaaactgtgcaaatttgtggtgttctctattttgtcacagcctgacagcaagctggtgagtttgccggacgaccgggcagacatggaaatcagcttcaagccactccaagtcaagcttgtcagagttcagtgctattttctcaactagattactgctttcattaatattttaagcacgtttgcattcctatatgcatggttggaaaagtaatgttgtaatttgacatttgaactttactggtatggtcaacagaatcctggtaaatcttcagtgttggatagtgtggtggggatggatttcttactaagtgattcaggtatgtttcagaaagtagttactgttgagttttgtgataccttccagtcttatgtatttttaaaagctatgtttggattggaggatgctacctcaggcatagattatcttaaaaaaaaattatagggatcctcagccattcatcataggtggtgcgacatgcagcaagagatttatagattttttgtaagt

SEQ ID NO: 64719 - DNA, 720 bp, Oryza sativa
ttcccctatcgcacgtactaccataattgcgaaccagttctttatcgcagtgatttgattttcgtctcctgtctatacaagtacacatgtttttttttcgatgggacagacagggagctcctgcaattcactatagaagaagagagttgatccagttataagggaaaccggcccaaaaaccttacaacagcacggttaattaaaggaaaaccggcaaaaccccgacattgacaaactgaacctaagtacagttgtccaacaagagataaactcctaaaacgaagccttcaggaaggtcacgccgacagaacgacgtcatcgtccgatcctaacgaatctaggttttcacccagagaaaactcttgaagtggagttgaacgagggctccagtagcaaacgccttcaagaaagtgaacggcgcccaagggcgtcgccgttgctagcaccgagagcggagcaagactttcgccttggagcacccatcaactatagcatccacgacgggagctaccaaatgtcacctacacaccgagggtacctgcaatatgcacatcacctgcacgacggccggacgccaaaccaccccgtccccactcgaggacacgccggatctgggcaagggagccagatccggccgtccccctcaccaccaacgccggccgacgcctagaggggcgccggaggacgccagtggccgccgcggggtgcctgcgtgctcac

SEQ ID NO: 64720 - DNA, 746 bp, Oryza sativa
ttcctgcagccctgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcagaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttgcagaattcctaacctcttctccctcttttcaaaccatctttttattataagaaaaaatactttaaaaattatatt

SEQ ID NO: 64721 - DNA, 1475 bp, Oryza sativa
gaggctaggcatggtcagtgattttgcttcagcttatatttgttgtctaactaatttccatttgttttttatggatatatacctttactaagtgggtaataaatgctttctttcgtttttaatggatatatacctttagtaagtgggtaataaatgctttctttccaggctcgtttgttcttccactgtccaaaatttggtatcctagacgagtgcaccaagtatgtagcgtatagttttttaatgttctcatttccattttttaccaataaatgcacagctcttataaagcatactcattgcagtgccacaagtgtcgatgttgaggagcatttgtacaagatagcaactagtatgggcataactgtcatcacctcgtcacaagtaagtatcatctagatacccacttatcctaactcttcaaatggtgaataaaaaaaaaacatggttttcatttctatccattttgtttctagttgatggtattttgcatcttaagcttacatctttgtcagaagtgaaatttgggttgatgatgcctttctctcatttattcatttgcagaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaactttaacttgtccgattccagcatctggtacatatctagggcctgtttgggggagttttagattttagattataagaagcagctgtttggtagccaacttctgagaatctggaaaagctctgaaacccagcttctggctttttagttcatttttttcagaatctgtaattacagattctctgaagctgtggactgtttagggcagcttctagcagaagcagtttttgagaaaagctgtagctgggataagctcccccaaacagggcctgagccatacacgaaatggaacaggaatataaatttgaaaattgctatccatccttcgcccgatctttctgataatcgtcggttgattttgtgagaattggacgcaacgtagtgattcgtatgcgct

SEQ ID NO: 64722 - DNA, 1617 bp, Oryza sativa
tataatatttgatgtgacatgccaaaactttatatccttggataaacaccccccaactattccatcgtttttatgagtactatttctctaaatactaaatggtttgtgagctctgtttctcaaactaacgttttgtacaaaagatatttataaggaggtttattaaaaaaaccacataaatttattttttttaagtttatagcaatcaatataagtcctccctccgtcccataaaaaatccaatcctggagagaccatctgttactactatctccgtcccagaatataagaagtttagagttagatacggtattaaaatatgtaaaattaaatgaggaaagattgtgatttgttaagaaatagaggtcgatagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccctgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggctgcagga

SEQ ID NO: 64723 - DNA, 1705 bp, Oryza sativa
ccatcgaggtgctcatcgaatgtgtccgcaatccattgttcctccaagacgaagtcgagcgacaggtggtggactcatggatagactagccttcaagatacagcttattactagctatttgcagcgcactgattatggttgtttggtttatcaggtggcctctgccagaaagaagttcaggagctacagaagaaccctgagagatttcttcaggaatcacttaatctagttggatacacaggtgctcttgcaaatccactagtagcccctgaggagagtctcacacgaatcaatggcagtattattcaaaagttctatcacgtaattctcttgcttctgtatcacatttgacttataaattactcataaatgcgactcaattcatgctgttcgtagtttccaaacgatgctaaaatgcaagtgtagctctatctctatagctcagtgcctcagttaacaaatttatgaaaaaaaaatctattactgaacaggagaacttcactgctgatcgcttggttgtagcagcatcaggtgttgatcatcaataccttttagatgttgcagagcctttattgtctgattggcacaagggctccccagtggaaaggccagagtctaagtatatcggtggggattttagacatagagcagactcagaggtaatatacttcccatcaacactactttgcctattcttttggggtttccttttgctctaaaattgaaaccctgctcattcctctccctgcagatgacccatgttgctttggctttcgaagtgcccgggggctggcttgaagagagagatgccacaattatgactgtagtacaggtatacttaatgagtgggtatttactaaaaacaatctggcctatgttgacatctgcatcccaactgcactttctaacatatatccatgaatatgccaaaatattttgtagactttaatgggcggtggtggttcattctcttctggtggtcctggaaaagggatgcattcacggctttgtaagtaattatctctcgacaaccatttgactttagtaggattgcaaattgctacaatatggaataatgaatatagattagattgtgcttttaatagccgttgttgtgtaattgctgcttttattttgccgttttagttatttcagttcctaaagttttttttttaaaaaaaaggctataagttgaactgttatttctttgcagatctgaatcattctcttgacaaccatttgatagtaggattgcaaactgctacaatatggaataatgaatatatatttgattgtgtttttaatagccatttttgtgttagtgctgcttgtttagtaccctagtttttttggccgttttagttatttcagttttttaagtttttttttgaaaggctataagttgaactgttatttctttgcagatctgcgtgtcttaactaaataccacacggtcgaatcattttcggtatttagcaatgcatttgatagaagtggcctctttggtatttacttgaccacggtaagctcatctttatacattattctgtgcctcgaattaaatagtgaattatatgaaacatgttgcagcttctaccttgagttgttacttcgtcattttatcaaattgtgtgagtaggacttcaaaagggactactagctggcaaagtctgctttttcaaaattttgaagtgccattgcttca

SEQ ID NO: 64724 - DNA, 5532 bp, Oryza sativa
ccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggtgcctttggctttcttcttcttcttggtgtgatcgattaccaggccaccaaattttccatctcgggcaatttcctgatttttgcccttcaactcaagctctggattgttgccttcaccggagaacaccaagtctgcaaatggcatttctgtgtcatcaattccgtcggcgttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggcctccatgggctttgagttaaatatgcgtaggttgggaactaattcttaacctgagaaaacatccagagttactccagaattgcatacatacagaaaggcagaaaataaacggtattaccttcttggctagaccgtctttctcagcaataggatttccctgcaagtttaggttcctcaagtagtgcaattcagaaaggacctaacccaaaaaaaaagaaaaagaatagaaaaaagatagactgagacagtgtaaagatattatgaatgtagaagggtgggagaaaattaatcagatgcaaacctccaaatctgatctcctctcaattaagttgtttcctaaatcaaggttcaaaattttgacattttttgccaggtctgatggaattgtctgtgaatcagacagagttcagcaagatgttacagagtgaccaagtggaatgtaacatgctttcgagcagaaaaaaaaaacaatgtgcaaaagagacccagacatatgctatccataagtccatatacatacagtgatcttgttgtgagcaagtctaagttccttcagttccacacacgcagtgagagaagaaccaattttttctatctggcagtgagataaggatagctgaggaaggtaatgacaaaacattagtcatgtaaaacaggaaaaagtgcatattaaagctgataggtcttttttttttgcaaaactaaataatacaaacctttttcatggcctttgccttcatcaaagcatcaccaatagtgaaaataggattcttggaaagaactgcagcagaaaaacattcagaagtaaattaggtggagggaacatcattattctttgcctgttccaaactggactgtaaaacaactcttttgttgggtgatgggtttgtactacaatatgaaaactgaatatggatgatttataagaaaactggtattttacatgcagaaagaaattgcaatgggcaaggatcttaatgttaaggttcccaaacttactatacttacaaaaactattaacatccttttggtttatcaaaattatcggcacaaatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaagacctttaaggctcacaagcttgttttcaataaccgctagccacttcaaattgcgcacagtttgatagacccttcagcattcaaaaccacaatgtgagtggaaaaaaaaaagatactctgatgaacacagccacagcgatgatttattggaacgattagccatcagttctctacttcaatgaactgagagaattattcagaccgagtgggacatctaattggtgcattatatgactttctgaaaggttattacgggattcatccttttaactattcaatgtttcacatggatttacccagtgcctatgcttgtagagaacacagtaacaccgacatcgcatatatccatacaggtgaaattcaccaagaatctacaccgatgctaaatttgttgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggtggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaatcactgtagaagagtatgcgtgctacaaataatacttctcagtcagtgaacatagcgtgtagcattgtgaagtcaccatagaccacatgactgacatgctcttgatgtttaatcaggctgtaggttctaagctcattatttttctgtattttgatggtacaggcgtgtgctatgtactataattggtggcttatgttaggaggtgaagtgttagttagttatcatcaatcagtgtagtagagtcatccttgacgttctttctgacatttgccatccttctgcaggtattatgttgtccgtgagccgaagcccttcgtattcttcggtggtggatctacccagctgttgattagcacacactgctgtagagaatggttggatgagttgttttcgtaacagaaacatcgccccacatactgtagtaattc

SEQ ID NO: 64725 - DNA, 1567 bp, Oryza sativa
aaagatccaaacggtacgcatcttcttcacataatatgcatccaaacaaattgtagaataaactgagacattgcgtgcctatattatctcaaaattaacagggccaatgtactacaatggcatcaaccatgagttctaccagtataacccgaacggatcagtctggggtaacatagtttgggccactcggtctcgacagatctcatcgactggatccgtcttgaacctgcaatagaaggaaatactccgagcgacataaacggttgttggtctggttcagcaacaatcctcactggtgatcaaccggttatcatatataccggtgccgacacggagaagcgtcaggttcaaaacattgtgctaccaaagaaccggtctgatccttacctgagggaatggaccaagccaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcaccatgtattcttctaatgcatccaacatgtgggagtgcccggatttctttgcagtattgcctggcaagaacaatggactggacctctctgcagctatcccaaatggctgccagcagtgttctgcactatgcagctgtggattgcctagtgaacaacgtcacactgattagtggtttatgatctgcaacatgacaggtttgtgccggatgctggcttggatgacatacgattgtggcatgaggattgattatggcagtcactatgctatcatgcacattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaaggtgaaaaggacactacaatactacatggctaatcttatcgatttaggggccgattaagatactatgtaaacatatatctaaaaaggttgctataaacatacacctattcaatcaaaaataaaaaataaaaaatagaataggatataatgatagtagaaaatgatgaaaaagccgagcactgatttaagggttagaaacatataaaattcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcc

SEQ ID NO: 64726 - DNA, 1975 bp, Oryza sativa
agagcttccgcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaaatccagaatcaaaattttagctgctcacagacttgttgatgacatctacttgctttgtagcaatatgtttttacttgtagaaaggagatggaaatcaaatcattgttaagaaatggttcgcaattggtaacgagatactactcttcgtgttttacagtcgaactgtaaaattcgttgtccgtcagttaattatcctgctccaactctcatccaaaatcattccgtttccacattgaatttattacttacccaaatgatgttttttactgagagaattcatttcagcatgaagcctatggatcatggtttcatgcttgatgaactgatgaaaaaaagtactgacttatcggtgatgttattgttggtggaggggttcggggaaaaaaaatctccgaacccaaaagaggcattgggccgtagtcgtaggacagattcgatggcctttcagctgctcctcagcctacagtgtattcttcttggcaaaagaactctgcccaatcagcgaattaatttggcaagcgaaggcaccggcaagaatacgtttcttcatgtggctggctgtaaaaggacgctgtctgacagctgataatcttgaaaaaaggggatggcctcacgctgattgctgtactttgtgccaacaagaacctgaaaactgcttacatctgtttatcaactgcgactataccatcacagtgtggagactgatgcggcaatggatcagcgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgagatttgcagatcttagttttttagttttttagtgttgacgttccagttctttagtttgccgggctgtggttcctgccacagtctaattcgacagcctcctgtcgttgcaagcgaaaactacttgtactttgattttattcctcccaatcttaatgaaatttggtcgccggttccttcggccgacccggcagattcgatggcctaagtgggctggcccaattgctgttgcatatacggcccaaacgactctttggggttcggagatttatttcccgacccctatgtttcctgttttttgaatcaccgtgtgatgtttttctgagctgaatgttgttgtcgagagctgttcttggacggattgcgaaagaagatgtactacatctgaatgaaatggaaggtgtgctaagtttttgaattgatggactatgtagattgatacgacgttgctttgacgatatcatcgcatcattgttcacaactggttcacaatcggtaacaagatactcgacttgtttgatctgcagattcgctgtccgtaagttaattatcctgttccaactttagcttctcccagacctattgatgacatctactagccttgtagcaacatgtgtacttgtcaaacttaagaccgttctctcccccgagtcggttctccccaggggcggctcgtagaggcgaccctgccgcccctcttccccctaccccaccccccgaagccgcgc

SEQ ID NO: 64727 - DNA, 1593 bp, Oryza sativa
gcagacgtccatattgcgcatatactcactcttataaatacacaccgtacctctataatcacctttaaaaagttgggttggcgcatcttagaattgatgaagtcatcacgaacacattgttgttgagggtaggtagtccatcactaaaaaaataattagccgtaaatgcgagtattcatatcaaatctaagttttgaactcggatgaggtggttcaccgtaagatgaaagatgtttttcatattgttgtaatgcgatgcagtttatatagccgcacgtaaaaggttgactaaattttgcattggttaagtacatagttccatatggcgttgtttttaccctaacatcacaacattgttccccagtttctagtagttaaataaaggtaaatgaattgaggaaaacaatgtaaataagatgaggtaaaaaaaatcgtaaatatcacatgttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatgtatttcttaattgctttttgctttttattatatctatcggattttaatctaaagattaaaaatctgtgtgatacgattataaaaatctttcgaaagatgtataggtactcccaaaaaaaaaataaaaattcaactgagggcccatccgggttcgaaccggagaaaaaaaaataaaaattcatccgagggcccatccgggttcgaaccggagacctattgatctgcagtcaattgctctaccactgagctatggacccttgatgtttccaaaccaaacagtttattacttgatttccatatttagcaattagccgattcttaatgataaaaaataattaaaatctaaatgaaaatcacatatttcctatagcagaataatgcgtgacacattttatgagaaatatttttatttatcttatacaatattatagtatatttttttagcaattagcaaacacatgcatttagctagccatctaaaatgcacatactccctccgggttaataatatttgttgttttggacaagagtatagtctccaaaaaataactttgaccattattttctgttataatatgtataaaagtattacaaatatatgattttattaaaatactttttaagactattctatacatgtaatcaccatatttgaaagataatgattttaacaatgattcataatcaaagattctaaagtttgatctcatccttatctaaaatgacaagtattatcagcccggagggagtagtacttttagtcaaaatatt

SEQ ID NO: 64728 - DNA, 1014 bp, Oryza sativa
caggatcagctccttccacatgtgcctgtagctactggccctattcggcgcggccacgcagtcccgtgtaggtcggccgggatggcctccgcctccttgatttccgggaggcggttgtcggcctctcccccgtgtccaaggtctcgccgaggacgaccttggcgtcggcgaggcggccgttcatggcgagccccctcggcgactctggcatgtcgagcgccatgagcgcgaggtcgccgtacggcccgcgcagacgccgagcataggcgccacccgatctgcaggcggaggcgcgagaaggcgtagttggagacgtagccgaggaggatgccgaagttgatgaacacctccgggaaggaggtgaggaatccgcgtgaccacgccggcgagacctcggcggtgtagacgggcgcgatcatgaaggagtagccgacgccgatgccggcgacgaagcggccggccatgagcatggggtagttgacggagaggcccatcatgatggcgccgacgaagaagatgaccgcggcgagtatgatgtgaggcggcgaccgatccagtaggaggtccggctggcggcgaaggagccgacgagggagtataggttgagcatccgagcaggatctccacctcgacgtccgtgatcttcatgtcctccttgatgaacagtgacgccccgcatatgtaattaatgagactgcatatgcaacatgaggctctctggagactggagagagcgtgtatatataggcagtactggtggctgtgtgtgtgatcaacggtcagagtaatcaattgatgacagtatgacatttggagcgtgtatatataagccatactggtgtgtgatcgacggtcaaaataatcagttgatgacagtatgacatttgcccatcgcaacttgtttacttgtaaaggtgtggaacttggaaggcctccgtgccgagcccagctggctcgtcatccaccctatttggaaggccgccgtatcaactttgatcctgctaccatcaccat

SEQ ID NO: 64729 - DNA, 1872 bp, Oryza sativa
gagaatgatcgaagaatggaggtcttctttcttttgtgggtttggtggtatgcacgcaacaaggtgaactcgggggaggacgtaatcagagtggaagaagtggtccacaaggtgaaacagctgatctgtgatcatgcctctctgcgcaaaggaaaacatcccaaggtgaatgtgcaaagaaataagtgggttccccctgtagatggtaatctgaagctcaactttgatggagccttccgagctgtaaacaagtctggtggttatgatttcctggttcgtgaccaccgtggatgtgctgttcttgcgggtgccggctgcctggaacatgtacatgatgcttttgcagctgaagctgaagctggtttagcaggcctaaaatctgctatttcgcatggtattaactctgtccaggtggaaactgattcaccatcctagtgagagcctttcactctcatgagtacgctctctctccttgcagttctatcgtaagggagatcaaggatctcgtccatttaaatttttctagtgttgtgtttaattatgccccgtgatcatgtaatgtggctgcgcataagttagctcaaatgggtgtgtgctgggaattgggtcaagcaagtgtgtgggctgacctgtccctgacattgtacaaactattgtggatcgtggtatcactgatcctagtatttaataaagcgcgccggtttaactcaaaaaaaaaaagatcgcgctcgctcctcatctctcagatcgcgcctcgcgctccaccgatgcatctccgacgattgtcgcctcaaccggcatcacccgccgccgccgatcgggtatcccgccctcgtacaggtagagcacatcgcgctcagacttcctccgagcacactaacacatgagacgtagattgcatagtgcgacaacaacagcgtctgctgtaataaccgatccggtaatctccgcggtcctccgccgtggagtatcgacaggctcagcatcgccgatcccgtcgtccgctgtaagcttgcatgtcgcatgaccatcccgcggggctgaatcgcccgcgaggtcctccccgccgccatcggacgtgcgcggactcccacgaccaccacggtgtgagatgacgccgctggcggcgattgtgttggccggtttctaggagctctttgattcagtccgccgctctccatcttttcccgtcccaggggcagcactgcagtattcctcgacgagcaggttctgcttcgagcgtagagcttccggtgggggttcaggggtggattagcatgtgccttcatgagtcgggatgtcagacggtaggaatggagcaggaggagaggagaacctgctgatccagtggagagatagcaatctcatcgggaacagcgtgctgagcaggtatacctagcatggacctcgattcctacaaggggcttcaagtttcgagcaataggcaattctgattggatcggtcttctgctttccttttggtgcaggctttgatcagaaccagcaatgccacagaggagaagacccaagtgagtacgtttggtcagtttcttgtttgtctttattttcctcaccaactgcgcaactgtaaatcttaatgctcttaattatttgatcccactcttaagtgtttttcatcggaaacttttgattagtgacacataagggagcttaaggatgaagtgaagctactcaagaacctctcacattccaaaatgctgtgagtacatactagataactacatatggtttgtttttcaattcgatgatggtgtttgatttatctggtatgctttgaacaatgatatattggaacagtatgggaggagaactcactaaatattctggtggagtttatgctaggaagatcaa

SEQ ID NO: 64730 - DNA, 1820 bp, Oryza sativa
  unsure (1)..(1820): unsure at all n locations
tcctgcaccccgatccgatataaggagtcaaattgaacttttttttttatcctttttccgccgaggcgaaccatcccgatttgcgatccgatttctcctttcaatcgagggttgcccgccacgtagcagtgcggatctctctcccttatcggttcgcccttccttttccgctctctttcaccgccccgccgcgtccatcgtgagaagacctaaccctagtcatccaccaactcgatcggagaggagatcggagaggagaggaggtgcggtgatcccgacttcactcggtccaggccttaaatccaaggcaatcgagagaagagatccgcggatgaaggaataaggaaaccgatctcgatttggttcgtcatggacttggagtgggttgcggaaaggggaggggaggggggcctcctcgtttaagaggaagaggaagaggaggacgaggacgaggagtaagttacttgctgccgccgagtcaaggccgagccgaagacggcgaggaggttttgtttggagcttttccgtggcgggaggggagggattcccgacgcaaccgtcaaaaatcttccacccaacactctccaaaggatccaacgggctcgagtggagagattctgcaggacgagcaccgcatagaggagaaggcggagatggcttctagtggagagaagctgcagaagcaccggccagaggagatagctcttagaacgggctcgagtggtcagacaacgcagaagctccgagagaaggcagccactgagaatcaccgtccaaaggagattggcccaagtggagagaagccgccgcataagctcctccgggcaaaggggaaggcgggcacgagctcaattggagtaacgctacagaagcaccgggcagagaaggcggactcaagtcgagggataccgcacaagctccaggcaccggccggcacaagctctattggagtaatgccacagaagtaccaggcaaagcagcagatgggtacctctcggcttggacgccatccaccatgtatccaagtccaaggaggagtaagcaacagagaggcacaagcggccactaccaaccggcagaagcacaccaaaagtaacaattcattatcgacgagggccactacaaagctcagatcagcaacaaacaccccatgtcaaaagcccaccactgccccttcctccaatggcaacactgctcctcccaaggatcgtaaagaacctgctacaaacgctgagaataatgctgttcctgtcgcagagaacaatgatttgcaagaagcggatgaggcaatcaaaaggctgaatgaattgggcttgggagagaatatcagctctgaggagttccttacatacattgaccagctgaatgaacaacctaaaatcgatacttccattgaactggacgatgcacaggtcactaccctctattttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 64731 - DNA, 1464 bp, Oryza sativa
cggtcagtacgaacagactgcagtagtcaggaggtcagggaactagttgtgttttctataaaaatatagagctaaaggtaaacactactacatacattattaaattggaggacaatcaataacttttttattaacgttagatagtcggcataattaaagatgtactataaatgtgtataaatataagctaaggctatattctatctgatgataaaaacgatgaacaataagataaataatatttatattccgttctcaaagaaacaaatggttaaatattatgaaaaaataaacagcgttatacatcttgaaatacagggagtacttgctgcccccaaataacttcgtttttagtcttatacgtgcaaaacaagaaagattaatgtgctgttaaaaaaacaggagtagtattaacggtaaatagattagggctgattaggcatattgaaggaatcaagctgattgatttgtgaactgaggttagacaggaagatagaaatgaaattaatctgtgtatcgatcattgcagaaggaacgacaccacactgcacacaacactttagctctttagtttgtgatcttttactactacgactacgacctctttaggctttagcgaaaattaatttacagcgcaagcaaagtaaaagcaagtgcctttaactcggatctcgtggacgcagtcgtcggtgccgacgcattcacctacacggcaaattctattcaggtgcagcattgcagcctacggcttctctgaaagaaacaatgcagagacttcacttgcagggtgtagcacagtggtagcacagtgttcccctgccacaatttttcttgcactaatttgcgctacatacaacgtagtactacattcattattgtaaagcaaacattgtactgtagtagatacaaatgatattacataatagtgatatgaggcaaaaaaacgtcatactcatctggagtacaatctttaatttacagtccacctaaaatgtactccctccgtgttatttgtatgacgttgattcgtttaaaattaaacaaaccaactttatatatttaggaaaggaggtagtactagtgaatagagaataaactatattaaacatatttttatacgggtagcgagattgtccacttgtagggctgtcggaggcgatggcctatgggtccttgccgcagcccatgagagcgtgagtgagcagcatggcgccgcggcgggtcgcctccgccagccggccgaccaccgggaagctcaccgtgtccctgttcttgagaggcttcttgtcccaccagtcttggtgcttcacaaccttgccgtcctcgacgtcgagcgtgatgagcgacgccaggtcgatggccctgcccaggaacttgtagtgctgcttgttgtcgatcagtatctgaaacagatcgattgattgttaattcctctgttagtgatcagcatgatagtcaaacact

SEQ ID NO: 64732 - DNA, 4549 bp, Oryza sativa
aagggatattttttttttcgggaatacgtaagaagcgcctctttgtattaagaggagttttagtctgtacaggttaaagggatacacagcaggagatcggattataggaagtcacccaagcacattagaccataatctcgctgatacaatgttgcgacttgagcgctctaaaggcgtgcccggtatgacagtattggcgagccgccacagcgctgcctcttccgccattgccctgccgcttctgtccagcttgtgtgcttctggttgaacaccctgttatttcgctccttccagatagtccatgttgcgagagtagcaatggtattgaaacctcgccgttgagagctcggtaaggtttccctcttgtcacataactaggagtggaatgaggtttcattgatgggcaagcattccgagtagggctgtcaaaaaagctcgagactcgcgagcagctcaagcttggctcgtcctaggctcgattcgagctcgactcgagctccaaacgagccgaactcgagcttgagtaaaagctcgcgagctttaccgaaccgaggttgagcttctaccgagcctaaccgagcttggctgtgtacagtctatattgcatgttcaccttattaatataataaactaatagataaatatatatatttgtatctatttacacaataaattagcatgtgttagcacaatatatttattttaatcattttctactcttttattagtgtgattaactagaaaataattagacttatcaagagattattattaaaatatatattatactacttatggccgagctcggcaccgagctcgagctcgagctcgagctcgaacgagctcgaaccgagcttgcctaaaagctcgaaggtgcaataggctcggctcgagcttgtgtcgagctcgagcttaggcagacgagctcgctcgagctaggctcgttgacagccctaattccgagcaaccgattgccgagagcagtagccaccagagctgtcttgattctgggcatgcgaccaaaatgtggttgatgctttcctcgtactgatcgcataggacacacatgctgggatggggcaagcccctgatgcttaacctgtccgccgtccagcagcggttgagtgcgaccagccagctgaagtaacggcagcgtggcggcgccagcgatttccatatcggcgtggattgcaacgggattcgccgaggaacaatgcttggtaggcggcgcgggaggagtacatgcttgaactttcgcatttccaaataaattggtcctggcgatccgagagctctatctcccgcaacaacgaccagagattgagatactctacgatggcctgcaatccgagggctcctcatatatcgcggatccaagctctgttgagtagcccctctgctaccgtccttcgtcgtcgggttcgcttgggtactcgatcatagagtgccggtgctagtgagcagatgcaggaaccatctagccaccggtcttcccagaagagcgtagtcgtgccatcaccaatctgtcaagtcatggatgcagccacgaaacactgttctttcggagaacaggggatggaaaggccttgccaaagaagaagagatatgatggatcgatggtgaggaaacaaacgtagacgtacccatgagctcgcataagcgggtcctcgaatgtggcatgcgccgcgtaaatctcgaagtcccgagccgtcgcgcacgatccgtatctgcaacatatgcgtgcaacttttttttttttctgtcttgtttcgtcaccgaatcaacaacacagagctaagcagagaacaggtgaacgtacatgttgaggagatgcggcatgatgtgccgggagacgggcgaggctgccttctcctcttccatggctcctcctgcagtcgtcgtggtggagaagaaggagaaccagagcccgtcgacggcggcggcagcagtcgcgcggcggagattgagcatgcaggccaggatcggatcgagcggcggtggcattcattcaaatggcgagaagagaagcgtactagtctagtctagtcgcctaccctgccgtggttgactagtccagttggcatgcgcggcggaggagggcgctacgtcggcgggacaatccggtggcgaggacgacgacaccacgacgcttttcttcttcttttttcctttttttcttcttttttttttcgtctatggaacacttacggcccagaggatttttggtagggaagtacatcaaaggtccctcaacttgtcatggagatacaaaaggaaaaggtacaccgaagagaatgcttgatggagattcttcgccgcgccgagcagacgaccaagaccaagactttcatatgacagaaacagcaccctagcttttcctgttacatctcaaattgtatttattttgttcgcctagcacctaagggagagaagaatggaaggaggaagtagaaagaaagtcagtttcatcagtacataatcacaggtgttgcttgatatattgtaggaccaggtgtgccattgtatcctgtctacagagcagtattctgaattcctgattgttcattaatgccatcatggtagattaattggttatatcatctgaaagatccaaatgagcatagtgcagttaagtatagcaccaagttcactggttgttaacaagactagtactgctacaaagcaaatactccaatggaggtaacaagagatattcaattatcaggtgcaaactcatatatcatctctaatcattaaaagaaaaccgacatgttccgtataagtttctgacattttgcatgcaaaaagctatagtaattttactttgaactctgaagatacaacgccatgaagctaaacccaagcaaatcaaactgtctgagccgatcgaattacatcagaatccacacgctttggtctcatcacagattgcacatgcgctctcagcatgtgtgcctctcagccgggctccgtgagcgcgatgtcggccttcttcagtgctagcgcgtgcgatgttggctgtgccgatgtcggccttcttcagcgccagcgcgttcatgccgttgccggtcatcccgcacaggtggcctcccgttgaatgatcctcacgatctcgtacttgtgctccgggaacatgccggcgtccaccggaaacctgaaattacacaaaggatggaacataagttgcctagctactcataatgatggattcgatataccacatatttttattaaagttctctacctcaattaggtttttgtcaacagtgacatggttgagagtgagagttccaattttgtcacagcagagaacatccattcctgccatttcttctatggctgtcatccttttagtgatagcaccttgccaaaaattaattaattttagtaatgatatgtgatatactgtctgttaattgaagaaacatgacaacaatatcttggacacacctgttgagacaggtgatgagaacctattgcaagtgtgactgacagaacagtaggcattgcgatcggtatccctcctctcagaagaacaagaacattgttgattccatctccgtatgaccggtgctggattgggaacatgattataacctcaacaatcacaccaatggcgattgagcagatacagaacttgcctctggaggtaagaacctgaaattcactagttagaaacagctgacagcacatccacttgcgaggttcttataatcttattacagtctgaagattgatgaatcaccttctgaaaatgcccaacaacctcagtggagtccactagatgagctgccttgccaaagaaagagtgtatccactagattcagaggtgacagaacctaaactagacattcatgcaaagcatgtattggatctcttagacggccgtctatatgctactgtgcctcaacagggtgtggtctcaccttaacattggggatgcatttgcgttggaaatccatcgtatagaactaattaatagcaaaacgcatcaaattattaggctactagctttataccaatctgtgcatcatagttttttttttattgtattgttctcaatactcatatcaaataatttatcgtgattatattattgattgttttttgtgtagttcctgacctctgattctgtagatttgctacacctcatgtatctatatgcaaatgacattattgcttagacagaaacaacagcttgagtctccaccaagtgcagcgtaaacaccagtatggtaggagtaatttcttatgtaacagtaacatgaggagaggaaaccaaaagccatgctgtgcagagacaaccaatacagttaatcgttaaaaagataaatgattccacattactattttttttaacacaaaacattagccaaaattagtggcgtggaataaccttcttccacgaatcgctaacctagttcttactcaggatcaagataagtttcattggaatttaacccaaaatggagagttttcagtgaagtcgcattatcttgccttggtacattcagatttgcccaacataacaaagtaatttggaaattaa

SEQ ID NO: 64733 - DNA, 1511 bp, Oryza sativa
tggatgggaagtactcaggaataacagttcccagaatcaaattggcatcagttattgccagctcaccaccttttctatagcatacaggaccaggatgtgctccaacagaatctggcccaaccttgaaagctccaaactgaaacttaagcttcgatccaccaccagcagccaccgtgtttatgtcaagctggggagcttgtattattgccccagcaatttgggtctccagaacttgttcatagcttccatcgtagcggctaacatctgtggatgtaccacccatgtcaaatccaatcagcggttttgatgtctcaagttgaaacaaggtctgagagtagccaaccacaccacctgcaggacctgacaacactgctttgtgcccggagaatctcctctctggtgccagaccaccatctgactgcataaacagcacattcacctgctcacctcccccttcaaacctggacatgaatcctgataggtactctttgatgactggtgtgagataagcatccacactggctgtcaagccacgaggcacagcacggaccatcggcgtcaatgatgaagacaacgatacatgcttgaatcccatctcaagagataatttctcaatgagaagctcatgctgaggataagtatatgagtgcattaaaaccactgccaaacatcttattcctttgtcaagcaaacctttcaacaaaggcttcaatgcttctacatcaaccggcttcgccaccctgaccaattcccctgagatccctttaacagataaaccatcatccctctcaccatcaccaccaccaacaagttcaaccctctcatcaacctcaaccacctcctcatacaaattcgacggctttgacaccttgagatcgaatatgttcggccgagcctggttaccaatctgaagcaaatccctgaatccccgggtgacacacagcgcgatcctttcacccttcctctcaagaagcgcattcgtggccacagtggtgcccatccgaatccaatcaatcttgcccgtgggaatcttggacgaccgcgggatcctctccccggagaactcctggaggatcctcctgatcccttcgatgggggcgtcgtcgtagttcgacgggtcgacggagagaagtttcatcacgtagccttccctcctcccgggcacctctgcgtagatgtcggtgaatgtgccgcccctgtcaatgcagaatctgaatttctccgtgctacccatcctaacttcgaggtactctcagaatctgcgtcctctgcaaaacaccaaaacagcagcgtagatgcaggcaattcagattaatctggtaatgggtgatggattactgtaataagtagaaggagttgtagcactgagctgtgctgtgaattaatcaaacaaagggggataagagcgccaggggcggatccaacttgggacatggggggttcagttgaactcccaaattttgggggaaacaaacaataaactgttacttgtattttctcgtgaaatagct

SEQ ID NO: 64734 - DNA, 1210 bp, Oryza sativa
aatgtttgacaccgttgactttttagtttgtgtttggtcattcgtcttattaaaaaaaattaactaattatttattcttttcatataatttgattcattgttaaatatactttcatgtacacatataattttatatatttcacaattttttttaataagacgaacggtcaaacatgtgttaaaaagtcaacggtgtcaaacattttgaaacgaagggagtataaatttctggagcgattcacttggctcccgctccaattgaccatttggccgtgggaatcttggacgaccgcatgatcctctccccggacaactcctcgaggatcttcctgatcccttcgatgggggtgtcgtcgtagttcaacgggtcaacggagagaagcttcatcacgtagcgctagcgccttcccctacctcaagaaccccctcccgatgctggacatcgctgacggatcgtttggctccggcgccgcggcgatgtgctaggactgcggtaaccaagcaaagaaagactgtggccaccaacattgccgcacgtgttgcaaaagccgcggcttcggttgctccatccacgtcaagagcacctaggtgcccaccgctcgccgccgtgagcaccaacagctcactggctcatccccgtcttcccccgcaaccgcctctaccacagccaccgcttccgcctctgcctccaagaagccttgccttctcacctcccaaacgacgacgtcgcacaccttcacctccgatgccaccacgcccgcagctttgacaccacctccagccatcaagtaaaacgccattgataccagcgcatgttcatcaatacatacgcgcaattcggcatgtttgtctcctacgaatctacaaacagctcaaattattaagcttgtgccattttttgcagatgtgttgtttaggagagcttgccaatgcaggtgtgcacaccggtggtgtttaggtgagaggagaggaaaatatgaaagaaaaagaggccgacggagaggtggccaggccgccgctgctccctatcgccgtccccaccatcgctccccaccgccgctcggggcaaggtgaaaaaagaggccggggagagaaagagagataagggagagagagaggggggaaggaggaggaagaagggaaggaaagggagaatgacatgtggggcccacattgtcgatgggtcccacttgtgtgtgtttgtgagtga

SEQ ID NO: 64735 - DNA, 2435 bp, Oryza sativa
tatgtgaatatatctataccgaaagacaccccgatttacgctcatcttccttctcttacctagcgtccacgacgcggacatctccgctcccgtcccccgcggatcgtttcgtccatcacaactcgctctccgtgcggcggcggcggcggcgatccccgatcgggcgactccggcgattgcgaggtaactagcgtctctcctcctcctcctcccttctcgaggttcgctcgatttgggcgcgtgtcgaattcgggaggctggtttgctctgattgggcttgtacagattgcttgcttgcttggtttacgtgcgcagccgcagcgtgcttgttttgctaaaagggcggcttggagaaatttttagtgacatcgaccgagcttgttgcgccgccgccattatcgtgcgacgacttaactgaatccgtttgcagttttctgctatgcggcgtcagttagttcagtttcctccgtgcggggggtggggcagggtgcggtacatgggtgggggcgatgaactgtgtggcacatcgaatttactgcagtaatctgacaagggaattgcaattgtaaggatataagggaactgcttctgctgtgattctcaagtgctgcaaccctaggtggcttccgcagtgcccagcccaggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaattggttgctagctgttagggagtatttttcatctgtcagtcagtggaactcaggtctgcagtaagtttgttcatgattgagagcatatagcttatatctcacccaactgctaacttcaggcagataggaacaattacactttattttgttgcatgctatccccctctgtggatctaaagctttgctgcccatttttagatccatcttgcttgtcatgttttctctacttcattttttaacaacagtttgcaatgcattccgttttgggcaattatatgatatacatttttctgcttattaatcttaacaggttgaaattaatacattgatgctgtatcatcacagaggcggtctttcttaatcttcaatattttcttagagctaaacggttatattttggtgtcttcttaacaacaatgccatctcttcagttattcaactgacagagcacggacgcaaccttttgtcttcgagaaggtgtgctgttttaacattgtctttctaaattttagtaagtcgatcatttagttcttatctcatgttccttgttctttacaaacatcaacaggagaactcttgcagtgtttctggtgcgtgacttgcgggtggaactttagcatatgctcactcagctcggcgccaaaaacgtcaggaagaatattctcatagtgatgcaagtacacagaccacgggtaatcagagcatttgtcaaaatggtgttgatggtaaattggtaccagcaatcaaaaagagaaatgggtggaaatccttacaatttctggctgctattttgcttaaaaagattggtccaaatggaataaatcatcttctcggcttgatgataacagctgtaagttcgatggttctctttagtgtgggtgtttttgtttgacattctgataatattgttctgaatttaataacttgtatggccatctatgctctacaccttgaatgtgtattctacttcatggactaagcatattgtgcttgttatctacatttccaagtatttatctgcattttatgctagagtttaatatgttactgagctttgctgacttggttgctgattagttatgatatgttgtatcagttagttaaactctcgatcattgagctatagcataccatgataggaagtaccatttccagccttgtctgactacatgtaaaaactctatagagcttgggttttcatatttcttttatataaataaaatcttgcttctgcaggtgttacgtactgccgttggccacagattagcaaaagttcagggctatctattcagggttgcatttcttcggcgtgttccaacctttacacgcctgattatcgaaaatcttcttttatgcttccttcagtccacaatatatcagaccttcaagtacttgacagggtccttaggtttgcactctaagaagattttgacagatcttgtccatgctgattactttgaggtatgttgctttatgaagttgaaatcttcattctttatgcacctta

SEQ ID NO: 64736 - DNA, 1458 bp, Oryza sativa
agcgtcataatatcattagttcagtctcttggaaccctttttatcagttcaagacgcttgaatcttctcaggtaaatgcaccgtccttgtgtgaaatgcttgccctgtcatgttattttttcttcggggggggggggggtgcactgtcacatgtttaatggacattgataaagtagttgatgatacttgatggttcttatgatgtcatatgacatgtttaacctttatgtaacctcaggttcatattttgtttatttagtggaactataggttctatctatcatcatcactctagttctttgctactaagaaattagttattcactcttaaacttcgtttctggagtacaaacataaaattttgacttgtggttactaaggaatatattggtgattcatgttttttgtgtgtatcagtactgttgcgaatatgcaatttaagattatctgttgatatattggagtccatcatattccaagaatatcttgtgcattacaagtatctatgacttcataattccatttgataaatatctttttgctgattaactttctattctcattaacagtggctatgcagatcgtattcgcgagttactggatgtttcacgtgagctatctggggttcgtgatctatctatgaataaaaaatcttctgtagacaattatatcagcgaagcacattatatagaattttcgggtgttaaggtaatcatgatggggactactagttcttgtgtctgtttggtatgaaaaattctaataaatgatttgttacaggtggtgacaccctcagggaacgtcttggttgatgatttaactcttcgggtagagtcgggttctaatcttttgataactggtaataatctataccaaaatatgtgtcctcttagtttggatttgcgattgagctattgcaaatcatcatgcttattgtaatgaaaacctgatatttgcacatcactttttaacacgcccaatacaagttcttttatgattgccatctgatgtaaacattagttgacactgggtaactaatgtactgatgggcaaattgtattatgccgagggaaagggcttaggagaagcgactggaatggacttttggaatgagaacatttattgtttacctgctcccctcgttggcaataactgtcctttatgtagtgataacacttaacaactgtctaaacttttgatctaagataatattagataccatgcactccatatatccatggatgtaggttgctgtcggatccctgtgatcaaccttaaatttgactcttaaatgtacgcataattatatatattcttctagacattttgtttgtatatgtgtgacactacttgtatgttttggtgctttttcatgaaagttacagccatggtaactaattttataatgcatgtttgctcattttcaggtcctaatggtagtggaaaaagctccctttt

SEQ ID NO: 64737 - DNA, 729 bp, Oryza sativa
aattcctgcagccctgattcctgttgaagtgttgattatttctactctatacggtgaatgagaaatgatgtactgaatcattcttctcttatttatggcaaatacctctgaggatattcaaactggaactttaaatcctctgactaagggcaaggcatgcagagcaccaagaactagttcccttgtgttatgaattcatcatccactcttcagcgctcatctggaggaatcgatgaatgggaagaaacaccatccaccaataaatcctctcctttgggaggcactgcaaatcgcaagctcccatgactgcgagtgggtcttcacctctgttgcttgggtgggtcaacgtccacagaaaatgtcacggacaagaagagcaaatgttgtttccccagtctcaaattttgatgaaggcctatctgaaggatcaccacttgatgctgctgttagaccagcggtagagtcacctggccttttgcttgcaaggggtgtagctagtaataattcacaagttacaccaagaatggataatatttcatctccagctggtctgtcagatagcgaaactctgctggtacggaaaataagaacaaggataaaatcagtaatagtggtgattttgagaacgagggcgcaaattcagcccataattcagcagacttaattatctcatcgaagaaaagcaggatactgttaaagaagagcttgaagatggaagtattcgacggc

SEQ ID NO: 64738 - DNA, 727 bp, Oryza sativa
attcctgcagcccagcggcgcttcggcggcgaggacggccatggcggggcgaacgatcaatggtggcgcgtcgatgctgacgacgacgacgacgacgacgacgccaccgcacctgatccagcagctcatggtgttggctggctggaccacccggagtccgtggctccagaaccacgcgtccatgtcgccgcggggctcgccgtcgtcgttctcctccgggagattctccgacccccgtgggatgccgtcgacgttcgcttaccgaacacccggagctagtagcggccgcgttatcgacaacggcgccgtcgccggccgtggcaagcagatggccggaactagccgctcacttgagattatcgccgttgataccggcgccggaagcagcaagaacgcgtcgccggccggcggccatgcaaatgccggcgtggtggtgaaacgtttggcccctgtgctcgcgatgccgagtgccggagccgccggcaaagggaaggaggaggcggcggcggcggcggcggctccgtcgccaaatggccgcggccgtaagcgcgcgccgcccaaggtgagcaatgatccggcggcgggatccgacaagaagccgaggaagagggccaagaaggcggcggccgctggcagcaaggtgaccgtcccggctgacgtgatcatcgtcgacgacgacgtcaaccaagcgagctcgaacaccgacgcgcaaagcaacgccgacgac

SEQ ID NO: 64739 - DNA, 2430 bp, Oryza sativa
cagatcaaagtgcaagaccagcagcaacagcgcggccgcctcgccgagcgccaggtccagcgccatcgccgccaggaagaagaacaacgccacagcgaccggcacgacggcgacaccaccaccaccggaggcgaagaagcacaccgtgctgacctggctgatagacaccggcttcctcaaggacaaagcgaaggtgttctacgtgccgggcgacgccggcgccgccgagaaggtcatctccggcatggtcaccaagacgggaatccgctgccgctgctgcaacaccgtcgtccccgtggctgtgttcgaaacccacgccaggtgcgagcggccagggcagccatgggagaagctgctgctcatgtccgggaagccgctgtcgaagtgcatgcaggaggcgtgggcgcaggagcgggtgaccgccatgcgcgcccgggagaaggccatggcgtcgctggagcaggagaaggagaagagctcgcaggccaagaggaagctcgcgaagacgaagaagatgcagctcctcgacggcgtagtcgtgtctccacctcttctcctcgtcatcaggtgaagaagaacggcggcggcaaggattgcagcgacgacgcctgcggcgtctgcgccgacggcggccagctgctctgctgcgacacctgcccctccaccttccatccagattgcctcgccatccaggtcacaagactgaataattttcagacagaaactgtgattgattttgtagcatgttcagttcatgatcaaatcctggttactgttttacatttttcagttcatggtcaagattatcttggttactgttttacttttttcggttcatgtccagttcatgattaaatcttggttactgttttacaattttcagttcatggtcaaatcctggttactattttacatttttcagttcatggtcaaaccttggttactattttacattttttggttcatgtccagttcatgatcaaatcttggttactgtttgacagacagcaactgacaacaatttacggccagcaaccgtggtttttgcggcattttgaattcatgatgaaatcttggttgggtgttttgtttgcttgatttcaggctccagacggctcctggagctgccatttctgccggtgcgtgctctgcatgtcacatgatgttcagggtttatcaacatgccaacagtgtacacgaaaatgtaattaatctcattgtacatgtcccttcattttagcatctgatcaaccttgtgtttccgaatagtaactgatgagcttcactggaaacacattaatctgcagatcatcagtactgccgtcctttgcaaagccctgggttcgagatcggcgcatactgcagcgaaacctgcaaaaaggtgaaaattagttattgatatttttttcccatagcatatgctagctcagcaatagtccacactaaccggttttccttaaaattagtgcggagtactgtatttgctacgcaactattgtgtttatttatggagacacaactgtatttctaatatggttgtagaagtgtgccctaatctaaagaaaattaatctacaccactataatttagacctccgatgatcgggaggtgtagttttttttctatataattaatgtcgtaattttctaatagatgcaatggtccttttagtactgttttcaaaatataaatgtctgatagatagactccaaattctgtacattatgcggtacaaatacagagcttctgaaattctgctttattaatggagcacatctcagttatgcttgttctgaatccgtttttcagatgtcctctcatctatcagatatgataggagtcatgaaccatactgaagatggcttttcttgggccctcctgaagattcagaaggatgagctagtcacttctgaggacatgcctgtcattcttgagagcaatgtgaagcttgcagtagctctgggtgtactcaatgaatgctttaatcctgtgcaagatcgaaggactaagatcgatatgctccaccaagctgtctacagtctagggtatgtgctgctaggcatcaaattgctaattcaactgcttcaatgtttcatcctaaaatatgcaaaccctgatatgtacgtgtcatatatttagtaattttgtatggtttagcactgaacatcagttatatgtttctctggcaaaatatatgtaagagcaagaagataacttcagaaacatatgagatagatttgtacattgtcacacaactttcatttgtactcaacagatcagagttcaaacgagtaaactatgagggattctacaccatggttcttgagaaggatggagaaatcatttcagtagccttgctgaggtttggatccattctctcttcagttttttttctcttaacgatagttcatgtcttatatttattttctg

SEQ ID NO: 64740 - DNA, 1807 bp, Oryza sativa
agcgtcagtgctgctgtttttcatggtttaggatttctacatggcaagagaataaccagtatatttgcaattataaagttcagaatttgtgatactccaatgccttgatcaaaatgcctttttgtacctttttcagctactactatcaaaccaatgtcctgccctgttcttctgaaacaggttccatggccgaaaactggctgagatgcctttcgcaggcacgctgccagcttaccagaaacaaggaatgatgcgtcgccttgtcaaggctgttgaaaaggtgcataacctactgaatcaccaatcctccatccatttatcattcattcagttaatttttcactgcaaagagattcagcgattgttggtgccgcttgtcagactcatactgtacattgaatttgataggtgttgctgtgaacgcattgggaaaatctactgatcccggccggcactgatctagtggaaacgtggaagagatccttctccttcaagccaatgccggccaaggtcgtggacgaagcctacaagctgagcttggtcgtcatcaccgggacgacgctgctgctgaaacctatctatgctcatcagcatcgactagtcccatcctcgaaaggtaacatgcgccgcgaatgcaagcgcgcgtctgctccggcgacggttaccgggtgcagcatagacgaggaagagccgatgacgacgacggcggctctcctgaccgacgacgagctggcattcctggagatggcacccttgtgcagcttcaccgacctgttggccggaggcgtctacccgacgggtctccagcttctccgcggcatgaagtgatcgacgagatgcagctctgcctgcaactcattcgtttctaaagaacattttagtactacggagtaatatctatgactgaattcgtttaatttcctacttaaaagtgcgactaatttcagtcaggtgtgcgtatgcatagttgagagtcgagactaaaatttggtgttcttgtcctgggtcacaagcagcaagtgtcagtgtgtcattgtcaatggagttgatgagatgatgattattcatcagcatggtacagacatagtacaggttaccgaacaatgttaggttaggtagctgtgatttctagctagctagagcactctcaaggcataacttacttagtgatatactccatttgtagtagttctacatttttgcacacagaccaaacacccacctaatattaatgtatactccagtatttcctggtgactcatggaggagacagcgatagatcactgcgtagctttcatctaagcgcccatctgcaaaagatctagtggaacaatttatttggcgtatactggggagtagattgcaattggaacctttttaattactaattacctcggtcctcggatacatgcaacaggcaacagaaatagaggggcttaattttctggtcaagagatcacagagcagagaagaaaaaggtccaacattgactagtgtttggtgcatgcgcatggagggggatgaaaatgtgcgatgaaatttcggatcgacataacactgttaccctttttgttatataaattttattttttttctaatttctttttcagcaattaatgttgacattgaataatttaaatgataaatatggttaattacggtcgatcgagcgtcgtttccgaagagatgttaccgattccgaccattttcaccccttaattccttgtagatctcccctcatctactattttttaaattaaattcaatacaaatgatcgtgaaaagttctttaaaaaaaatgacaatg

SEQ ID NO: 64741 - DNA, 1324 bp, Oryza sativa
tattgatttagaatttctgagagttggtaacttcttaattttgagatctctcagtggctgggatagttagttttaacagtgggtacttaatatttacagtggagaaagcctcttttgtacagatccaaccccttatagtctggtttctccctactgtctctcatccaaaaaaaaaaaaatcgagtaaaatttacagtgtactgagaacttactgctttgagatgtctgtagaagctcttcgagttcaaacaccctattaataccaccggacagttcaaggaattttttatgtaactcaagaatatcaccaaaagctataaagctttgtgacaccacagatgccaagaatcgaagtgcatgtgccaactctcctgcaatccgaaattgagaacttgttgggaaattctatgcaaaaataatatcatttggatttgaaaaatttatcaaccttgagttgaagtcaaagctcggtcccccttgtgttccaaagcatataacaaactaagcccccatgtcacattgtgaggtagctgcttcgtcacgaaatcatcaaaaataccatatagccatctttttctcagaagagtccttgagtggttaagcatcgttgtgaatttagcttcaaccatctgatttacgataaaataatcataatattagggcatgtaaatttactaacagatctgtaccagatgttcaaaagcaacaagaaatttgtatacacaaaaaacatattgcccacaagaattatagtgtggaaactagaaattttaagcagcatttatgagacatgaaaaactcacagctttttcccttgatccaccaccaaagaaagctattgactcagcatgtgtccgcaatcttgagtgcatgaacctgtgaaattaacaaggtcaatacttggaagttccttagtaataaagtcaactttgccaatgaccgcaaatcatatgtcactaacctgaatgttccttcaagttcttgttcttgatttgcaagatcaccaaagtcaggggaaacagctcttagaaaaccaagacctagcaacatgtatgcgtacaaaatagcaactccccttcgccctgacaaaatcttcattctccatgtaaacctggagagtaatagaggacttgctaagaaaacctgattaatcaaagaacacctgggtaatattttagaccatgacaaactcaccaaagaatgtcaacaagtggtttcaccattccggtaactaggccagcaagatcattggtcaacttctccacatcatgtgtgattctttggtctgcatcaatatcgatgcctgacatgttaaatacctgaa

SEQ ID NO: 64742 - DNA, 1588 bp, Oryza sativa
ccaaaaaaagacaaaccttggttttcgtgcccaacgtttgaccgttcgtcttatttgaaaaaaatatgaaaaaaataaaaagacaagtcacgcataaaatattaatcatgttttatcatctaacaacaatgaaaatacgaattataaaaaattttcatataagacggacagtcaaagttggacacggaaacccagggtttgcctttttgggggacggagggagtatttgcctggcactgcccccaaagcatcctggtaggaacatttcaattgcagggaaccaatattaccttagtgatggtgacacaattgaatttgcagcactttgcagcacactaatcccaattaaccgaaggaaggcagctttgtcctgctccaggacatacttaacgctcgttcctatcaagattgtgaaaacatattaagtaaaaggtataccatcagatctatctccagtacatgaagataaaagccaaccgttcagtgaagctatacgatctgaaatccaagtccgagagaaaacaagcaatgccactgcaagcaactgcccaccttgcttatcaaataatttagggacctgccaaacaaatatcccagaaaattatttcatgtggacgatcagcaaatttgagtcgaagagatctctgaatagtggatactagatactgaattactgataagcgtaaaaaaatgtatgtttctcaccagtatttttgacattgcagcagctcggagtggcaaaggtcttggtgagcactgtaattgtggaactagatttgaccgttctgtgtgttctatttccatatggagaagtggctatgagctgtgtagaataagaatgatccttggggcccattaaagcattaccctagcaaataaaatctgttaaaagaatggtacataaaaaatcaataacaacagaacaggcaatatggaataataactacctttgtgttggcaataaaagccctttgaacagcaagtgcatcagatttacgatcagtttctgatgagttcaatgcatcaaactctggttcagcagagataaaggagccatttctacaagagaaataacgaactttttagaactgcatttcatattatatataaataaataaggagataaaaatcatcatgaggataacctattttcctgaactgtccaccctccttctccatccaaagacaaaacgatgtcatgaaatgcaactaatgctggacgatgagagattgttatgcatgatgtgcccattgcttgaacccttttgcagaaacgctcttccatatcagttgtcacagcactagtgcattcatccaggatggcaaactttggcctatggtagaacagccgggccattcccaatctttgttgctctccaagagacaattcatcaccccagttacttccttatcaagagggtagcgttctagcaaatattccagatccacctaccaaaagggaagaaaaaaactaaggttttccagtaacactttctaggtacttgggacaaaatagtcacaaacaagtgcaatgaggcagctaaagatgccaatctatcaagtggataattatgaggggctgcaggaa

SEQ ID NO: 64743 - DNA, 1045 bp, Oryza sativa
agctcgagaaaagctcggacgagccgaatccgaccgaccccaacatacccaactcgagcctagataggcgcagtcttgctcgagctcggcgcctagcgctcagcctgccgtgctactggtgggtgcgcgcgtgaccggcgacctcatctccggcctgccacccccatgatcggagaatcgccctatccctatcgcaaccgcctcggccgccgcacggcagatcgaccgaaataaaaaaaaaatagaggtgggtaggattacctccggaacgggagcgcgacgaacgaccaacgcgagaggatgcggcgaggagagcaggacgcagaagaggcgaagaagacgctttctcccccctctctctctctctctctctctctctctctcgaagacgaacactggagggtttttttttttttattcctattaccagccctctcctggacaggttgatttcccctttctctctccctctcctgcctctcctgagtcctgacacacgcagctggcttgtggcaattatttctgtttgtgcactgtgcctgttaaaactacgattgaccagcacttcttttttatcattagtgtgaagaccaccctctaatccggcgtcatcactaattttcccgctctttttcactctcccgggataggcctcaattgagtttaatgggcctataccaagtcttctttgatgatcaggcccatatgcggctgcaagagtgcaaggcccaattcccttaccagacacgcactttgccatcaatgcaccaaattacttcaaaaactatataatgaaccagcgagatctcatcacattggagaaaaatttaagttcttgttgaaacaggcgtagaaaaaatcgattatattactgtacaagtaaaagaacagtaatgctgagaattgatgcactcacaagtcacaaatatctcaaacgtcaaattaacagaccaaccaaccatacaggtacgctcttacaatggaataaaatgattaacatgcatgtagttcatgacagagctgatttgctcgatgctacctacag

SEQ ID NO: 64744 - DNA, 3530 bp, Oryza sativa
ttatgaggccgaatgtttttcaacaaagaatttgcatttgcctttttacgatccactttatcaaaatattggacgagacgtggggaatgtattggcccgattgcatattcaccttcactgagatccaagagacttccatcaaaatctttaacttccgcttatgatccaaaactatgcattctccatatgatgtagccttacggaagaattctttgcgggtttggatatcactatgcatcatcctacaaaataaatatacgtgtccattaatattagtttatcgacaatgagaggggcctaaactgccagaggcttgccgcgtagcttaaaatttccgactttattttctaaagaaaagggattgtcttgtgaattcttgagagaggagagaaatttggggattgaactattcatccattgagttggccctaagggctaatatgttgagaagagtacaacgcaaaaagatagaaataccccttaacacaaacacactaatacatatattcttaacacccccactcaaatgtaatgtgtatacaataacattgcatttggagtgaaaactaaacaagagaacacaaactaaatattagcctatctccaaagtcttgatgatgtcgtcgaagtgagccaattcttggatgatgaagaagaaaagatgtatcccctcctcaatgaagtggacctcggaaccttcacaaactgttcttcggccctcggtaccttgaagccttcacgaaccgttcttcggctcttcattgattcagagatgttgttgatgatgaagacaatgaaccttcacaaactattcttcggtcctttgactgatgatgagatattgatgttgatgaaggcccttcacaaatgttcttcggaccttcactgattgatgatgatgatgatgatgacgagaagctccgacgtggagatgatgaagtgacaatgaaggctagctccgactgggagctggcgatgatgaaagccaactctgacagggaattggtgatgtagaaaagacgatgaagagatggattgacataacttcgacaaattgaaggatgcaatagacttggatggactgaatggatagcataatgatttgcactagtagtaagataaactagcaaaagacagtaccaacaggtatatactaggtactgtaacaacaaaggatttgttgctgatcaacgctgatagataatagaagacaagcagattttgttctctcaatgatatgcatgcactgtcaactagctagaagcaaagcaaggactatctggtcaatactaatggatgatactaatgatgttttgagcatgcttgaggcgcttgcatatgcatcattggtgactgattcacaggaaacataagagagaacacaaaatgcacattacaagattggaagatgcttttgattgagtaggactgcttttgtgctgtgatctgggataccaaaatggtttgttttgtgcttcatcccccactgcaagttccctttcactatagttttcttctaatttgttcacaaaatgaactgttggcagaaattttggatgtgtgtcatttcatagatgccgattccatagggctatcaaacaccccaaaattatgccacgtgactgaaatttgctaacaagagtaatcatgtagtcatgctcagtgctaaattaggtatatggattatatagaatcattgatctcatcaaattcagattaagagctgacagaactacactcttttagtggctgataaacatatacatgtgtctttagacaaaacaaattgattcttcatcctctgcattacgtaaaactggaacccaatgacaaaacgattccctgtttggatcacagaacacaaatttctacatttctactgttaatgaaatatttaacagaacaaattttaggtttaaactaacttgatcccctacttctgctgctacaaagtactattagaagaagtacacatctctaataataaacaagtttttgctaatcatgtttcagtgaaaacaatctaattttgttcaaacaaaacaaatcaatccacaaaactactacaatgtcaacaatcaaaacctctgtaaatgcagggcactcgactcttaacaaaggaagataaaaagggagaatgaataacaaaaacagaacataaccttatctaacttaattcaaatttgcttacaaaactaggtattcttgttcttggtagatgcgtataaaacaatactaactatattaaggaagctacgaagggggagaaattgtcaaacctcaacccctcgccctttccccgaacaaaacgagaactagttttaactagttttagctgcaaaacattctaacagagctagttgtttcaagtgctcgtatatagaacatacaaatgctataaggcaaacagcaaaagcaaaacagaaagtttagatgtaacaaagcttttgtttgggaactgaacaaatttcgatgaacatgacaaccatcgggagaatgcagttcaaagaattaatttgtcaaataaaccatgctcaagtgcttatagtatcacaaatgcaaaacgtgtattttagcagggagagtaattagaggtaatcatgtcacaatactaaaaattaagtggtactttggtcagtgtattttagctcaaatcaacaactaataagaatggagggagtaacttgttactacagtcctagttgcaggcaagtgctgcatgaaaggcttgatcttggaaacattctgtttcttgtagtgaggcaagacattccaagaaaataaaccttatagaagccaatattttttaagaaaaaaaatatagggacacaaaggtatgtatagaaaactgatcccaaaaattatcaccctatctaaatcaagatagtaaatttatttcaacatgcaaaacgttctaatgtttaggatcatgtatgctgcccaattccactagatttttttgacataaagataaaaaaggggcagcaacaaaatgctttgccgttcacataatgatacttcctcacatcagaaatctagtggtctggtaattgcaaaatgaaatgctagtctgctgacactctctcaacctccacaaatccattcttctgagaagcagatctgaggagaatacacaaatcattttatccagctagctatcacaaaccttctaactccatccccagcaacagattagagggggagaaaaacacaatcattagatctaccaggctctcatggtcgtcaacaagagcaaaacaacagggggggcaaagaacgtgacttaccatggaagtttccatggttgcctcactggttgccgctgcaaatggcgtgggtgccttgccgccagccacagcagcaaaccgaccacctcgtcaactacccctagaacgccgtggctttctcgccggctgccggcgtctatgccattgccacttgacctcaccggcagccaaggaagataacttcattcaaggttgtgacttgtgacacacacacgggcggccaactcaccaagcgccaaggcg

SEQ ID NO: 64745 - DNA, 1568 bp, Oryza sativa
gtaattacgtgctataattaaagtgatcatatataatcgagatgcatggtgggcttaattatattgatggatcagttgttgcaggtttggacgtcgttgagagctcggtcgatgagcatggtgaggaagttcatgacgtggaggcgtgcttgagcgcggtgaatggatccatggcgtgcgtcatgttgggggcgaagaccatggcgacgttgcggctgcccatcttgttgctccgctcctccctcgccacgtccgccatcagctgcaccgcccagtccagcagcgccgccttcgccgccggcagccgcgcgcacagcctcgcgcagtcgtcggcggactggcaccgcgtcacctccgccgccggcagcgagtccagcatcccgccggggagctcgcggaaccaggccttgatgagccccgccaggcagtgcacgtccacgccgccctccgggagcacgccggagttgagctgctcccggaccgcctgctcctgggcgtcgtcggcggcgatgcggaagatgccctccgccttcagcccgccctgctcgtagagccgccgctgcatcaggaggaggatgctcgggacgctgttcccccgcgcgtcgtacgagcactgcatcgactccgtcgacacgccgaacaccgtcttgctgcaatattccatatccataataatacagttgtcagccgccgcgccggccgccggagatggagaagaagaagacgcttaccttgcgctgggggcgttgccggcgacctcgggctggagctcgacggggaggccttggaagccatggaaccggtcgaaggtgacgtgggcgacgtggcggacgtcggtgggccaaccgatctccatcggcggctgctgctcgccgccgtcaaccgcctccacctcctcgacttcctcgccgccgccggccacgtccattgtcaagctcaagcgacaagccacctactgatctgaaagaaatatcaaatatcctacctcgatctctctcctctcttcttcaacgaacctcctaattcgatcgaggacagaacgaaatgtcgtagactaattgagagagaaagagagaattggtggagactaattaagacgagtggatatattatggagaggtggttggtcgtcgatcgaatggatcggagatacagttaagctgcagcgagagaggggacagacgtgggttgcaccactactccacctctcctgtcttctcaattccctttttgcatgccttgcgtatcttctcctctactcagacattcccccctcaactctaaaaaaaaacctcaaaaatttgatgttctgcctagggagggacaacccatcgtctctcatcttatgtttagctgttaactgcttgacatatgcactcggacagctttgtccgctccgccagatcagaggatttattactaattagttttaatactcgtatcatatcaagacgtgtgccacaaatgctccagagagccttgtgaataaacgctggctttctttcctggtggccaaagaaagataaaacgtcgtttcaccgataatatggtcgcaggggctgcaggaa

SEQ ID NO: 64746 - DNA, 2114 bp, Oryza sativa
  unsure (1)..(2114): unsure at all n locations
agtattttacaaaaggccatatatcaaaaatccagttttatatgtgctaaaaaatgtaatgtggttttctcaaatttataattcatcatatttcaatccgctactcacttttatgataattggttgtaacttttttgaagcaaatgtcagaataaattcaattgtttaagtacccaaaaccattgagttactcggttgtaacttctaaatagaaaccgatttgaaatactccctccgtccaaaaaaaaaactcactttaagtaagttgtttttttgttatggagtctagattcaaggggttattcagtttgatgtcatttctaaccatactaatttttaactaagttgctatagatgtacctacatttagttccttttttttttaccaaaatttggtaaatacattagaaataccaaaaatttgttagtattatcaacttattaaaattagcattgctaaaatttaataagatttgttttggctataatccgaacaacccctcgagctaaagtatttttttaaggagggagtggtaggggaaaaaaaagaaaagcaaaatggcgaggccgctgcctgacaaatgggcccctttgacgacgactggaggcctttctgcgccgtcgatccatccatccggcctcgccgatccccatcacctgcgacggcgagcagcgtcgccggcgtccggctgcctccgccgcatactcggctcggtcgtcttctcgaccttcactctccggaggtctcctcgctagccccgccgcgccgatttccatccatccctcccgcgaggtgggtgccgccgtcctgccgcttccgcctccgctccggtgagctcccgcacatcccccttcctttcgaatttgccctaacctttaatatcttatcttctagatctggaagctatagtttttctctttttcctattaaaccttaatactctcaatactaagaacagtttttttccccaactcccctgaaatgtttattttctgaacttatggtggatataggttggctcctgaagttgattaggtggtgccatgggttcaaaggattctcaagtcgaagctactttacaagatgggaacaaagaagatgaagaggatggtactgtttcttttttttttttttggagcatctactttctataattctttgggacaatttggacaaaactgtgaccctgttgtgttgtgttgttgctgtggtgcatgcagattgggaggcgattgcagatcgtggtgaaaacgatgagacgctaacgctagcgcgttctctcgagcagcaagcaaaggttttcctagtagttcttctgagaaaattagcactccatcttcagggcccaagaggaggggaaggggttcgtttctttacgacaagagtgttctatacagtgatcagtgtggtctagaaaatgatatggatgaacaagagtctaatgatcagagtggatcaaagggccgtgtggatgagcagaaacacaagagtaatgcaggtatgatcaggggatccatttctacgtgtccaggtagcctgttcattgtgaataaatgaagaacttagttttttgcttgattttgtagctgcgaaacaatatgggacaaggcatgtccttgttctttatgacttcccacctagcacactcgcagcagatttggaaaagattttcgacaagtttggggaccatggagttgccattcgctgggttaatgatactgttgcacttgcagtttttcggactccatcagctggtaatttgattgttgtagcaatttcttattgacttaatttaggtattccaacttttagatgagccattcatgtggttctctccaaggaaccagattgaacatgtgtcatatatggctactgtgttacttagaaatttagaattttctgattgcttggaaatgtattacattgactcatgcctgtatcgaggaacatggcattgtttgcagtttgcatacatgaatggcacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64747 - DNA, 1418 bp, Oryza sativa
ttcccacgaataatacgagaatatattttaaactctcgaatggatgttaaccgttatttcatgtagttcaaataattaaaaaaaattacaagattgattaatatataatatatcgctacataaatatgtatgttctttacaagttttttataaaaacacacacattgaactctagctactttacatatgttaacagccattttttattgtaacttatagaaattaaatttaaagtaacatgtttgtgaaccgatatatcgcatattaatttatccttttttaatatatatatatatatatatatatatatatatatatatatatatatatatatatatatatatatgacggaacgtggggctcctcaccgggagaccgcgcaggcccccctttgccggttcggccgggggcgctaagtgaggttcttcaccctcgatctgtgggatgtcagcgagaaaggaagcgcacgagacacgggcgatgtagacaggttcgggccgctgagaagcgtaataccctactcctatgttctggtggatctgtgtgtgaaggagttacagagagccggagagcaagagagttcaggctctagaacccctcttcctctttctctcctctaccagctcaggtattctcagagtcgtctgagagtcctccttttttctcccttccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgccgtcactcgcctgacacaggggataaccctgtcattccttcattaatgggtggagatttgcaatggccactgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcatgccgcacgtctgcccttcttcatacaatgactcccttaccatgattgcgatgaagcctggaatgaatctggccgggactgacataccaattccaggagttagtacgccggctccggctagggacgagtgcctggaggctctcatcattctgacgggacggggcgaggcgtgtgacaggccgcctgttgccacctaacccgcgatctgaccgttctgtgaccggtcacacactgcgaccggtcacggaccggataagcgtgcgatgcgttgcattaaatgcggcgtggcgcgctcgtccaaccagcaataaatgcggttaggtgagccccgctgtgctcacctaacccatacatgtggcg

SEQ ID NO: 64748 - DNA, 1877 bp, Oryza sativa
tctcattagccgtggcgtgcgttgaagctgtgaaattgacaggacgagtttgtgcgatttgctcgcgctttgctttgctagtttgctttccaggtcatctcgatgggaggcaaggacaatgggcatcactgttcggcatgatcttcctccgatctgcggctttgcatacaacccagagtccccccacgatgacactgtgcgacttcggttggattgtcagggaaagctggagaactcattgtcacctgtgtttgtcctgaaaagaaacaggaatcgcccctaaactgatagtagatgagtagatcgagtcatcccatgctccctttccatcctatttttccagtttagcttcttaccttacttgcctagctagcaatagcatagctctcattatcgatctcacattgtatctttaaaaaattatctgatattccctatgttatatattataagatattttaagtttaactaaatttatagaaaaatataatagtattttcaactcaaaacaaatctataaaaaacatattcgccggtggattaaatggaactaatttgataacataaattcctatatttttttaagcttaatcagactcgaaaagtttaactttgaaacaaacgtaccaaataatcttactaccttttgttgcactctggatcaccccaactctcttctcaaacatacgaacgatcttgagtgcgttggtttctacttgtcaataaactcccatggtcatatgatatgtttgtagatggacaaacaagttgaggatggtccagactgtcacaaaggtaaaattatccaattcaaagtgaaaatatcaattaaataaatggtccaaaacgaaacgccagtaataaaaggtggcccaaagtgaatttcacttgaagttttgattcccttttattctcggctgtatcaccatgaaagatagaacgagaatgaatttcggccaaaaatgaaaatgaactactctaaaaaataatttatcttgcctctctcaactcttgctcctagttgaatcgcatcccttaatagcaaaaccgggtataacgtctcctccatctatcaaaaccggtgcaaatagcctcctttggtggttcaggaggcggttttgtctcacgtggcatatttgatcccattaactgactcagtcaatttgtgggtcccacctgtcaaccggctagtggtgatgtggtcgggagctagaggtctagctggagaaggttttggtgccattgtcagggatagaggtagaggcagaggtagggaggagagatggaagggatgcggaggagaggtgagggaatggcttcggcgggaggaccacagtcgtcgtcgaggaggcggcggtggagagtgaggaggaactgcgctacctggtccacgaggaaccctgcccacaacggcgccgggactgctcccccacacgtggccgatcgacgagctcctcctcccccccccacgtgcaaccggccgatgattccaatcccagcgcatggcccaccgggagttcctcccaagagcacggccacccagtgagctcctcccccgtgcgcggccggctgacggctcctctccctgtgcgcagctggccgcatgagctccttccccacgcccgccgccgccgcccgggatctattgcttattggaggtgagagaggaggaagatatgagatgaggtgaggaagaagatgggatgaggtgctggctgctgacaagttggtcacaccaaatgattaagctagtcaatagccacgtcggatgaaatcagctcccaaaccactaaaggaggcgatttgcaccgattttaatagatgggggagacgttacactcggttttgcagttgatggatgcggttcaaccatgagt

SEQ ID NO: 64749 - DNA, 5270 bp, Oryza sativa
cacgacccggccccgccactaccgcgcgcatgcttccaagagatggaggcagagctcctcctccttctgccgtgccgctctctctccctctttcttttcccaaggtggcaagaggcaagcctcctttctctccttctttcctcctttttctccctcgccggcgtcatgccctctgccgccattttggccgcgagcgccggagcgccagctcactctttgacaacccaaggtcggtttccgaaccgacattgccaccctataaacccaagcccctccccaaaccaatctccctcgttttcgtctctcgccattgccgcctcgctcatgtctgttcgccgccgcctctcgttgccacgcgtgccggaggagccggcgcgttcgtggacgcggaaggggactccgggcgctcgtcttcatcctcttccccggtccgaggccggagagatcactcccgtgccgtcggcctctcgtcactgcgcccttcaccgcacggtagtgcatcctcctcgttctccctcctcgctccctctcctccccttagctttaggtagtagcacgagtagacctcccgtaactagctggcgccgccccgaccgctgccaatgctcgctgtgtgctcgccgctgtcgccgcccgagctcgatagcgcctgcacgtcgccggcctctctcgtagtgtctccgtctaatccgacgctagaaacggactccggtggtcgcgtagatgctcaagtgcgaaggaatcgatctcccatcgcgccgtcgccgttttcccttctctcgccgccggttgccgccgccgcaatccgccgccgtcgagcctcctccggcgaatccgagccgttggctctctccctctcgtcctcccttgtcattccggtgtacaccctgtcgcccctcgtcgtcgcacggcgtcccggagaaaccgccgccgcccaccgtccattcgcggctggcgccttcgtctttccccagccggcacgcgtggcagccacgtcggtgccacctcggcacgaccgagtcggctgacccggtcagccgctccctccgttccaccctccccgtgcgcgtggtccatggtgagccgtgaggctgcgcgtgggcccgccgcgcaccgcgtccctcccccgaaccctagcgtgcgccgcgtgctccctccgcacggtgaaccgagccgccgacaagcgggtcccactcgggaccacgcgaggtggacccggtccactggcacaccggctccctctctccccgcgcgtacctttgggccgccttctcgggccggccggcccatcaaactcggccgagccgcccctttctctcggaccgcgccctagccgctcgagggaagtctatttcccctccctatttcgattctaattcaaaaaaggattttaataaatccttttcctttagaccaacaatccaataatcttagaaattcaatatcttctcaaccatatgtccgtttgactccgttcaactttcaaaattcctcaaatctcgagatctatttaatggcacgtttagaggtcaataatagggctttatttttcgccgtttgttgagttgtcccgtttcgcgtgtagtttcggagcccgaagacccggagtgcacggatttcgaggatcaagctcaagatctcgagcaaggcaagtcacctttgatcatcttgcacctataatttaaatctaagtatttcttctccgtaaataatacatggataggattaacacaagaaatttggccgcggcttgcgagatagcctactggccctaatccaagttgctgcaattaccctccttgaattattgaacacttaaaacctcctttgtcgactgttgtgcttcgatgcacgagccttcaggcacgcgcatcggaacacctcccctcaaatttaaaaatatccaactgtcggtgacatgggacagggagtatcatgactagaggcttgggcaggagcaatcacccacgaggcctgaccccctcgggggggtcgggcccgagggtgatgtggccgcccccctctttgtctccccgaggggtcggaccgctcccgtttcggcctcgagggttgaggcgccccgaccccttgtaggttttgcgccgcgtatataggttaggtgagcgcagcagggctcacctaaccgcatttattgcggtttggacgagcgcgtcacgccacatgtaacgcagtgcagcgcgctcgtttatccggtctgtgaccagtcacagaccgatcagatcgtgggttaggtggcgacaggcggtctgacacacgcctcgccccatcccgtcaggatgagagcctccaagcactcgtccctagccgaagccggcgtgttacctccgtccccgccgccccgaggcagcggatgatcacatgcgacgaggtcccggtcaaggagattgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtagcgcgacttctggaggccggattcatccgcgaggtcatccatccggagtggctggcgaacccggtggtcgttcccaaggcgaatggcaagcttaggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacctattgttatacgacaatgcccttcgggttaaagaatgcaggtcctacttttcaacgtactactcgaatttctttgggtagccaaataggacgtaatgttgaggcttatgtcgatgacttggttgtgaaaacgcgcaaccaagagaccttactctcggatctagcggaaacttttgaaagtctccgctccgcccgcataaagctgaaccccgataagtgcgtgttcggtgtacctgcgggcaaacttctcgggttcttggtctctgcccgaggcatcgaggccaaccccgagaagatacgagctatagagcggatgcgcccacccagcaaacttagggatgtgcaatacgtcaccggttgcatggccgccctaagtcggttcatatcgaggctgggagggaaggcgctacccttatttaagctccttaaacgctccgggccgtttacttggacggaggaagctgaacgtgccctcactcagttgaaggcgtatctcagctctcccccggttctggtcgccccggagccagatgagcccttgctactctacttagcggcgaccccgcaagtagttagtgcagcgttggttgtggagcgcgatgaggacaatcctcattccgcacatccccaccctgtgctagcttggcccgggagagagcagggaggagaggccctcgagccgaacggtggcccaaggcccccgacgaccggaactggccctctgcccgcttgtcagacggtgccaggtgcccccgacccccaggatggcccggcggccactgcgggaaggccgcacctgtcgccctctgaccccgaggctaaccctgtgccgactcgacccgggagagagtagggagaagaggcccccaagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggaagaagagcgacccagagatgcggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttcagagttcgatttgcactttgaaccacgccacgctatcaagagccaggccctcgccgactttgtggcagagtggaccccagctcccgagcccgtctccattcccgaggccaactcgagcccctcgcagctgcctcacaccgcttactgggtgatgcagtttgacggctccctgtctcttcagggcgccggtgcgggggtcacgttgacctcgccgagcggagacgtcctcagatacctggttcgccttgactttcgggcgaccaataatatggcagagtacgagggactccttgcgagactcagggtggcagctggactggggatccgccgcctcctggtattaggcgactcccagctggtcgttaaccaggtctgtaaggagtaccggtgctctgacccgcagatggacgcttacgtgcgccaagtacggcgtatggagcgccatttcgacgggatagagcttcggcacgtgcccagacgggataacacgattgccgacgaactctcacggctcgcttcctcgcgagcccagaccctaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggatcgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagag

SEQ ID NO: 64750 - DNA, 9591 bp, Oryza sativa
ttgattatctgtatgtcgcgatcgacaagttcactaagtggcccgaggcttatccggtcgtcaagatcgataagcactccgtacttaaattcattaagggcatcacagcccggtttggagtgcctaaccgtattattacggataacggcacccaattcactagtgagcttttcggcgactactgcgaagacatgggcatcaagctctgcttcgcctcacctgcccaccccagaagcaatggccaagtggagcgtgccaatgcggaaatcctcagaggccttaaaaccaagaccttcaacatcctcaagaagcacggcgattcgtggatcgaggagttgccagcggtgctctgggcaaaccgaaccacaccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgaccttgactacttggaggagcgaaggcggcgcgcggccctccgagccgcgcgctaccagcagagcctgcggcgctaccatcagcgccacgtccgggcccgatcactctgcgtagacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccatggaacatcgaacaccttcgtcgcttctacccctaagggggatcgggtgtcatgtttcgggctcgggccaaccccgcacccccctcgggcgtgcagggttggccgggggctaccacacatgcatatttttatttctcttatatctgctcttatatctgtatttcaataaaagcattttcgatttcctaaaggttgtatctgtactgttgtttccttttggagaatcttaacttgaaataggtcactcgcgctcaatcctgccctcgggggctcgggtcggctaaaatcgccaaaaggggcccagaaccgagccgtgccccggggcgtggtgaactccgggggggaatcggtaaaaacccacaatcgggtcacccataaccctcggtcaccacgctcccggcctggccagtctcgacacgtggatctccccaggcactagccccgacccgcgccttttgaggactgggacctgggcacgagcccttaatcaagctaagacacaaaaggaccacggcacagatcatcctcatctcatacacatagcaaaatgaaattgacacagaaatttcttcattttgattgcagattaagttaatctatacaaaaaggaggcccgaaggccttacaagaaagaaaagaagaaaaagctgaagatcggcgggggcctgggggctcaatccgatgcacccgggtcgtcagcctcgtcgccactgccgcccattccgccgtcatcgtcctcctcgtcggagttgagggcgaacgcgagccgaggggctgaaccctcgaagctgtggacgatgtggttggcggcgtcccggacctgcgcgcgcgcgccgtcctcggtcccgggagggaactcgtccagcgccgtccatggggagaagtcgggatccctggcctggtaactcgccagtacaagctccaccgctcctcgggcgaggtccctcgaggatgacttaatcgtcctctcgagctcctcggggagccgttggagagtcccggccatctccaagaggcgctgggcgaggcccccctggttggcggcgtactttgctgtcctcccgccccagaggcctgcctgccggccggcgcggtctagaccggagacggcgtcccgaagcatgccgggccctacctcgcctgccaagcggagggcctcgacctccccggcggacgagtctagcgcgccctgcagatcggcgatggtgtgttcggcagctgcgaggcgggcggctaagtcgctttcgcccacagccgccccgccgctgcgcgccctcgcgtccagctcctttgcctgcgcctcgagttcagcggcccgctggttcagtgcggccctctcggcgcggacaccttccagattacggcgcgcctgctcctcccgcgctgcctcgcggagggacaggctgtccgccagccgttgcgccgcggcctcggcctcctcgagagctcgctcccgctcggtgagcgcgtcctcgcggaggcggagtgcggactcctcttcggcgcagacggcctcgtgcgccgccagcgttgcctcccggatggagacgacggcctcgcggtccgccaggtccctctccacgacgcaggcacgctctttcagcgccatggcacgggcctcaagggcttcttcgcgccgccgggatgccacctcggtctccgccgcccgccgttctcgggcagcggcagcgtcaaggaccccccgggcggcgtcgagcttcttccctagctccgcctcccagctcccgtgttgaaggcggagggtgtcctgcgcctcgttcatcacggtggtggcgatgagggcagccccccgttcctcctccacctccttggcgatctccgccagcaccttccgacgggcttcaagatctgagacgtgccggcggtgtgccttgcggcccacctccaccatggcctccaccgagcatcgcccctcttcgacacgcgcccatgcggcgtcgagctccgcccgctctgcttgcagggccttcacctgggcacttaacccgtccaacaccgtggtgtttgcgacggccaaggcctgcagaaggggctctgcgttcagtggggcaacggaaggcgtggggaagagccgcctcggagaagatgccgcgcggctcgggccgccgatggacgtgccggactcggggatgtcccccggacctggattgtcctgagcgtcgcccgagggagtgggcccaagcgatgcgcccgcggcctcgtcgcgagctgcctcggaagtcgtcgtcgcctcggcctggcgaagtctggcctcctcccgagcggcttcttcagcttggcgagctcggacggccacctgggcagcttcctcggcttcccgaaggcgatccgtggcctcttgccggtcagtttcacgggtcgcctcggaggatgtcgtcgcctcggcctggcggagtccggcctcctcccgagcggcttcctcggcctggcgagcccgggcggcctcccgagcggcctcctcggcttcccgtaggcgatccgcggcttctcgccggtcagattcccgcctccgagcctctgcggccgccggatcctcggcctcagactggccggacttggaatggtgggagggacgcgacgggatctcgctgaaacagaagaaagaccagaagacaaacaagatgggtgagtgaaaactcgcgttgagagaatgaatacagccaagatgggcgtgggacgaacctgcgagggggtcggttaaacgaccaccttggaggggaaataaggtttccccgggatggttctgtcccccccatcttgcggagccgcttcttttttcgctccccctcaggctacgacgtcggcgtggccccttccgggcgcctgctgctggcacgcgccgccccgccccctcggggaggagatgggggaggggttccttcctgcttcctcttcccccgggcgtcggcagggcggctgctccccgggcccccgtcgcggggcccagaagcacgaccccctcccggggtagattgatcccccctgcggctcccgcccgcgccatcgtggcctcgaggagcccgctcctccgacgccccgaccgcctgcatgatggtcaggatggaggcgcgatctggatcgctgcagagggggaggactccttggggaatgagggatgcctccacggagctgagattcagcacccgttggactactatcttgaagtcctcaggagcccaatcccatctgaccccctggtgggtcctcatgtagtcttcggacccggtgtactcccaggcgccccgggcgcgccgctgaagcggcgcaatccggcgacgaaggtagtcgccgaacaccatggcccctgtgagcccctgggatcgcaggcccgccaggcggtcgaggacggcgtcatagccatctcccagatctaccggcgcccgccagttggaggcctgcgctgggggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcagccaccaaccactgacggcggcgacaccggctgtacggtgaagaaccaccggaacagccgaagggatgggcgcaccccgatgaacatctcgcacaggtgcgcaaagatggccaatgtcattaccgcattgggggtgaggtgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcagattccggcatgaagcggcgcggcagcccggcctgcctctcgctcacgatgcgggaagacggcagcacgctaccatcgagcagagcggagccccgtgccatggcgccggaagaggagatgtttgagaacgagcgcgtgtggcgaaggtagggcacaggaaacaaggagttagggcgcaagcggcgaagacaaggggaataatgacgagaggaaggaagcaaatctcttcctcggtgtcttcatacccttgccaacgctgtgcccggctcctcacttctcgcgcccactatctcgctccctcgtttctcgcgcccacgcttccactaatcccattcgcccgcttgcggcgcatgaggtggatatgcggttgtggcagtcgagatggaacatatcgtgcccgcgttaattacgctcgccgaccgaagcgccatcaccatatctccaggcaaaacgaaccggctcgtcccgattcgcgtgctacctgagtaatgtggcagtcttgaagaggccgctcattattgacagtcgagttaccgttgccggagtgcgtgatttgtgaccattgggtttctgcccaactgtggagaccggtcccacctgtcaccaggcttttggaagtggcgtcacgcccgaccgcttcccttaaggagggcaatcgccctggcataacgccgggggctactgtcggtgacatgggaccgggagtatcatgactagaggcttgggcaggagcaatcacccacgaggcctgaccccctcgggggggtcgggcccgagggtgatgtggccgcccccctctttgtctccccgaggggtcggaccgctcccgtttcggccccgagggttgaggcgccctgtcacaccccgaagttttcctccctagtcaaaattgtaatttataattgaccctaagaaaatgctggtgaaatcaggagaaaaccctaagaaagtaatgcaaataataatcggatttgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttccctcctttttgtcaagtgggccgtcggcccacttctcccttccttcccctcccttactgggccggccgcaggccgaggcccagcccgacagccggccgcccgcctccctcctctcggggtcgccgacaggtggggcccacctgtcggacccgtctccctcctcccgccgatcccgctcgcgccgccaccgccgcaaccgacgccgcgcccacgcctccgtctctcccgggccacgtcgaccacgcccgcgcgtgcgccgcattccccgcgcccgttcccctccctctcccgctcgcgcccgcgcccgagatggccgggattcgaaaaccgaatcccgcctctctctcctccccactcccccacgtcggccgtcgaatcccgccgctcccggccacgtccggtttccccatcccctatttaagcatcaccggcaccccctctcgctttttccccattgcgccgacctctcccgagctccccaacgcctccgcgccgtgcaaccacccgccgccgccgcttttgctactccggccgccgctaggctcgccgccgtctcacgccgtcgccgccgttagcttcgcgcggccgaggtccacctcgtccacccctcctccgtcgaggttcgtcgccggagccctcatctccacgcgcacgggtgagcgccacctctaccgccgccttcggccatggatcccgatcgccatggtccatctctctctctctaatccctatcttctccttccttagggcacgccgaagctcgtccgctagccgacgccgtcctcccgtggcttgccgtcgccgtccgccatcgccttcctccgcgccggccaccctcggtgaggcatcccctcccttcttttccccttcctctcctctagccgccgctctccgccgccgtcggtcgtcgctttgcgccgctgccgcatgtgcgccgccgccgtgtgagcgccgcgccgccggcgccatggtcgccgccgtctcgcgccgcgcccgcgcgccccggccgcgaggtcccgcgccgccgtccgatctacccttgggtagatcggggccgccggtccggtcgccacgtggcgccgccgccccatccttttcccgtgccgctgaccggtgggcccgcaagccgccaccctctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcatatctaattcatccgagctccgtttaatcccatttaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgaaatagtcgccgaggtacctccagcagcagagcaaggcaagtcatgcttgtcacttgaacatgttgatcctatattgcaaatgctccattgttttctttcaaatattgcattgttttataatatcactatgggatggatacctactgttacagccatgcttttggatatcatgctcctttgttagcttgggttataacatgattagactttggactaggacttgcttagccatgcttagttcaactagcacacattggggatctcatttaaaacctagactataggtttatatgataatgttggtttaataccaccgctctggtgttggttaaataaaatgaaccacatggtgggctgtgggtgcacggttttgctagtcgcacccatggcagttaaggaccggttcgcgggatgccctggaagaatttatcgtacttaccacaagccagcgtgggcaacggctgggcttatagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgtttaattttttacaactgtttttgcattaaattcctgtttataaatgccagtatttatgcaaatgaacctgcttagctatcccttgttaaatccatgcatcatacccctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgttttccgctgcatttctgtaagacttttataatgtttgtaagacgtggatctgtatgtcaacattgtcgtttgtgtaccccggctggtcctggacgggggttttaatacacattctgcttggaattctattcgggaatttctgggcgtgacacgccccgaccccttgtaggttttgcgccgcgtatatgggttaggtgagcgcagcagggctcacctaaccgcatttattgcggtttggacgagcgcgtcacgccgcatgtaacgcagtgcagcgcgctcgtttatccggtctgtgaccagtcacagaccgatcagatcgtgggttaggtggcgacaggcggtctgacacacgcctcgccccatcccgtcaggatgagagcctccaagcactcgtccctagccgaagccggcgtgttacctcctggagatggcacgttggtcccggtcagatatatgccaggcttcatcctaaccattacaagcaagatattgtatgaagaagggcgaacatgcagattgctaaactgacacgtggtggacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaaatctccgtccatttatgaagagaaggcaagtcaagttggagaaaagagaggataagtccccacacaaaagagagatggtgcatgtggtatccccttgaggtataaaaggaggaccttgcccacttagagaggggatccagaacgatcgaggctggattgggaaccagaggagagagtttctagagtaaaagctctctgactctccagctctttgtagcttcttcatacacagatccaccagaacacaggagtagggtattacgcttctcagcggcccgaacctgtatacatcgcccgtgtcttgtgcttcttccactctcgcgaactttccacagactaggagcttagaatttcacccagggcccccggccgaaccggcaaaggggggcctgcgcggtctcccggtgaggagccccacgctccgtcaccaacgatggatagaaacttggggt

SEQ ID NO: 64751 - DNA, 1690 bp, Oryza sativa
tgcacttaaggactgattccttggaatttcatccgaacatataacaagtacgaccgcatgggtggaatgggacacccctggctgagtaattagctaatcaagggagccttgatgccgggagacaagtggattcgccagggtggtgtcggggaggacccctgggcttcctggcacagtatggtctgggacctaacctgttgttggtctgggacccctctcgtcgacatatggtaaacctgtgtcggctctcgaaatgccttgtcatgaaagcctcaaggtcaccagacatggctgttctgcacggactgggtgatccggattagtaatgtcgtgtgggtaaagtgtgccccctctgcagaggttattaaactgttcgaacagccgtgcccacggtcatgggcggatgtaaggtgattccttagcgtagttttgtttgactactgctttgtgaaatttctgttgtggaatgggatcgatgttgggaaaatctgcagctgatgggatcagctaggcccgggtggccgtttgaaagctgttggccgggtgccaaccttgcatcaatttaaagactgatacattgcacatactccgaccggacgagacacactgtctcatccgtgtcgtttgagaagcactcacttagttgtttcaaaaaggagtttaaataaaatcaattgcaaaaacaatagcctttcctttgaagcctgcattaaacacttaattcccatggcttgctgagtactcctgtactcacccttgctctatataaataatccccccccacttgctgaagaagatgatgtggatcccgccgacgaggagttcttccagaagcaagtcggctacgatgagttttaggatttcggcctagttcccaagtcgcgcctgtgatgattggtccaagtcttggcttctgctttcccttttgtaatgcagttgtgagctggggatctgtccgcagcccaacatgactgtactcctactctataataaagagacctctgttgctgtgatattctatcttcttgtgataccagcactgtttcctgggactggtatcgattaacaggttaatttggagcgtcacgggctagttccgttcggggctagttcggggcgtgacatctcttcctcctttttccaatctcaccaagtgaccggcggtgaggaggccgatgacgggctacagggagggtgccaaaagttgcgagtggagaggagaggagtggcgcgcggtgaccggtgggagagaggagcagcgattgacaagggagaggagcgacgcgcaacggtcggcgggagagagacgaaaaccgcgtggcggccggagggagaaaggagcggcgaccggcgggatagaagaacagtgtgcggcgtggaggggagagtggagcggtgtgcgacagtcggcaggagagaggagcggtgcatgttaccggtgagggaaaggagcaacgcacggcgggagagaggaatggcacgcattggccagtgggagagacaggaacgacacgtgacacgcgggcgatagagaagcggtgagaggagcgacttgcggtcacggtggccggagggagagaggagtggctcgtggcggccggcgggggagagaagaacggcgcgcggcgcagcggggagagatgagcggttcgcagcggccggcaggagagaggagcagctcaaggcggcg

SEQ ID NO: 64752 - DNA, 5084 bp, Oryza sativa
agatctcagggtgagatggaggaaagtgggacccaatgacatgtgtctcactatttttattttctttgtttaactgacatttgggtcccgcatatttgtttaatcttttagttttcaattttttttccagatcaaactgccacgtgagcaccacatcaatgtcacatgagatgaagacctagttaaaagatccatgtaggcgccacatcagccaaaaccggggacaatactaccgagggacgttgtttgcatggttttataagttgagggatgagtggtatccggttttgcagtctagggatgtatttcgaactcggtgacaaattgagggatctagagtgaacttattccaatgaagaaccgcccaagcccagtgcgtcggccatctgaaagaatgaaggcccgtgtacgggacgacgggtccgatgccgcctccccaagcaaagcgaggcgaagacgagaggtcaaaaggccggcgtcccgtccacgggggtccacgtcgcatcgcaggcggtggggcccatggcgtcgtcgtcgccgccgtggctgctgctcccctccttcccctggcctcccccgccccctcccggctcctcctccggccgcggcggcggaggaggcggcggcggggaccccggcgactggaagccgaacgtcgtcgcggcgttcgccggcgcccaactcggccgcgccctccgccgtcgcctcgccggcctcctccgctcgccggtgctgcttcttacccctgcccgctgtttcactccgattttgggatgtagactcttgggtttccaccgttgcgatatccagcccatccgcagctattaaccgatttcagactcttggtgatatgctagttttattagctgtgatattatcatgatgtgttagtggtttgttaccgtagagcatttccactacttccgtttattaaatggatcgataaattgcgtgcttaatcacacaatttattctgaactgaattgcacgatgtgtaggaggcgcgacatcttggtgccttgccgagaataggtgacatttggtttgaaggatcagactcattcgccacacactcgattcttggagtgttggagaatgcgctctccgcaccatatgcttgcagctctgttttgttcaatggaaatggatcggacaggaggtacatcggtagggggaagttgccatccagaaggccaagtggaatcaattcgaagaagaggctttggactaatattcttcttgctgttaatattctgtaagtcattgctcaattcatgttattggttcctcctttgttgatagtaagcttccttctacatttgtggattaacattgttctactttcaccgaagggcttatgtcgctcagataactacacaaggacgattacttatatggggggctaaggttggtctgttggttttaattttcatttcattttattctgataacttttagtctaactcaattacaaaccatgattttagatcaacagtatgattgatagaggagaactctggcgtctggctacatcatctcttcttcatgcaaatcttgctcatcttgctgtatgtatttgtgtcagtttgtgtttataatctaagaaataacattgctaattttccttctgatcataataatgatgcagttcaactgtttttctttaaattcaattggacctatggtggaaatgcttactggtcctagaagatatcttgccgtgtatttcacttcggctctggcaggtattttgttattacctatgtttgagaacatatatatggtggtgataggtgaacattgcctgtcttcctttagttttgtcataatgaattcttcaaattttgccaggttcattaatgagttatcgctattgtgcgtctcctgcggttggtgcgtcaggggccatttttggattggtatggttacccttagcttttgatttcagtcatagaaataagtctaatcatattgttggcaacccaaaggaccataagagtttaaaactagtttcaagaaatccctggtatggtttcttatgtcacaccatttgcatgaactttatctgcacatgtccaggttggtgcctatgctgtttatacgtggaggcataggagatttttggggcatggaaaggaaagtttagagcatattggacgcgttgttatcttgaatatggtattgttctacttatctacctgactttgttcttgttaccagctttctatcgttttcattttagcacttcttttgtggttatcatctttaacaaattgcttaaactttgctgtgtaaatagggtatgggtctccttacaaggggcattgataactggggccatgtaagcctcctaatcttagttcaatgtatgaaatatttacgtaatgacctcacttgacacttgaataatggcagttgggaggcttgctcggaggcatggctatggcatggttcctcggtccagcttggcaatatcaatatgtgtcaaaggacggaagagcggtgttcaaagacaatgcccctattctccaactaagcaacgggaaatggttgaggtagaattttgtatttaaaacggattcctaacttgtgtgggacacagaaattgaagactgaagagaggtggggtttgacactgccattctgccaaggtgatggagtggacgcctagtttggactttggaaagctatttccagggaaactccagctccaaatcttacgcaagggcgacatttgagttcacctgagtcattatttttggatataagttgcaattgtctactgtgacagattatagctaatcaatactcaaatagtcaccacagcaattgtatttaacatgcttatcagtgttactggagcccaactggcacggtgtacatgaatccatatttctggagcccaactggcacggtgtacatgaatccatatttgatacagctaactataggctcaagtgtatcaatctatttatttttggggtgagatggtgtaagtatctgctttggatattgatgattgttatcactactcttttcttctgattttgtgcccaagatgtcacaagacgtaatgactcacgacaaacaacaatctgttcaggcagcacatatttagcaccagctaaatttcagaacttgtttacgggatggcctttgacttgtttccgcaggctatcagcacaacaaatggacaaacgacaaatgtcgcagaaagacgggtgtaaatgtatcgtattatgctcagtatatgatgatgttacaggaaacgaacagtcgtatcgcaagatacaacatcaattcgactatggtaagtcattacattctcctctaccataagcacccaacccttcggtgagaaacttgatatttggtagaggcgtagggcagtcaccttcgtgacataaaaaccctggtaaattagcataatacagacctatatctacagttatactccaactctgaagtgcgagaaaccaccatacagttagaagtaaccgataagcaaaacctgcctttttgcagtatgattgctcatgattgcattcataaacctgcctttgcagtacgatcgctcacgattgcaactccatgcttcaggagatttcaagaagcaaactttgcaaccacaaccaccttgtgcactggtaactctgtaggcaaacagtccagggcaccagccaagtctcacttcaggaatggagagctgcaaattttgacaatggatgtcaaatgaaatatttatgttcaatgaactgctgaagaatagcgaactaaaaaaaagagcaaagcggcacagatatataaagaaaacgtacataaactggtaccttttgtaagtattttaaaaggttgaattaaattattaggatggcatgacgttaatatacaaagaaatcaaaatgcccggttcacctaattcacctaacagcatattgattcacaggttagtaccacaccactagtacacctacctgattcattgtaaaattctagatgaagcgaaaaaaatatctcactctatcacttcaggaatataatgccaaactaacaaagtgtaatgtaaatttattattattactaagttggtagttgccatggaaatcaaacagtgcagttcattattgggttagtgtagtcaagtcgatcaatgctaaatcttattcaggagttaccatatcaaaccaaccattcaaaagtcttaatcatgaaatattgaagcaaataataaagtaaacacttcatagaatagggtacttacaatatggggaaggggcaattgaagggggggacttggtttttcgtcgcttcttccatggagccattgaaggtcgaaacacaggcaatgagggtgaaggtattgacatcatttgataagttggtccagggactgcaccaggtaaatgattgggaggatctacatgaccaggaattggtggaaaagctggagaaagatatggggaaggagcaacagatggctgcggggagtgtataaatggaggtagcttagggtctctgcgaaaacaaggtggtttgcctgttgggctaccagcggaagaaaagcggtcacaattgaaacatggaaagcaaggatttgtgtcaggcaaagggggtgaagcttgaggaggaagacttgggttcatatatgttggaggtgcagggtaatggatgctcccagatggtgagaaagatggtggtacacttgaagaagggaatggagatggagatggagatggggatggggatggagatggtgaaggagatggactcggagataaatctgagatcgaatgctgtaggtatgatgacagttgaacaccttttactttaccaaatacagagtgattaagcccaaggttccttgcattgggttctttgattagctgagctagttgtttcaatctatatggtaaaagaatgctgctcccatctagaacagatgcctcaatagttgccggggcatcaactgaagatccaatctcattcctgaactgcaaatatactttctgcacatatatgacagagggtgtaaattttaaacacaaacacatacaaatttgtaaccaatcaggaggaaattaaat

SEQ ID NO: 64753 - DNA, 2034 bp, Oryza sativa
  unsure (1)..(2034): unsure at all n locations
ccagactgctcaggaattactgtaattcctccagggaacctcaacagctcaacggaagatggatggccaaaaagtggttctgtcaacgataggttcacctgatttagcatcatcgctattaaggatgatctcagcacacttagggcaggcaaacttattgaggcttcttttggagaaggaagaacactaaaaaccacatttgtggagtacttagaggtcaaagaacgcattgacacaatggaaacctgtttcaaacaataagagaagtccattttaggtcctcaggtctccctgggggggtctaattttcactcctaggttcacaagtggaccagagtgaaaattatgaacctttaaattaacaaatggtatatgcagaggaaacaaaattagtaaaaaagaaacaggcatcaggcaccttgctattaggaataccaatttcttcaaatatgtcaccccctagtttatccatgtgagcagcaaggaatgaaactggcttttccaaggtaaaaccaacctggatttcagctgaataaatgaaaattgaaaacactatcagtcctcaaatacattataaggcaagagacatcatctaaatttaacactgtgacataaaaaaaaaatacaaacaatagctgtgccaaaaaaacaagacgatttctggaatactctaaaatcattgccaaatcaattattaatacagtataccatataaaatgaaaatggcatgtgaaataacgagatacttgagaagaatcactgaggcacttccacggatgagaaagtaatgaaggactgcgccaactgccaacaaatgcaatatagctaaacaatactagttaaggatgcaaatgagtaaacaaaaagatggcatagcattttcattcaacaatatagggtgtaaagaaaattggtatcaatgagaagtagaaaatgcaatgatggaaaaagtgatgcaaggattataagaggaacattactatatgcaacgactaaagttgattataaaggttctggatataattagttatcatcatatgaaactacaaatttggttgggtggaggctgagtttttccttagaaacctcaaatttagggatctaaaagtttccacctgaggcaggcagcatggatttccatatatgagcttgaaatttatgacatgtacgatgaattcgagaatgtaaatgtaaaaagttccatatatccaaagcctgaaacattaatataaagcaatttccatccagtcctaaaaaacatcctatgcttaaaaaaaaatttccacagcagcttatctacactcactacataagagaagatataatcaaatggaacatatggactttctttcttgttatataagcacataatgagtatggaatgtcaatcctataacacaactttgtgaatagtacacgaacaatagggtaactaggaatctcaaatactaggttatctataaatttgcgcattatatgaaataaattaacaacacatctacttacttaaagcatttcatattctaaaatattatcaggaacggtacataggtcatagccagctccaaggatagctactcaatgacttaatctattgtgatcaaacaaaaatatatatgtaatttctatggtgaaacaaaggcacaaagaaaatggcatatttgtcaagccttcattcacagttcatacttcgatctattgtgatcaaacaaaactatctatgtaatttcaatggtacaacaaagcaaatgccatgcttgtcaagcttccattcacagttcatagtttgcacatcataagaccaagtacccatcaaacaaaatagtcaacaaacggcttttacagttattgccaaagtgaagcaaatcttagcgtacttttatcttgaggcaccatcatcatattatgtagcagccatgttaatcaataaatcaactcctgttattgccgcagtcactagtactctaagaagaagagcanatcgcacatctcggttgaccacacactgcaagcttgaaaacctactagaaatct

SEQ ID NO: 64754 - DNA, 8800 bp, Oryza sativa
tgaggccgtcgctcgcaaccgcctgcgcccgcgccgcgcgaggtgcggtgaggggcggcgccttctcctcctcctccaacctcagctgctggtgcgccgactgttggttgagtgcggtggtgtcctcgtcgtcacggctagcgtttttttggttttactcgccttctgttttttcgcgtttgacgtggccgcccttcgcgatcgcggccaaaaatgcgggggattttgacatttctgttttttttttctcacttcgcgcttaaccccatgtgctacgcggaaatatttatacttccagaaaaaaaaacttgagcagtaaaatagcagaccatatgccagttataaacacatgtcgagaagataaaagaagaaaaagataagcagcgggctacagatttatagccagctacagcacaggcttcaagatgaaatatatgtatgatagatgagaccatatattaacagatggagtatatgtttatatgttagtactattatatgacttgactattaaattgactatagatgatatggagccagtagttagttgtactattaaacttgctcttatattcgtaattgtaccgtccgtttgggcatcggcgttcctcacgcactcacgctgcccttttttctaaaccaactgcgacgggaaatcccaccacctctttcgcaaccaaacccgtgcatgtgaggacatgtggatagataggtcacttgtcaatttgttatggagtagtacaaaaaatgtgatgcttcggttggtgaacctgggcattcagctgtgttttttttttcttttttggtgagctgaccttgtgttttgctgtgtgtgtgttggcctgctgttgggtagctccctggttatgtctgattttagtgggattatgcagggactgtgtcattaggtggcctagatttgtttgcttggtccaatcagttagctggagtgtggtagggagtgtatgtgatgatgtggaaattttggatgtgtgattgattgtctttacagcaagttaagttgtgcacttgtgctagagataatggttatttactatgatacgactatgacataggtgtaagtaccttttggtattttcaaagaaaaaatgaagcctccaattttgttaattataaacatggatgaagggcatatttagaacatagggaagagaaaactatgcagctatatatacaatgtatagaagctaaaaaatacttaggaaagctcaacaattccgtaaaaaataaggatgcaagctaggtgagtaaacaagtttttttcccgcttatcccaattctagtttactttttttcttttaaattttgtactatcatctgaaaataaacttgtaagtggatttttttttttgccggcaatgaaattgcccacttatgtccctaacgaaaatcacgtaacaaatgagctgtaagagaccaccattacaaataacatagagatactctcttccatgctactccattctttccacgttataagtcgctttgactttttggtaggtccattttgctatgtatctagacataactgctacttcctccgttccacattttaagtcgctttgactttttgtacaaagcgacttataatgtggaatggaggaagtactacttagtttgttttcatcttttatacagataagtcgttatcacattttattttgttatcacacttatcgtgttatttcgaagtaaagtatttgtgagtaactaaccttcaacattaaaattagaagagctaattacctataaataataagtgattgattgtttgtttcatcacgattagtcgttccactggaacagtttctaggtgtcattatcattgacagtttaatggcatgctcttcctatgaccacttgtgtacacacctagataaaagtactcctttatagaaataaaaataactaaaaatggatgagtagatagttcaagaagactatgttggtgaaatggtgagccatcaaaaatctgtcgtccttccggaagaaaccaaccatcatggagtactgtagtagtattcgtgaagaattatcacaggtggaatttgttccattggttggaaaaacatcaccatcactagcggttttatcttgtcgctatgattgtccaatccatcgtggatagcactcaacaaaatagttgcaggagagcaattccaagaagaaatagagacataactttttacacatatgctcaattatcttttcttttctttcatttctatgttggttgtgtctaattgtggtaccacacccagtgatgaaggcagattagagacaaactttgagttaaaagtataaaattaatatctctagccaacaataaactaattttctatacaatcgatcaccactaggtaaaatgcaataatttttttcagctatcctcataacaaattactcaatataatatacgatggaaaaacatgtttgaaataaataaaatatagttttcagagtggaggtttttagcccaaatttcatgttctatgtcaaaagtgaccaagcaagtacttactggagtttagaatgattatgttaaaatcataaaataaattgacaaaaagaaaactatgtttagggtggcgaatgcaacttggttcatggtgggggtacatctgtaccataccacctcggatccggatcatctgactttggggtggtgtgcaattattctatatccatcgtccattccatcctacggctcttgattgctctttctcctttccactagtgcacaaccacccaacattttctactatgccacaaaatcagcccaacaagaaggtgccagtaacatgcatggatatcaactaattttacgagttcatttgaacatctaactcctaattttatagaaaaaaatatagtccaaaacacatatataatgtaattataaaaactatcatatgatttaaaaatgaacgtctgagatgttattgtaggatttcacctcccctctccccaaagaaaaaaccaagtatatacccttactaatatatgcatgtatacaatttatattataacaaagtgtctagttgtccgagagagcgaaagatctatttatatattatcatatttgaactagtatgttaatttatcactgtttttctaactatgccttttaaattcaaatcatgaaccccattaggaaaaaaatctggcatcgtagaccaagaaaatacccgcccccccccccccccccccgctattataaaatatgagcatttctagctatttacctagaaatacttatattttggaatgacaggacttccaatttccttggagaaaatataacaaacaaattttcttacatggcggagctagcaaactttgaatttttactaaatttgtgttatggtaaataaaaatggaccatcaaataaaaaactatgagtatatgtgcaattttaaaggataatttacataatttgaccctcatgaaaatataggagcacacaagatatatatccattacactactattagtgaaaaaagaaatagtattggcacctatatggaagagccaaaccacgaacaaaagagagagaaaggggcttcgtaatgctagccacgtatttggaacaattaatatgatgccaattccctaggaattgatcaaagtttcctaattgatactaatgacgggtggaattaattaggaatgtttcccttatgttttttaacttcagcatcactactacaattaataatagtctttcccgacttattacactgataaatagggtatactgtacgttatctttatatctataaacaaacgcatacccttctttaaacgcataccccaaaagaaggaacgattcatctaagtagaaactagaaatatttctcgagggggcccactatcgatcaaacaacgaagattcgactcatcgttggattgaaatctgacggtccaacttgtttcttcaacctcccgccacctgcacttgttccatctgttagtgtaaaatcacctctcagcttcccatacgtttcatgccgccatattcaccatcgttttttaacaatatagttctcacgcctttatcctgggtgtaaccatatctagctcactcgctcgtggctatatcaacaataccctattatctaccacctagaacgatgtcgagccatcactttaccgttgccgcagatgatcgccctagcattattggagagctatatccaattacgaggaaaactggtgagagatcgagaaaccagacgatgaatagcacaaacccctttcactgtttcagcaaccgtgctttaggtttaggtggtagactacgttgatgtgccatcgctataaagtacaaagtactccatgggaattgagcactacaataccaaccagaggaaaaacccatgggagagacattgtcaggaaggacacgaagccttgacaatcggtccaagcccacggcccatttccccacgacagccgcccgccgccgccgccaaccccaaaagggtaaaccctcaaaccctttgctcccgtttcaaactcgtatttgaacctcccgaatccgagcggacggtcgctgcaatttcgaaaatttcccctccctcccccacgagctgccgagcgggcgggctgctcgccgccgcaccacccacctccgccgtttcaaatttcaaatcctccccgacgcgcccccacacccccccgtgcccccgatctatctaatccaatccatcgccgtcccgatcccccatgtctcttcttctgtgactgtgagtaggcgcgagcggcgaggcgtttcgtcgagcacatggagggcggcggcggaggcggtacggacatgaacgccgtgccggatggcgtcgtgcagcacgtcctgtcgatgctcagcaacgtccgcgacgtggcggcgtgcgcctgcgtgtgccgccgctggcgcgagtgcgtgccgtacctgccggcgctcttcttcccgaggaacgccttcgacacggccgcggcggcggggggcgccgcggacgacgccatcgggcggatggtgaggtccgtcgagcggctccgggagctggtcatctactgccccttctccatggcccgcctgcccgagtggctggccctgcggagcacctcgctcagggtgctcgagctgcggatggacgccgccgccgccgataaggcggaggacggcgggtacctggactgcattggcctggccaggggcctggaggagctcaggctctggggggtctcgctcacggccgcgccggcgtggggccggctggacaagctccgcgtgctggagatcgtcggcgccccgctagaggacagcgccgtgaaggacgccatctccgcgtgccccaacctcaccgacctgtcgctgcttggatgcgactgctcgggcgcggtgtccatcgaactcgcgctgctcgagcgatgccggcttgacttcctcggagccggcaactgctccctctcgctcgccgctccccgcgtcgagtcactcgaggtccagggcttcacctggattactctgcgcggtggtcacagcctccgccgcctctcaatcgccaaaagcacaggtacgcaacacaccgccccgaattgttgatcacgctgacatattgttgtgaggtagagtactagtcaggattatattgatgtgatgtgctattttgcgatgaaatgatgcggggagcgaattcttaatcgcgctgacatgttgttgcgaggtagttaggattatgttgatgtgatatgctattttgcgatgaaatgatgcggggagcgaattcttaatcagtaatcacgctgacatgttgttgcgaggtagttagattatgttgacatgatgtggtactttgcgacgaaattatgtagggagggtgtacaaggtggacaccgggaagctcccagatctggagcacctctctctacgcggtgtccagtggagctgggctgcagtaagctctgtgctgcagtgtgcgagggatgtgaagcacctagtgatgaaaattgagttcagtggcgactttgacgcgctccagccattcccggaagtcgatttggtcgacttcttcaacagccacccgaatctccgcaagtttgatattcatggtgccatgtttgctgctctgtgccagaaaaacagcttgaagaatgtgagtgtttggtttggctttcgcggcatagcattgaactttaggttgttatgtaaggtattgatagatggctaatatttgtgaattgtgaatgcagttagatgcaaggttctgcatcccttgcttggaagaggttttgatcacagtgcgctcaccactaaatgctgagcagaagctgaacaccctcgagtcgcttgtgaagtatagcgtgaggctgcgctctatggtcatcagaatctcgcagatgaagaattgccatgatgccgctgatgatttctttgaggagatatgtaagttcaaatacatgaacaacaagaaagtccgggttgaataaaacaagatgccgtgtgattctttcatcaaattgatttggttaagaactagtttttttctttcaatttaccgtcacttcaatagaggatgtgtgtcaatccttctcgagtaacttatattatgttgtttacctgattgagttcaaatgctggagcttgttggtagaacaattttgattgttgtgcttggaattttgaaaactgtgctattaatctctgttctcttagcgtacatttctgtgatggcattggcatgtctattttgtacttctgtaggtcaacatcgctgtagcaaactataacatgctagtagtacattccagaggatgccttagctttagtgttagattgttatgatcgtagttattcattggatgtgtccgagcagttaaattgaagcaacatttgaggttaatatgccattgggatttagtatgttctggtcagaatggcttaaggctgtactcaatctggtatggtattatggtctatctactgcctcttgatgtcctaagatacctgataaaaacttggaacatatgctgcgcgtagtgctctgttttcttgtggcgctgtcctggtggcgctagctctgtgcgcccttctgatgcaaggcgctgtagtgctgtttgctgtagtggtttggcagtagtagatgcaacaaccttgttgtaccgtttgctccttcataaaaaggtttgctggctctcagtagccggcccagtgaaaaaacttggaatggcaatggttttagggatgcagttttattttggggtgacttgtgaggtaaatatgcaaaatgtttttcaagcagctggttcaatcttatagtgtttcttgggttacgggttgtaactggtcaaaaccaccaaaacaatatgaatccagaaactgattttgcaaaccatgctaaagtcaagacaattggtcattagatgagaactgttcaatgttgaaattgaaatttcaaagttcgatctgtcagtaatttttggtgatcatctagatttctcgttttctgtcggccaccctgtatactgtagacattagacaatgctcacctgttctgttgcatcgtctaccagtaaatgcacactttagtcactctttaatcctaagaccgtgtttagttcaccaccaactaccccaaactttcaacttttcatcacagcacatcacatctaaaactttcctacacacataaacttctaattttttttttccaaacttccaactttccccaaactttcaacttttttcaggaactaaacacaccctaattcatctttagattaaacttcaaagtacctcacaattcgatcgttgagtttctgagctggccgtgcatttggttccacagtctgcattagcaaataaacgtcaggaattttacagtgtagagcaattatttatggtttcagccattcacactcttccagcacgtacataccgtagccactgtcttgagcaagtcaatctgctccttcgatgcatctcctatctgttagacaattaagcatagagagttcagctaatgcttacatatttagtctagtatgcattgctgttcctgtggtgaaatgccatacaggaaacgaagaacatgagctcataatcatctagtccattgttttcatataccttgctcatgatcgtccagatcactccttcagtgcaaggcggtgttgtgagggagccgtcgtatctgtagtagcctgaggttttatctacccaggtcgatggatcaacaggctccttcacttcctcctcggccttctctttaccagcaaggttcttgaaatgtggcgccatctgcatgtatatgcagcatatataagccgtttatagtagtggggatgcatgactacttttgtttgatttagatttagattattcaatggatcattgatttgattgcaggaacaaattaaatattttaagaaatatacttaactaatatcttaaagcaagtggtttgagcaatgcattaggaatttttttaaatgtatttttcaaagtgtggagcatataatccattttaataatctggtgaataaactaaaaatagcagatattactagagaaatgattgtaaactataaaaggaatgccttcttgtttcgtgcatgtcattcaaatatatatatatatatatatatatatatatatatatatattgtcggtgacatggggccgagggtatcgtgactagaggcttgggtagccgcggtcacccacgtggcctgaccccctcgggggggtcgggcccgaggatgatatggccacccctccctctgtctccccgaggggtc

SEQ ID NO: 64755 - DNA, 7374 bp, Oryza sativa
  unsure (1)..(7374): unsure at all n locations
aacagcacagagacgacggctctcgccatgctggggtcctcgtgaaccatgtgcatctctgcgtcgaacctgcatgaatcccattaattgttcgaaccgaccacactctgacatttgttggatacaacaccaccgctaattaatccagctagctacagctcaattgattcacaattccttttattttgataacaaagtgcgcagctagtttttgccaggatcatgcatccgcacctggttccgttgattgtgtgctcggagggttcatgccagtgcacctgcttgagcgtgtactccttcccttggaccgtcagcttgctattcccatctttccatttcagctgagaccaaaaatccaaaacgttggatacatgaagacacaagatcacgcaggttttgcaatcagcattgcatatttgcaggtttacccaataccgtttccataaaaataatatcgtttccgattatcttttactgtatgcatcgtattagaattgctgctaaatagtactacctccgtcccatattacttgtctttttgagtttttgttgtcaatgtttgatcattcgtcttattcaaaaaaatttaaaattattatttattttatttgtcattttctttattatcaaaaatactttacatatgacttatccttttttatatttgcactaatttttcaaaaaaacgaatggtcaaacgttgcaaataaaaagtcaaaaacgtcatctattatgggacggagggagtactagctagtagttaatttcacaaatatgaaaaatttctgaccgtacctataccgtttccctaaaaataataatacagtattccttctgtcccaaaataagtgcagttttgcactgtttatgtctcacttttgaccgttcgtcttatttgaattttttttacgattaatatttttattgttattagatgataaaatataaatagtactttatttgtgactaacttattttaattttcttataaatttttcaaataagacggacaatcaaacgttggacacggatttccacagctgaacttattttgggacggagtagtaatatgcaagctttcgctgtgtctaaccatgtagtcgtggcctcggttctgaatggtggtggcgccggccttgtaggcttgcatcagcggctccttcactttctgcggctccaccgtggtgatgtcgatcggcgactgcttcttgccgtcgccgcagacggcccactccttgtgcagcgagccccacttcgccggccccgtcgcgtcgttttcgtagccaaacatctcgtgcgacatgtctgcacacggataaaaatttttaaaaaaaacggagctaggatttcagcatatcgtcgtccaaacgccagacgccacgacatgctcgatcggcgattgctatgtactcctacctgcgtgcgtggtgaaggggattgaaatcgaagcagctgagaagtgcacttacgtccttctacatgatcagctcgtgtaggcgtgatggcggaggagaaggcgaagacgaagacgatgacgaggctggccacctgcagctgcagggccagcgacggcggcgatgcggcggcgttttgtcgtccccggcgagccctcgccattgttcgagggttgcgtgggctggaagcggtgtcgtggagggaaagggattttggaatagacgccatgcattgtgcgcgagcgggcggccttcaaaataggaagatacagggaatgacggcctcatagctctgccgaattgccgataaattaagagagaacataattaaggtccatacaggaaaatcacgttaagttaacatgccttccacgcaaaaaaggaaggaagagaagatagataaattaggtccatacaaacaaatcacgtttaacttaacataccttccacgcaaaaaaaaaaaaaaagaaaaaagaagaagaagaagtgaggagtccgtatgatatgctcaggcaaggagcaaggtctgcttgtgtcggttgaagtattcccctatttctcggtcggcctcattgtgttctccttatagtcttttggttaacttagagacatgaggcggctttgaaagggaaggtcgtggaggtgtcggatcatcagtgggcaacaagcacggacaacggtgaagtgtaacggtgagaaagaagagaagggacgtagatttagggggtgcacgaattaaaatcttcttcgtttaaatttgactgattttttttccaaggtgtttgaacagtagacattagacagttaaaaaaaaatcaagagatataagttccctaaacagagtcggtgtgtaaaatctcagtgtatggtattcacaataatttcatcagataaccagccaacacaaccatgaggggaggggaggccatagtggaggactggaggaggagtaggaggcgcgggcctgtgaggaagaggcgcgagcatggcgcggtggcattgaggcgccgtggggttcattgggacttgggagggataggaaattagaatttcttcgttgggcttggagtgtattcgggttaattcttgaagtgtatttcggttaagtgaaacccatgacccaattgattagtacactatggagatcaacgttatgactaaagttatcggtctcggttagttcggttcggtctttttttagcccacccctacatggagaccgccatcatgcaatgcatctccgaagtccaaaacagcgagtcgacgtatccagaccagaacatctccctcgcaggtcgcaactcgcaagttgaggagaaattcactacgagaacagatcacggtctcctaataaaccacagggtcaaaattaacaccaatctcaggaaggtaatcccaaatcccaaaccagaggacttgacatcacctgactgcaggcaggctggcacgtgacgaccagctcccttcgatcaccttgctcccaaagacaccacgcggtcaaaccccgccaagcgcgaaggcacactgcacccgcgcgcgcgcgcgagcccgcagccgacgagccaaccaaacaatcgcttttcctccagtttctcccgtataaaaacggccgcgcgcgggcagcgaagctccaaacaacgaggggaacgaacgaacaccacaaggtgtccacaacacaaagccgcccggcccgagacgacgcggcgatcaaagtcatccaaccaccacgaaaccacaggggccagcgtcgtggcgacagagatggcgccgcgcaactcgctgctcccgagcttcctctacgacggggtcggcggcggcggcgggggcgcgccggcggtcgtcgcgggggcgccgagcgagccgccgttcgggatgatcgagctgttctcgccggcatactactccgcctgcgccttcggcggggccgccgcgtgcgggctcacccacgccgccgtgaccccgctcgacgtcatcaaatgcaacatacaggtacacatgagctatcagttaaaaaaaaatcggatagatttgcgcttcttaatttgacgtgcccggatattggtaaagtttctgcaaaattttacgaaacggagcacctcgtgaatttagctactatatccgtcccagaatatttaggtcattttgatttgataccaaaatatgctttatcaaattattgtcactctaatagtttgttgtctaatgtttggttcagtatcaaaatatgccaataacactcataagctgtctaaaaattcgacactattaaaagttgcctatgatatggtaatatggtagtaaattaaacaagttcatagcaacctactactatgttctacgttgtcgatggctcgaagattttgttggaagacttttcctcgtgttaattgaccgggagtttcgggtccaagtcagctgccgagaaagtaggagcgtgacagactcacaaacatgatgaaccgggagctcgtcacccgtgacgtactgacggtggctggaaacatttttctttccggggaacttttcgtcaaacaggactagtaggcctgatgggctcttgtacctctcggcccatcaatcttaaaattccatcttactccatttcaatcaccaacgaaaatgctgatttcccgttttttctcatctctgagtctgacacgacgaatgctcgtctcgcagatcgacccgaccaagtacaagagcacgacgtcggcgttcggcgtcgtgatgcgggagcagggcgcgcgcggcttctacagggggtgggcgccgacgttcctcggctacagcgcgcagggggcgttcaagtacggcctgtacgaggtgttcaagaaggagtacgccgacatggccgggccggagtacgccgccaggtacaagaccctcatctacctcgccggctcggccaccgccgaggtggccgccgacgtcgcgctctgccccatggaggccgtcaaggtccgcgtgcagacgcagcccggctacgccagggggctcagcgacggcttcccaaagatcgtcaggaacgaaagctatgcagggtatgtatattnttttatgatgagttctttgttatcctgttctgactgatctagtagaatgttaattaaacctgtagctgattgttaattgcagtctgttcagaggcttggttccgctttgggggcgtcagattccttgtgagtactcctactctgctttactgtaacattcaggctttgtcacgatcacgatcagctctcttgcgttcatgaacatctgaactgtgagtggcatttccttgttgcagatactatgatgaaatttgcgacgtacgagaacatcgtggagatggcatacaagcatctcatccccacaccgaaggagcaatgcagcaagcctctgcagcttggagtcagcttcgggagtggctacattgctggagtcttctgcgccgccgtctcgcaccctgctgacaacttggtctcgtttctcaacaactccaagggcgccaccgttggagatgtaagtctgcaccctgtagaacggcacagccgggagctatacttgacttgatgcgttttgccaatgtgtgattgttttgtgttcgtttgctgaattcttatttcttttcaggctgtcaagaaccttggcctctggggccttttcacccgcggccttcctcttcgcatcctcatgatcggtacactgactggaactcagtgggtgatctatgattctttcaaagttatggttggcctgtaagtctatctgaacttctgcacggtattttctcttacggggaacatttctttgtaggatttctaagagattgtataattttacaggccaacaactggtggtgctcctgctcctgctgctatcccaatcggagaactggcagagctgaaagcctctgcttgatcttattgtaacattttgtatccatatttcattatcaaaatacggattagtagctgggtgatattgttttctctccatacaaattgtaacctttgggtgatattgtttttttttcattgtcccatgcaaatagtgcaccaccataatgtagacgttattaattagtacttggtgaaaagtcaaaaataataaatcatactcagaatagttcaaatttggattgaattgactttttctctctgtttttttatttgctaaaattacaaaaatgcaacctaaaaggacttgctaaacttggtttacaatgctatatactccatatctcagctatatttcatagaaagaatttgaactttccatttcaattgatggagaaagggacttctatgcgtgaaaacgaattgtagtccgtcaataaaactgacaatgaagggtgaaacataatcttgtgaaaggagggccagactaaatggtttctggtaggaaaccggtgacccacgaagacccagcccggttacttaataaattgattcatcgctaagtatgggaggtgaatgagataaatagagggtaggaggtgatggggttgtacacttgtgaagaatagaatgaatgagaaagcataccacacccttatatctttgtatcttcctctgtattcatgatatccatccccatttaaaccacgtacataacattagggttacataatagtgtccaaatcatcaaaacagtgtgagtaatcctgctttaaagtcattgtgtaagtacagtcaccgatggctttttttgggtgagaaacgggggcgttgccaggcttagggtagctagggctcaagccctatatttgcctccaaaattatggttaaattctcttaaatcaccatgagaatgtgataaaaaaaatgaataactcactagttaattaagtcctaccttaactctactctttgataatacctgactccgccgctggtgggaaagacatgtcatgatctcatcccccttcaaaaagacaaaggatatttttttggcacaagttatctgcgccctttcaatgcctgttgaaacgcacacaaattcatacttgtggataaattaatcggggcatatttaaatgatttaattgagtaaggaaaatgccaaggcatatttctgagtgcatctttcttcaccagttttgtggtacaactctttcagccaggtctttttttcgaatggtaaggccgttgccgacgttttatattaagaagaaggtgtcccattttaagaagcaaacgagaccaaaccttacagggtccagttaattagggaaaactgaacgaaaaccacagctacaacaccatgctaacaactaacctaacctaaactaccacgacggagcccgacacaaggcatcggccaagcttgtcacaatggtgtacaatagcccacacatgttatcgttcaattttgtggtacaactctttcaagttttgtggtacaactctttcagccagatcatgtttcagtttcttttcgcaagtttgagcttcgaaactttcagattgggcagcaataagactttcagctgattcttaaaaaaaattataatttcccatcccaattgttggcaaaattatctttttatagtgcaagtggaagtgaacaaacagaatgactcgtagaaagaagtcgaataaagagttggaatccatttcaaggaaagaagcacatattttaagatgtagtggcatctgtgcagtcaacatttcaaatgaaaataatgactttgaatttgcctctgcagatatattcactgtaacgttattttattgtttttcctagtccataagtatattgtgaaacaaaataatattattggccatggccaaaatttaaattttgaaacttaatttttagagaaaattttaggtttttttaatgtggttttctttttcgacattagcttttaaagcactaaggacacttaaaaaatttaaaaaatttccaaacagcatatgttttggagtccgag

SEQ ID NO: 64756 - DNA, 3084 bp, Oryza sativa
aaagtacggcgtattattagcatttggctaaaagatagggcctaactattcccaatgctaaaggccggataaattaatttgtgcatttcctatatcaacactggtaagtagtacgtactcttgtactcttcttttcgttcacccaccgaactctctttgtattcctgtgagctagagcattatttttctttaaaaattaataattattcgtaccattttttacttctatagacatgaaaataaatcaaatatacgcatacgtctccaccacagcacaaaataatacttgcaagattcaacgtacaggtggattttccttagaaaacattggggggctgctatatactggtataccgttcggacggtataggcccgcaagcaatttagccggacgattccttccattcaattagtatgtctgtcatcgtgtctcaaaaggtgtgtcatgtcaccccatcgtttgtcattttgtccacgtgcatacgcaaaaaatcttcatgtgatagctaaactagttcagtatagcaagtagtagcctacctagctaccaggtgtcaaatctgatactaggtaggtatcacatctgataccgggtgagcatcaagtctattattaggtattacgtctgataccgagtgggtgccatgcctcataacaggcatcacacatgtctgataccgagtgggtgccatgcctcataacaggcatcgtgtgtgatatcggttggtatcaagtactagataactggatggccaagtatcatatttgatacatagtgggatcggtctagataaacgatacctggtggttatcaagtcctgatatctaacaggcatcatgcgtttctgccacgtatcaagtgatacttacgaggtatcatatgatacctatcaggcatcatgcaattcttaccacgtggtgggtgatgcttgcgatgtatcaggtcctaatacctagccagtatcgggtgatacctatcaggtatcatacgattctaccacgtatcaggtgatacttgtgatgtatcagatgatacctatcgggtatcatgcgattcttaccacgcggtgggtgatgcttgcgctgtatcaggtcctgatacctatcaggtatcatgcgattctaccacgtatcaggtgatacttgcaaggtatcagatgatacctatgaggtatcatgcgattcttaccacgtggtgggtgatgcttgcgatgtatcaggtcctgatacctagccggtatcgggtgatacctatcaggtatcatgcgattcttatcatgtggtgggtgatgcttgcgatgtatcaggtcctgatacctagctggtatcaggtgatacctatcaggtatcatgcgattctaccacgtatcagatgatacttgtgaggtatcagatggtacctatcaggtatcatgcgatttttaccacgtagagggtgatacttacgaggtatcaggtcccgatacctacccggtatcaggtgagacctatcaggtatcatgcgattctaccacgtatcaggtgatacttgttaggtatcaaatgatacctatcagatatcatgtgattcttatcacgtagaagatgatacttatgaggtatcagacgatacataccagatatcaggagccaggcactaaagcgtcgtcgccggtgatcccaccgtccacgtcccacgccggagcttatcgccggcggccacatcctccaccgtccgcgccacgtcgaagctcgtcgccggcggccgcgtcctccgtcatccacgccccacgccggagctcgtcgccgacggccgcatcctccaccgtcgacgccacggagctcgtcaccggtggccgcgtccttcgtcatccacatcccacgacggagctcgtcgttgtcacaccctgaagtttcccccccccttttttttctttaaaaattggttaaataaattgccagaagaaattatcttaagtaacctagagctaaattcctaattaataaatgcatttaataatcgaattcggcgtggtggaatttttcttgagttccccatgctccaatacattaacatgatttttagtggaattttcacagccttggaaataattttaaccaattaaaattgagcaagtgcaatatttttaatcccaggaaaatcctttttctctttttcttttcttttccctcctttttctttgttgggccgtcggcccatccctctcccgcggcccctcctccttgtgggccggcccaagccgcccctccctcctctctcgggacaccgacaggtgggccccacctgtcggtcgtctcccacctccggccgttggagccggagctccaaccgctgccgccaaaaccgccgcgccgccgcctcctccgctcctcccgcgcccacgccgcgtcgctcccgcgtcctccccacgtcgccgccctctcccccgcatctcctggcccgcgggagcgctcgcaaggggcaggattcgaatttgaatcccccccattctctctctctccaccccacgtcgccggccaaaacggccacctccccggccacgtccgccccacctataaatcgctccccgcatctccctctctcgtttttcgcactcgccgcgccctcccgtgcttcctatcgtcaccgcgccgctcgccccttgcgccgctgcctaccgccgtctccggccacgcgccgccgccactatagccaccgccgcgccgcgcagtcgccgccgtcgcgctcaccgagcccgcccgcacctcggccgccgcttggttgccgccgaacaacgccggagcccttttctcctcgcgcgccggtgagaccttctctcccctccatctccggccggcaattcaagccgccgtggtcgccttcccttcccctaacccctctctgctctctcttagggtgccgccaccgcccgtccgcgcctcggcatcgccggtcgtcgccgccgttttcttccttcgcgccggtcgccgtgctcgccggtgaggaatcccctctcctccttccttccctctctcccatgagcgccggcgccctccgcgcgtgcgccgtcgtcttcggccgccgccgccgccgccgccttcgcg

SEQ ID NO: 64757 - DNA, 2232 bp, Oryza sativa
  unsure (1)..(2232): unsure at all n locations
nnnnnnnnnnnnnnnnnnnnnnnnnnnnnnnnnnnnnnagaaggggcgccacccgccgtcctggaagaagcggcagcccgccgccgtggaggcggaggagcagcgcaggccgagcgacgcggcgaggctctgcgccacgtagccggagtaggacaccgtgattcggatcgccatggcgagcaagcagaggagccgtagcgggatcgagaggagacgaatcgagtagcccccggaagcaggcggagaccaaaggcgccggccgatcagatgacgggagaacgccgccgcgaagacaaggtgggaggcgggggggtttccggcgagggagacctcgccggcggggaggtcaacggtggcggtcaacggaggaggcggggaagaggagctgcgaaagcgagtacagaagagagaaggtgggaggcggaggagacaagtgttttttatagacgcgtggttgttcacctcaccgtttcggcgtttggtgaggtggaggccagaggcccttgaactttggagaaatgattttggagttcttttacatattcgagaaaattggaaatggatttaccggataatttttgaaaataaaaaaaacagaataaagataaattagttgagtggtgatggcactgtggttggcttgtaaaaaaacgaagtgaatacgataaggtgcttctgttagtttcatgtgtcatgaagtaatttggatgatagattggagtaccatcaatgccctacgaaaacggggttacggttaagaggggcgtatgagaagggagacgttgagtatgcacaataaatttaggtgaaatgtagaatattgacgcaagccgaagagtgtggtgcatagctacatcctttttaccaaaattttatttaaaaatgagttgcgcttaaaggtaaagagtgggacaataaatatttaccaacgacaataagatatctttacataataattctattgaatactatcaaatttttacccatacgttttcggtcaacaggtcagaataaccgcaataaacacgtggctatcattagtactgtaaactgatatttaccacacatattaagatattttaccatttttaatactatcaattttttgtttatacgttcataactcgaaataaccgcaacaactaagcagttatcatcaatattgtaaaccctgcggtggactggagcctagagactgaattcagaatgcaattaggttaaaaacaccgccgctggcctgatagggattttatttgatctatcgattgagaaaacaagaccgtactccaaagcaatcaaaaaagtcaaaatggacgagctgtgtccctgcctgctgttgccatcgaacgacgccgtggaaccgtctccgttcatcccctgtggtttgcgacagcacaagcagcttaacgccactgaaataatcgcctcctgcacctaaaagaatatggctaatgctgacctatttctacatgtggttagcttggatgcttctctgaaacttccactgtcacggtcgaaggagttgggggtttcagtgattgggcaggacacctcatagctcggtatggaaagcaaatccagtagtttattaattttcagatggaacagcgagtgagtttcttccttgcagtaacatgatttggaataaagggatctgtattcatatgactgaaagaatccatcctctccgtccaaaaaaaaataattcaaacccgggtttgaatctgaacacttgggtttggttctttatgaaacagagtagtatatatgagatttggaataaagagcagtgtgttcatatggctgaaagaatctatatattatatatagtaagaactaatagctcaacatcattgatctacatcactcaaacaaggatcattgttagagagccataagaaggccccaattgatgtgaaactgatgctaaaatcctttaattcttttctatatacatgttatttatctttgtaattatgatgcatttatgcagttttaacttttagtagaaagaatctcccaagtgattgaagagttcatgttcttcaattttcttttgttcgtactctttttttctttaacttgcatgtatttttaaagccatttatccatatataatcatcctgtagcgacgcggggagtgctcttttaacttggataagagttccattcaaagatctggatcagcgcgttcacataactattgccgggagatcttgacttttttaaaaa

SEQ ID NO: 64758 - DNA, 17244 bp, Oryza sativa
  unsure (1)..(17244): unsure at all n locations
agcttcatggagtaggtgccgtgtgagcttcagataaatcatgcagatttcttcagattatgtgggaaaacaagactggttcggtccgctagctcacggttgaacgttgttcatgtcaagatgatgatgctgcaggtcagcttaattcataactgcttgtattgatctttttgcctaattttcagcttcttggtggtgcatttgttcagcttaattttgcagatcggggtgagtagttggggtggtgctggtgggtagtggatcatggaaccaggtaacacggactcgctttggtgagttaaataaatgaattggagattagtctgacctgcaagccaattggactagttatgcatttcaaatcttgagactttttgactgttgacatgtacagatggataaagagggggctgaatttgagctattctgttggtgtggtttgacatccaggcttccagatgaactggttgagtagccttaattccttgaagaggtgcttgcagactacattgaattctggagttggacaaagggaattttcaatccttccctattactagcactatattcaaaggagtagaatatactctctctctctctctcttttggcgaggaaaggagtgaaatatactgggaaccatgtaaacaaatgtgtatctttttttttgacataagcccttagttgtcagtttgtaattgcttttaagcagaggctatggacatgacatgagtaccagattagtagtttgagctaattttctttgcttaattatgatagctgtagaacagtaggagtacagtactaagtactgtagttaatataagcagcatcactccagcccgtacaaactcaagactcaagagggccaatcaggaggcctgatcattgcatcaggatgcggactcttgggaacggcacttgtcatgggagaaaaatatggtcttggagactgaaaccgtacgtacaatacaatactcacctgtgccattcttttatatgcaaggtcggcaaccaacgcttcaatcataatacaatttcggcagacaaggttagcatggtacaaccttgtccatatgcaaaccatgcagcgacagccaattttttttccaaaacgcaaatcttgtctactagtagtactgaactactgatagattttgatcaattcaccatttattaaagatttaatcagacgatgccaaaacaaagacagcgtgagttcaccgtaccggtctctttctgagacaaagaaaaatgaaagaaaaggataaaaaaatgagtaaaacatgcatggagccatggagggagggtgtgaagtgtgaactaggaaaaagattggcatcaagagaatatgggcacatttaagcgtgcactgcctcgtgtgaatgtgtgattgagccattgggtgagttggttcttttgtcgtgctacgtttctttgatctcatcatctttttttcctaactgttttagttgccccggtctgcaggatggtcaggtgaatggtgctagatgttaacagcagcttcagaattgcgtgcaccgttgaatgtaacaagtgatgtttgtttcacctgcagaaccagtggctcaaggaggattgcctgagcctgacgatttctgaatagcccctcatgtctctttcagaaatccaaaagaaaaaaaaaaacttctggtgagaagaaaaattacccgaaggatcgtgaattatctcagagatagcatgtgatgactagtagtccagactccagacatcacatgtcaatgcacatgacaccagagaaaacagttaggtaaaagaaagtgggttagtgaaatcacagattcacagtaacagtcgtacctccagcaaaactgtaatgatataattcatttttttgaccacttgcaggaagttagaggcatgaattttctgctgttataaatgctttgctttaatcactacagttttggtggattagtgaaatggtaggtatagaaaacaacttgagcaaataggggccgcagattgctacttaggctacaaaagtgtaatggcagcaaatcctgaaccatcatattcgcttgcacagccaaatacaaacgacaatagagatgaagtcactgacaggataacactatcgctagaacagtacatgcattttgaatgcaattctgatcaggcaaattattcaaaattcaatagccacatgtgattgctggcatcattttttcctgagctttgtcttcatcctctcaaccgcggctctcagcgtctcatcatccttgcaaaaggtgaacctcaccaagttcttcccatcctcagggttgagataaaatacactaggtggtatggcgacaacaccgacttcgcgaatcaaatactcgcagaactcaatatcattgtcgaaaccaaatggggtgtggtcgaccatgacgaagtatgttccacttgaaggatagacaatgaaacctgcatccttgagtccgttgactagcaatgccttcttagctccataatccctcctcagttcctcatagtagctatctggtgctctcagagctgcagctgcagctgcttgcattggtgtgcaggtcgcaaacgtgaggaatgagtgtgcctgccttacaccccatgtcaggtgtggcggtgcgattgcccaaccgatcttccatcctgtaagagagaatgtcttcccaagagagttcatggtcacggtcctctcatacatgccaggaatagaagccattgatatatgatctgcctcaaaagctaacttgtcgtagacctcatcagcaaaaagcagcacatcattttccttgcagagagtggcaataaactcaagttcttcccttgtaaacattttcccagtaggattgtgcggggtgtttatcataatagctctggtgttcttcgagactgcagcctttagctcttcaagagggactgaaaaatctggaggacggagagtaatggcttttacgttggcaccagccattgacagggtagcctcatatgaatcatagaatggagcaaacaatatcacttcatcgcctggattaattagacctaaaattgttgcagctatagcttctgtgcatccagatgtgacagtaacttccttctccggatcgacttgcagtccgctgtccttcaggaatctttcagcaatagctgagttcagttcaggcacaccatatcctcttgcgtactgattcttcccagcattgatagcttgaatagcagcctcttttacaaagtcagggccatcgaaattcggaaaaccctggccaaggtttattgctccatgcttgatggcaagcatactcatctgtgtgaaaatggtcgtcttaaacttttccaaccgctttgcaacctgcaatagagaggaatcaacataaacctcaagggtatgtattctttgactataattatactgattaaacaatgcatataataaattctgtgttactcaaaaccatacaacaatacgtacagacaattccctatttgtttggtatattaggactgaatttctaaaagaaaaatattcgattcttgtcaggcaggtttcaatgtattgggcactggacatgaaattgatatagtgtgttatacagtggatattggttgaccatagaaatcaccaagccaacatggaatctttatcttagattaacaaaaacatattatccaacctcaggatttgagtcactggtctaactactcttttgtgtataagttggtgagtatacctaggaccactgtctggcagctttagctcaaaacccttactcagaggtttgggataaaggattggtttcagattgaatctccttctcttcagctgtcccatgtcatagcactgcttgattcttatctcagtgcacctgtttttgtaatctcttttgaggtggtgaatcaaacacgttcacaaacatggcatggaaatatggttcaaatgttgttctcaaggcgggtttcctaaggctgcgaacccagaacaaaaaaaaaatcaggtgtccaatacatactaataagctaattattgagtaatattgtgattaaggtagcgtaacacagtgagaaatggccaagctacccggtgtccggtgcaccagggtagctgaacataggactgcccctgataaggcatcatactgtagtgctagtgtgccatatgcctttggtagaatctcacaggagttttcaccctaccttccaaaaaggaaaaaacaacaggctgacaaaaagttacaacgatagctctaacttcgaagtggattttaagagaaacatacatagttctcactggaataatagaatatggcatgtatagggaaatcaatgagctgatttagtcagatattcagatgagtaaaaggtagcacaagaatagccaggttattgaacaatgtgaatggattgtgaggactaacatgggacctcagtatacagcagaagtagatcatacaagcatatttggacagaagaaatgaggaatactgtagcaatggcatgtaatatgggtgcaaccatcaagaatttgatatcttgaagggaacatgccaccccaataaaaccattcagtcacaaccagctaaatcaaaacttaaaaaagtgtattacactattatgcctaaaccgtatccctttcttatgttaaattctgcaaaaataatccaaatcatgattcatgacctctttcaaaaaatagaaatatagggatggtgctaatcagctgcaattttttccacaggaatatacaaataattggaacattaaactatgtaaatttagtttaacacattcttttgactaatgaatgagagagaaactacactcaaccataatcaccaaggtgttcttgatgttgtaggtttctgcattttctttccccaacaaatgtaggagtacattgttttctttctagatttctgcaacatatttttttgagatcacaaggtcgatggctagacccatgttcatccacactcctggaatcatggaggctgcggataaattacgacctcacggagtgtgactacaaatctacaacagagtgttagtgtacgtttccccagggaactcttactgtaaccccagggcccagggtgctctgatgagaatacaacactaaatgtagtattatcaacacatacaaatgtaatactacaacacatattaatgagcaatgactacccttaagcagttatgcttactacgttagcaacaacaaaatctgtgataaatttctcccaatagttatgctaagtcctaaatctgcaggatacgcccgaggcaatgcatagcattagtaatcagttaatcaccgaacctaacttcaactatcatctcaactacaccgaggttatcctgatcaacacttccaggaagcactgccagccacaaagctacacatccaagagtacgcaagcgtaaccacacacgacactcccagtaaaatctcagccacagaaatctcagaaccacagagggagacagagagagagatagcaatcaagctaccagtgggggggggggggggatcgcgaattcacctgcacaggctgctgctgctgcttctccgccgccgccttggcggcgccgttctcggcggcgacggtggacgcggaggccatgggggagagcgccgcggccgccgccggcgaggccttccggagcgacgcgacgagcgagcggcggagcgaggagaggaggaaggaggcggaggaggagggatttaacggcatctcatgccgcgtcgcggtcgcggtcgcgggcgtggcgagaaagccggccagattcatgaggggggccgagcagcagcagcgggtcgagtcgcgccgccacgggtgggcgccggaggaggcgtcgcgaacttggcgagacacgcgagaccgcacgcgtggcgtgggtactagtacagagtcagtgacgagtgggccatggaaatcatggagcccgcatgtctgtgagttaaagggtggggtttcgcgtggaaagtgtgcgttcgaatatgcccggttttttggaagtgaggggagatggcactgcaaagtgtgtgtgtggcatcggcgtgcgtgttgtcatgtgccattgaacctggacatgtttttttagtggaccggagcgacttccggcccaatcaatttgctctcttcatgggccggaaagcccagaacaaatcgcctaaccaaaaaccctcacctaaacctccaccaccacaagccgctctcccaaccggcggcgactccggcgacccccgcgccgccggcgaccgcgaccatgcgccaccaggtaggccttctctcccgcctcctcctccggcgccacgtacaccgccgctccaagccggccaccgcgccacccccgcccccgcccccgaccccgccgcggccgccgcagaagcccgagccggtctccatccacggggagacgtggcacgacagctacgcgtggatgggcgccctctccgacgccgccgccatgcgccacatggacgtgcacatggaggccgaggagaagtacgccgaggcctgcctcgccgcggcgggcgccgaccgcctcgcgcggaagctccagctcgagatggcctcccgcctcgcctccgacgcctgcacgccgcccgtccgctggggaccctggctgtactaccgccgcgcggacgagggcaagcagtaccctgtgctctgccgccgctccgcggcgctacacagcgagttcatctcgtatagcgacccctctgccggattcgacttcaccgccgggaagcgcatcgagcagaaattggtggattacaacaaggaggccgagcggttcggaggtaaccaccgaaataaaattgggattgacataattccatttcgtcttaccccgtacataataatctgattactagcgctctaaagttagcagctgtttatttaagtttttttttcagtgaatctccttttttataagtatatgtaattcctctacttggctatttaccttgcaatggacaatacctaagcagcgtgttccacaatattttgctactgcaatttaattctgagaagtaattaattggttttccattgctatttttcattgaagttatagtatttattcagtttaccttcaaagagtagggttttttttttttagtaatttgtaagcttcgataacatgctatgcttgttagatattctttacctgcctattcttgttaccttctcatctttgatagttcaccctgcggactatgtaggcacttaaagtttagggccttgtaaagtttgaaagttgttactgcttagtattaactatttttggaagattataattgcataattcttctttagttgatgtgtcacatattgttgtttcctaaccatgaccacaatacttgattttgtcctgactttgaaatttctagtgctattatgttgtcatattactctactattctggtaccagcttatgacctacgagtgtaccaatatttacggttattaagcaccgagtgaaggctgggatattttaaaaaacaggttgctccccagcttttcaattgaaagttaaattaagaaggctgagatttttttttgggatatacaatcttttatgggagatcgtgtaagcatattttggtgcatcagcatcattccaatgttccaatttgcctgtatgggatgttttgcaaaatagatggagacctgtatggaagttttaaaatttggtttacatactcttttggaacacatcactgcataatggagatatgcaatactacagttttggaagtagacaattgttcaatctttttagtcctaaagtgggtgctcagagtcagttaatcattttttcttggttatgtagttctaaaaagctatatcctatgcttcatatgcaggatactcatacgaggaactgtctgaagtgtccccagatcaccggttcattgcatacactatgtatgataaagataaggattccttcactttaatggtcagggacctagtgacaggaactctttgtgataaacctcgtgctgaccgggtctcaaacatatcctgggctatggatgggaaagcactggtttacattgttacaaatgaggataggaggccatatcggttggtggatctgttctctttttgctatgcatttttctctttgctgcactcaactatatctttaaattttgtctgtgtaggctgttttgcagcattattggatccagcaaggatgatgttctcatgttggaagaacctgatgagaatatttatttaaatatcagacataccaaggattttcggttcataacgttaaatgttttttcagacactcactcaaaggcactttttcttgtgcactatacctgtaatattgttagttgttcttctcttcactttctcatgctcgattaaccttttccaggtatatttgataaatgcttctgatcccctgtccagaatgagattggtttgggaaggtgaatcccaagttcattgtattgttgaacaccatcatggacgcctatatttatttactgatgcttcaagagaaggcacccctgttgattctcattatctaatgctgtctgatgtggaatctcctgggccgaagagctggaaggtgtgaagtttgccatattaaattagtctactctgaatgcacacatcagctcaggattagttcgcattagtgactttgtttaatctatttgaaccattttaatgtttgcatcaggatgtttttcttgaagaaccaggcgttattcttgaagatgttgacttctgtgatactcacatggtgcttgttctgagacaaggcagaaagctgaagctctgttcagtaaagttacctttccctgaacacatcagagtaagtcaattgttgttccttatctatatacaattcaagctgagaaaatttactccttagttcttggtggaattctatacaccctcacagtctgctgctctggtgttcgatgataacattggaaatcttttctgcttatttaattaatgaaatccacagttattttgcctattggatgcttgatactgtttttatctttggatacttgttttccatgtatcaggtacctgctcgtctgtcagatttccatccatttgacttgtctcttccaaatcatgtgtgtcagattttacctggcccaaattacgattatcgttcctcaacaatgcgtttcacaatatcatcacctgtggtatggacatgtgttatttatttatctcatcctctctagttcacttatgcaccttttgtggcttttattcacaaagccataaaaagtcctgttgattagaaaatgctgagttgctttacttgcactttttgtgtgaataacatcctttcttctccaactttccaatctataagcgcatcccttcttttttgttgagatgacttcttatctacttccatggcttattacatttttttttctttgctatgttgctcaatcatttgcatgaatggtaatatgaattagctctggttattctggaatatgttcttgaagattctttttggttataaagcaacattatatgtggataatgttatgacagaggaaatttatccttgaaacataaattgtttggttcagcctagtgctttttccttacgcacttgtaacattctcaatatcccctctgttttttgtgcttccctctttatgtcagccttatcatgttacattttcaactgcattattgtgtttttatttggaatttagtgccatgcctttataggattgttaagtgataacagtttggtatttctcatgatgttacagcaatctgcttgcaatgtgcattattaggatatttagttgtgcttgcaatgatgtcatttttttttgtatcatagcactatattttattagacattggctgtggctcctttacttatcatgctctagagaactctaatgaattaggattatattcatgcttgttgatgcattcttttttggacaactttatgatcatgtcattttagatgcctgatgcagttgttgactacaacttaccgaatggtaagtggcgaatagtgcaacagcaaaacatgcttcatgaaagaacgaaagcactatatgggaatgcttttgctgctagtatggttaagccatcttcaaaaggaggtgatttgtcaagtgaggactttggagattgtgattggaatgaactctctgaatactatgcttgtgagtactatgatgttccatcaaaggatggagttttggttccacttacattagtatattcgcaaaagcacaagcaagagggaaatccagggttacttcatggacatggtgcttatggtgagattctggataagcgctggcgcagtgagttaaagagcctacttgatcgtggctgggtgattgcatttgctgatgtcaggtatgcctattatattttgttaaattgaacataaccatctcaacctcttgaaataactgacaaatgctagctcaaagctgtacaagtacgagaaattgtttatacatttgttgcatcaaggaatgtatcagcttttgtcttctgaattttgacgcacaaataattgtgtcaacataacagcacatcttttttcaggggtggtggaggttatgggaagaagtggcaccaagatggtgcacgtacaaaaaagatgaattctatatatgattttatctcttgtggtgagtttcttcttgagaagggtatcataaaaagaaaataacttgctggatggggatatagtgctgggagacttctggtggcttcagcattaatactcggcccgatttgtttcgtgctgtcgttttgaaggtatttatgattaactgattggcttgtgtagaaatcattagctgattttcaagattactttcttattttctagtctatggtgttattcatcaatgcacgtgggaactaggaaggattttcaagtcattttgtcattatatatgtttgccccaaatcaaaattgttctaaattttagaacattacaattggtttaaattgctgcagattggcatcacaaatagttcacatagtccacacatcacgaactcttcttttatgttgtttctttgtcattaaaagatgtgacagatgaaatcagttaatgaagcattttaagtaacagattatccatagggaactttgtgttatcaaattcttcatcaagtttgggattgctgtattagttatcctttccctgtaatcttcagtttgtactattaccactgatcttgttatttataccaatggcccatcatgattcatgacttacattttgtcccccaggtccctttcttggatgtttgcaatactcttctccaccctattctacctcttacagctattgattacgaagagtttggatttcctgtggaccatgaagagttcctttcaatcaggaagtattctccttatgataacatccagaaggatgttccttacccagcagtgtttgtgacatcatcatttaatacaaggtacacttttctttgtgggtacttactacccccatccccttctgaaacctctgcagcataatgcacaatagctcaacaacttgatatttttttattttatgtatgacttactactttctacttctncgttcnnacaatgtaagtcattctagcatttctcatattcatattgatgctaatgaatctatatagatatatatgtctagattcattaacaacaatatgaatgtgggaaatgttagaatggcttacattgtgaaacggagggagtagcattgaagcttgtaatatttacaacataaccttagactagataaatagaaaagataactggctaatggctattgcaagtttgcttctgtagttctgttgtcctggacatgaatatgttttgtggttgaaaatggtaggtttggtgtatgggaagcagctaaatgggtcgcaaaagtccgagaagttactcgctatgatccagagcggcctgtaattctcaacttgacaacagatgttgtagaagagagcaagtatttgcaaaccaaggaattagcattggagactgctttcctaattaaaatgattcatgatacatgaacatcttgtttatctctttgaatttaaactcattgcccaaagatggggagcacatgttacaatgtcaggcctctcttttcagcaatagtctggaatcaactgattggagattatctgaggtaccacacttctatttcgtacttttttttttctcagaatgtcctgggggaaaatcatatgtgcatatccctacagtttatgagatagttgcacgctcacaattcatcagtctcagttatatggtctgatgatttggaagccaaaattcctgtctactggagatcgtctgactctgatcaagtctgtcctgtttgccttgccggtgcactacctctcggtgcttgagctgccacagtgttcgatcaaagagattaatagaaagtgtcgggggttcctgtggaaggggcaggaggaggtgagtggcggacattgtttggtggcttggaaagcggtttgtatgccgtttgaaaagggagggttgggtataaaaagcctggacttctttggcaaagcgcttcggctcaagtgattggctaagaagggtgagcagcaagaccggccttggacaacagttgcgactgtggagccgaaagatctgagagacctctactactcagcatcacggcaagaggtaggagatggaaaaaacacgaagtttcggcttgcggactggttgccaatgggaagcataaaatcgaggttccagttgattttcagccatgtggaacgcaccggcttgacagtggctcaggggttgaggaaccacaggtgggtgtgtgacatcaaaggtgcgccatctaatcgagccatcggggagtattttcagatttgggatgcagtccaggaggtgcaggtgcaagggggagaggaggatgtgactgtttggaagagggctgcaaatgggaagttcacccctgcttcggcttacgaactgttcttcatggcaaatacagaagcgagatgtggcagtctgatttggcacactagagaaccttccaaagtgaaattttttatgtggttggccgagagggaggtgtctcacggccgacaatctcaccaagcgaggatggccacaccaacaatcctgccccctctgcatgagcaatgacgaagattgcgagcacctctttgtctcctgtccttacacttcaaatgtctggagaaagatcaagggttggatcggtgccgggttccagctgccggcagagctcggattggaccttggagattggtggttggagtggtggcaggtctttcaaaccagccagaggagcgcatttgacactttagtgctgctggtctgttggatgatttggaaggaaagaaacgctcagagccgaacagcggggttcctgtttggcgcaattaaagatgaagcggcaatctagaaagaagctggggttttcaatgttttaggagagtaacaaccttctgtaacttgtttttcttttaggaagttgctgcgatggcaacatcctttcacttcgacagcctcttgtcgaagtctgaaacttgtatatgtgtaaataccccttttcttaagtaaatttggtccgcctatcttaggccggcctggctaaaatatggtctgatgatctgatctgctatcacgagggcagttctgacgtccaacaagtccacaacgcatggtatctgctaccaagtgctgcccatgattccttgttggtaaaatttatctttgttatgctgctaccattggatcattttcaattctcagtagctcatctacacaatgaaattgatgtttttttaccttcgtttttcaatcatggaattgatatttaatatctcatgtgctagatgatgcctcatgccctcacctgctcatgctcgtttccatgtcaagttaatagtactaccaaaatttacttatgctatgtcatatatgaaagctgatttgatataactggttgctagggggaacaaagctcttgcacacttggcttggagcattaaggcaattgcaccataacagaagcggaccaaaatataccttatctagttatctggctgcttgcaccacactattgttttatccttctgttcttaaaatctgcatcttatgactgcccaagtgatagctatgaccttgtgggtcaggtgaatttagcgtcatgaagtggatggaacagttggacactacttgaatgaccatatgtccctgctgatatgaaggctgtaacaaagcacaggttggaaatctgctgcaggttgtgacagcactgcgtattggaaattcagttgttagactttgctctaggatcacctaggttagatctagtcgggtggttctatttgggattgatgtttgaactatagagattgaaaacgggagagggtttagatagaccgaccggttgaggagttcgtggaggaagaggcgccggacatcgtcgttgtcgtcgcggcttgacgtggatgcgacgccggtgaggtcgacggcgatgacggctgcggcagtggtggtcgtagacgtcccggcgatgaggcgtggcgcggcggtggcgtttcccgtcactggctgcgccccctctcgatcggattagggttttgtggggtggagttgncgncgncggtgaacttcgtaccttgtgccgtgccggcctcccaccccctctttaatggcgcagtgtgacgggggcccaccagccattgggctgggcgccccccgatcagggcgcggtcaaggccctcttgagccgttgggctcaaggggagggagatctatctaacatcagttactgcgagatttcatcagatggaacttagagcttcgtttttgtcttctggttttcattcttcagttaatctgtgataaattgaacttctacgcatctcaatttatattagttatgagtatcaatatggtcctccagatactcttttgacgtcttcaatgtggatccgtgaccaaaccttcgtttttttttccataatggtaatctttttttttgaggacattcataatggtaatcagagtataatttttccttgtgaaaaggtattgctggtggtatattaaggatttgtagcataattgtcaccatgatttttaaatgtttcgagctacgtttttgttgttttggataatttgaaatagaaaaaggtgagtacaaaggagctttgattccaacctttccaaagtgaaatttaagcaaaatttgttgtttgggtattgcgttttagcttcatggttttagctgtagagatttttgtagaattggatctttggagaaatacacttataaattgcagcgtttttgccactacacaccgttaccaatattttattatattggcatggtgaggagtgaggagacgcgtgaaggtttgaaatacccttgagttattccaattaggccaagtgaaatgttattggagtatactcttggtacccgtctttgcgaggtgagcgtaacgctaaaataaatgttgggtcaagcatgtttagttgtagtcaggatgatatcattgctcacccaacgaagtgtaatggctcagtacgctcgatgagacaagcggtggcaaacaggtgtaggagcatgccatggcacacattgagcacctttgggaaatgacgcatgatctcggtagggaggtccgaatctagctctaccactgcgtggaccatcttaccatcgcgtggagcaaaagctgacaatgtgtgataaggactttacctcacttaaccacatttcaagtgactggcttttgctgcgccaactacatgtaaacctataaagtcagagtatgcattggtaaaaaatatctaaaatgtaatgttccttgcaaaataaaacggcaaaaacttacagtatgtagaaatttccttagtaagaaaacaatggaaaggacaaacgtgaaattcaattttgaaattcttccgacccgttttgcctccaggggtaaagccgtcatcttaacactgccctctcaaaccttttcggttttttagggtttaataactcttcgagcccaccgtgtccggcccagagcccactagcccccctcgatcccaccggcgacctcccgccgcctccgccggggacaagcccccctgcgcgccgcgctgcaatggcgttctccttcgcctcaccggcgccgcagaatccgttccagacgccggcgcaggccccgtccctgtctccttcgccgtttcagttcaacctgcagcagccgcagcagcagcagcagcagccgccgccacagcaacaggcggcgccggccgcgcaaccgcagcagcagcagctgatgctatatacgacggacgggaagcccgcggggtacaacacgaagtgggaggagcttcacgccgagtcgcagaaggcgctgctccagatcgagtatggtttccctccccggtttcccctattttgtggcaaatgagagtgcttgttcgtgattgaacttagtgtttaagcgtctttgcactgcaatttttttcttgatctgtagtcaactaaaattgctccatctgacttggtaaacgcaatccttgttggtatgctattattatttttttgttatatgggtatactagtcagcttaggccctagtggaatttgctgctgctgggttggtgataaggtggaaaagtagtttcttttttctgtctgtggtttagatttaacgctttatgcgataagcttgtgcctttacagtctctcagagatcagtttgctttaaacaaatatgttcttctagcaatatatactatggagggctactgtttctgatggtttagcagatcattgtttacttgggtttcaggggaaggggaaacacgttttgtgctctatgatctatgccatttgctacggattacttaagctactgcctcattttgcattgatgtggtcaatacatgggttttagggttagagagttcagtttctctgtttttgttacctgtttgggacttggcatgctattggtgtaatttttcactttgaattttgtagggataaaataagggagtacagggacgagagcgagaggttggatcagtgttctcgccttcatgactcttcaatctcaactgtcaattttgagaatgatgcaagtgaaattgctcaggttggacttgcttttcttgcttttgtcagtcgtacatgagacgcttgattatgtgagtcttttacccct

SEQ ID NO: 64759 - DNA, 1883 bp, Oryza sativa
ttttttgtggcacataggtaagcaggaacttttttaatggcataagggtaaaagactctgattatgttggtcctatttcgtaactgatatgggattttgtcagttgacagtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctgctctaacaggaacttggagggacaaccaccatgatggaaagagagaaggcttccgttcaagagttaatgactgttgtgaatgaaatgatgcgaaacacagaatttgctattaggtcatatatgatgctgagaccaagatttatccgtccaggtgctggagcaaatggtggtggctcaaatccttctggtcctgctggagctcagtccaatcagccagtagcattggctccaaccattgatttctatagtggtatcccaaagcggccttcccattttatgcaacagactatcaacaggtttgagaaatatcttggagaatgctgcaagtggatcgcggagctagagcagcttgttcaaatggagaacaataaaaggcaatcagcctcattagaatctctaccgaaggttatgtcgaatgtgcatgattatttcatctatgttgcttctaaggtaaatctcctttttcatacacacactgcagttgaactgttaaaatgcatttattttgaggttctcccccatgatataaatcatttattatgtaatatagtcataaaaataaatgtaaatctgtaagtcaaccaaattttttttgtaacagctgtatctcgtgaaaaaaataagagagattgcttacttttaggcttgctgcactgccttggtgcgatacccagtattttctaatgtttgtattttttttaggtggaaaatcttcatcaatatgt

SEQ ID NO: 64760 - DNA, 2990 bp, Oryza sativa
tagcatagcttttcagtcttttgtagaaggctggcgatgttggatactacgtcgacgactgacgaatgcgaactaaaaactgtatgcattttgtctgctttttagccttgacgctttggttagtttctggggtttctttttaccctctgaattcgaagcatgcgtatgtcgtttttcagcattggacggtccgctgttatagtacaagaaacaagttgttacattttgtattatgtttgttcctaaacgtttggcgccaataccgagctatcgtcaactcgtcatgagtttatttgcatcacctcgcactgactatcggatcttatactccctcattttcaaaatgtttaacaccattgactttttagcatatgtttaaccgttcgtcttattaaaaaaaattgtgaaatatgtaaaactatatatgtacatgaaagtaatttaacaatgaatcaaataatatgaaaagaataaataattacttaaattttttaaataagacgaatgatcaaacacgtacttaaaaagtcaatggtgtgaaatggagagagtacttcatgacaaagtacccgacactataccgtgaaattgtatctgccagtgcatccggatgtactgcaatttcctccctatttacatgcactctcacatgtgctcggcttgcatactcttgttctagtacagaaaactgcacattatgcttcgtatatgcgagatcgatcgatgcattgctgttcaattattctcgccaatatgtgcgaggagagaagacaagaaatacaattcctcagatacatttttggctagtcagagcatgtgcaacagtgcaagatgatgagaaatcgagggccaccaaagaaagaaatcaaagatgcatggtccattggtccatgactccatgggggttaaaaaggccacatgatttgtagcgcagggatgtacgtataaaaaggattacgctgcctttttctctccctctcgtatggttgaatctgaatgagtggtgcctgcaaaattcaggtatatgatgtggcccatcggtggccgggtactcgaatactcgatgcacatcgctgtttgtctctctctttctttctcatgttacagccatgtcgaagcaccgtttgtagagtccacgaaaaacgggaaaatgcagtgcggacagagcatgtcatctcattttcctcctgcccaaatcagttcggagactcattttcatctttgcccaaatcaggttagggacgtgacatgcttacccaataattgctgccaagtgccagccaataattaggtttgtatggtttaccagtagtatcacccatatgcctacgtttctagaacgggaggagaagaaggcctaaacaattcaccgatcgaggtcggcgcccccaaagtctactacacaaaagctgggagatgagacctcctataccgctatacagctactcaaaagctgggagtatattactaggaatcgtaaagtagtaacacgctgcatagtccaaagcggcgaattcgcccatggattcggctgccgccctgaaacgcccgcgcgccggcgccgcgatatgccgcccaattagccccatctaaccccaaccacccatgccgccatcggctgctgccgaaacgctcgatgtctcggtcgctgatacgtcgaacgtcgtcatacgtgcaggacggcgacacggcgtgcagcgcggcgcgggggcgtcgcggtacgcctcgcacgtctcgaaaggtggccgaggagtgtcccggatcgcggcatatatggggcgggcctgcctagcggctcgcaccgcacatgacgtgaaatcatcaccatcacgccgagtcgcgcggatgaccgggacggccggacggcccggatcggcgtacagctgctcaaggcccggggggatgagtggatgaccggttcggtttgtggctggtcgcgcggtttccttgggcatcaaggacctcccttccaattcaaaacagggtgctctttaaaatactactcctccataacaacgtaccaaaatactagtaccaaaacgtaccaaaacggaagctgtttaattgaccgtggaatggttctcccgtgaatgagcacccccgcgtttcttttgcttgaaggcaagcaacgacatggttcaagttcaacaatcctctgcatgattttctcgaagaacctgagcccgcccgtgcacgaacaaaccccaccgcgcgcgcgcggtaccagcaaaaccagttgttcccaaccctggtcgcgccctcgcgccgtgccgttcacgccgcccgctctctcgcgcgcgcgcacacacgtccaaaccgccatccaccctcgcgcgccaaaccggccgcaagccgccaattcgcccaatccacccatccgcttggccccgccgcggcgtctcgcgcgcccccggcccgtcccgtctactacgatctcgtccccggtcggtcccagccagccaggaaaaagcggccgccccgctcggcacgtgcccaaagctcgtacgcaccaccaccactcctgcaccccgcgacgccgcgcgacccctcccctccccgtctcagatccggaactcgtggctccccccacctccccccacccaccaaaacgctccaggatcggacggaccagccatacacctccgctccgcgaagcgcgaaacacccgccgggtcgcgttcgcgtcgcgtcacgtcgcgagtacccccgcgagacgcgcccccaataccctactactgctactgtaccaccggaaccgggcgcgagacgagacgagccacacaggtcggcgcggcgcgggggacgcacgcggagcttggtcacctcaccggcttccctctgtcctcctgcacggtagttataagaggcctctccgcctcacctcgcctcctctcctctcttctctccgctccacccactcctgctcttctgctctttgttcgatctgtgtgcgcggcggtctgggttggggggatttgaaacggagggga

SEQ ID NO: 64761 - DNA, 1959 bp, Oryza sativa
gacggccgcggctgccgcgctcgccgcggcggccggagccgcgcggctcctccgcgggcgcctgcggctccgccgctcctcgggatccgggtccgtgcagtggttcatcggtgacgaggacgacaagcctcagaagcgggacaaggggaaaggcggggcgcacggccgcgtcgtgcgcgagggcgtggagttctacagcaatggggactgctacgagggggagttccacaagggccgctgcaacggcagcggcgtctacaccttcttcggcaagggcaagtacgaaggggactgggtcgacggcaagtacgacggctacggcatcgagagctgggcgcgcggcagccgctaccgcggccagtaccgccagggcctccgccacggccacggcgtctaccgcttctacagcggcgactgctacgccggcgagtgggccggtggccagagccacggcatcggcgcgcagacctgctccgacggaagctcctacgtcggagagttcaagtgcggtgtcaaacacggcctcggcagctaccatttcaggtgagcgtctcgccaaatttcgtgctttattactccatcacagcaacacactgttccgtttcatgtcaactgttcgattggtacactaattactcctatttgttcacatcttaattatactcggtgagaaatttatgcatctgtatctaatttggaacgcgtgctactaaaatttctttcagaaatggtgatcggtatgctggggagtactttggggacaagatccatggatttggtgtctacagctttgccaatggccactgctacgaaggctcctggcatgaaggcaagaagcaaggatttgggatgtacacattccgcaacggcgacaagcgatcgggggactgggattcagggactctgaagaccccccttagtccaactgatccttctgttcagcgtgctgtacaggtatatatatacacattgatctaactatcagcttatgggttacaattgcaaattgcttgtggtgttctaatggttgcattgtacaattaggcagcgcaactagctgcggagaacgcgtttcacctgccgagagtagacgagcaggttcacaaggcggtcatggctgctaatagggcagccacggctgctcgggtagcggcgatcaaggcggtccagaacaggatggatgggaaattctgtgatacctatgtgtgagtgagtgtgtggtgaagaaaccatggctttccttccttctaactgtacattagggtagcgaaggacaataactaatcggttgaggttcagttcagacgaccggagcaagcacaaccgcttgccccgagtcagagagttcagcaaagaacgggagccgccgggagagcggagctgacaattttgtttcgcaaaacagctcagaatctgcaacatcgcaatcgcgattggcggccccccctttccccctttcttgcaagctgtaaattgtaaatagatccaggtgtatcaatgcaagagtgagctttttttcctcagtccctcttcttgccatttactgcatcttctatgttctttatttgcattacacatataatgtggttgcatctactactacaattccattgcctctccagtctaaatcttgaccgcttgaggttgtactcccatgtgcagtgattctccatttgcaaatggtacatggtactgcacatgggagactgtaaatttctttctggtcctgcaacttgtaactgtgattagtaggacccaaggtactattgtaatttgagcactctgtgttgcctatccattccctgcatctgtgcccactgcatttttttcaaaactcggggcgattcatagctttgggtccacttgctgctccagatttttgcaccagaaatatgaattctggtgacgaattatgcaagtgtcaagctggcacaatgcattgctgtgtgctgggactgg

SEQ ID NO: 64762 - DNA, 5420 bp, Oryza sativa
  unsure (1)..(5420): unsure at all n locations
ttcaagtctcagtaaattcataaaaatccctagaatccactaaaaatggatttgtttcctgtttcagtagtcttatagcatgttttgcttgtgtgctttgtttgtcacgtagatttcggccgtttcgtcgatccacgatttctcgaagacgttgctgtggtctcatcagtgcgagagcaaggcaagtcatgcattacaattgatcatattgtacccaatttacaaatgtcccgtatttctattaaatgttacattcttttacaatgtcatgtgggatgggtcctattactcagccatttattgtttaccatatgccattgataacctgggtatcaaaatgattagatgttggtttaggaaatgcttagccatgtttagctcaactagtacacaaaaagggatcacattattacatagactttgtctactagcatagctttggatttggtgccaccgcaatggtgttagttaattaaaatacactgaatggtgggctgtggtgcatggttttgctggtcgcacccatggcagttaaggactggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttatccagctgccggattcaccgcggcgcaagaggggaccgcccactgccttttgaggggtgggggtgaaaccttagcgtggtgtggatggttaggggagggttatgtggaggatcttgtcacgatttccccctttgcagtatcatggtgatacttcggggcatggcgacatgtgtggaatcgtgtcttgtgggtacagttgtaaacctctggccagagtaaaactattcgaatagccgtgcccgcggttatgggcgatcaaccaaattcaccgtgattagtctcacccctagtttagcttaatgaactggtgtagttcaggtggttggttgggcctgttgcaacgtggtgtagcgttgaacagtgattggttaatattgattaatttactacaattgttttactactttcaactactgcttttaaatgctagctttgtccaaaagaacccctagcctcctttggttatatcctgcatcatacctcctcttccggtatgacttgctgagtacagtgggtagtactcagtcttgctctcttttcccccacaccagagctaaagatttttctagttggagctatcttgttgaagttggttttgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcgtttgtgtacccgggctggtcctggacagggatttaatgcacattcagcttagaaattctggttcgtgaatttctgggcgtgacagtcgtcgacgggcgtgtccttcgtcatccacgtcccaggccggaactcgtcaccgacagtcacatcctccaccgtccacgccacgtcggagcttgtcgcgggcggccgcttcctccgccgcctcgacaagctagccaagtacgtgctcgtcgtgctccacgccaacgacgcggcgagggcagcaccttcgcgctctacttccacatctaccgttgcgtccgcgctgggctcctcctcccctgcgacggcgccagtgctgccggcaaggagctcgcggtcgcgcgcggggtagtgcgttgacggtgcgggcatgggcgccgtagcgccgccgcctatgtcagccatgcgtgcgtgctggagcggcaccgtgtcctgtacaggctgctactgctactcgggacatgcatggtcaggtatcgctcctctttaaataagcaagtgtcccgttcggacgggattccgatatgtagcattcccgaaaacatagataatgtataataaggacacacggttcatgcttgtcccactgatgtgtataattaaagccctactgtacacgtcaaagaagctcaatgtttaacccattctgtaaataattgtgttgaacctagtggatgaggaaaaaaaaactcgttctcgccgctaagccactggcttctcctcgtttaacgggtgtctttaagtacagggaaacaaacatctaaaaaagaatgcaatacttagtgtgtgtttgagaaggataggattgaggagattaggaagatacgcaaaacgaggtgagccattagcacatgattaattgagtattaattattttaaacttcaaaaatagattaatatgattttttaaagcaactttcctatagaatttttttgcaaaaaaacacaccgtttagtagttcgagaaacgtacgcgtggaacacaaaactatctttctctctttctcctgcactcgaacgcgcagccttagttttggtatgtaaagaaagattacaagtgtatgccgtttatttatctctgttttcttttcctggttttaagtacagtttacagccttctctacttcccaaacaaatgtaccgggcagatcatatatacttccttcgtttcacaatataaggtcattctagtattttccatatttatattgatgttgatgaatcatcaacatcaatataaatatggaaaatgctagaatgacttatattgtgaaacggagggagtactaattaatcagcaatcattttatcatctgtccatgtcaccagcttcaaagctaactttgtctaatgctctagtacatggacaagttggcatagttcttttaatctatggcagccattcttttgtgtttttcaacctgtccacacctcatggatcagttttctcttcttctttatcagatgaagaactgcagatactgccaagcatataaccacgggaggaaccgacgaaagtatgcagcattgcagattatcgtccagggagtattacgtcaggttaatcggttccatggattctataatggacaggtgtactgccacgtcggcactgcggacaattgtacagtgccacgtcatatgtgccggatgatatgcagctcggtcttcatagtgctatcttggtgctgacgtgtccttcagtgactcgtccaaatgcgagccaccaccggccatggcggtcaacgaacccggcaccggcaagggatagctcctgccgtagagccggaggaagccgagcgcctcgacccgcggctccggcggcggcacgctgccttccaggatccgcaccacggtggccatgctcggccgcagcgcagggtcctcgtgaaggcagcagagcgcgacgcggacggtgcgtgccgcttcggcctcgtcgacgcgcccctccagcctcgcgtcgacgaggtccaggtatctccgctgctcatggagctccagtgccagcatcgggaagtactcgtcgccgccgccgctcgtgccactcgccgtcgacgtcatcgcgctgctccatccggacggcaagtccgagtgctcgccgctgccggcagcgacggcgacgttgttggccggcgccgccgcctcctgctcgccgcggttcttcctcccgtgtatcagctcgagcagcaccatgccgaagctgtagacgtcggcgcggtcggagatggccgcgttgctgatccactcgggcgcgaggtacccgcgcgtgccgcgcatggtggtgaacagcgccgactgctcccgcgacatcagcttggcgaggccgaagtccgagatcttcacctggccgccgttggcgagcaggatgttctccggcttgacgtcgcagtgcacgatcttctgctcgcacccggtgtgcaggtacgccagcccgcgcgccgcgccgatcgccacctccatgcgctccccccactccagcaccggccccgtgcggccgaacagtgaccggtcgagcgagccccggttcatgtactcgtagacgagcagccggcgggaaccctcggcgcagaagccgcggaggcggacgaggttgacgtggcggatgttgccgatgatggtgatctccgtgcagaactcccgcttggcctgcacgccggcggcctcgagctttttcacggcgatgagcccctcgccgcctggaagctcccctttgtacacggtgccgaacccgccggatcccaccttcgtcgcgaaattggaggtcatcgttgtaatctcctggtagctaaacctcgccggcatgcccggtatgacgatgtcgtcatcgtcgccgccgccgtcgtcgtcagcgtccgcgttatagccggtgtccctggacggcgacttctgacggcccaagtacactttcatggtggagctcttgcccttctttttcctgccgttcttgctcatcttgttcctccaccatatataccatccgagcacggcgaggagaaggaacgccgcgacggacggcaggacgatcggcacggtgtggttcgccgacgacgagccgatttggttgctcccggccttggttgcggagttgaacgtcttgatgtatcccaggtttgtatctgatgcgcccttgtacagcgagccgagctgctttcctccgatcaagcggcagctcagggagacgctgtcgtggaagaagccgaggcaagcgcagctggcggtgcagagcgcgcgacacgccgtcttgttgacgccggtgttcgtcggggcgtcgaacttcgtggcgaagtaggaggtcagcggcttgagggcgatgtatgaaacggaggcgccgccgctgctactgtcgttgttctgacacgcggccggcgacgcgagcgtcgagccgtcccccggcgtgcacgagccggcaactgtcacggatgcggcgaagagcggcgggcacgtgcaggttgagccgttgcccgccggtgaacagtaaccgagggacgggcactgcagcgggaggtcgcagtcgccggctggggcgatgaagtcgccgccgaccggcgccgaggagttcacgagcgcgtagctgatgatgcgcagccggccgtcgctccccagcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64763 - DNA, 708 bp, Oryza sativa
  unsure (1)..(708): unsure at all n locations
aagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctactatagggttgcacaggaatatatagccattgttttcttattccaaagttcgccgtgacatttcacgcagaggtcaaatgccccattgagatcattggagctcagaacgacacactgacaccaccaaaattagtgtaccagtatgttcaggccttgcgtcataaaactgaccgggggagntcccctggtaaaattcttttcacggggtatttaccaaagctccccacaattatgccctttttgccccccggaaagggggaaccccttgttggtttcacaaataaaatattttattttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacggg

SEQ ID NO: 64764 - DNA, 8678 bp, Oryza sativa
accctaattttttcttcaacacaaccactcaataatgtttaagaaaagaagcaaattaaaaagtgcctcaatggattgcatctttgttgcaggttgattactttgccaggatctttccaggcgtgtctcatggctttgcttgcagatataacgccagcaaccagtttgctgtcaatactgctgaacaggctcttgccttaatgcttgactggtttgagaaatacttgaaatgacaatatagatattctattaaaaaaatgacaatatagatagttatttgtgaaaatgcagaaaatcgcacttattcattttcatctaaataaattgccggtgtccatgtataagtataaccagccatgtcaatgtgattaattggctatgattttctctgaattgagcttgtcgatgtattaactgctgaattgatcttcaaattcagcggtgggaattcaacccaacgcacatgcatgtattctcaagttcaaagttaaaactaatcttcaaatttgaacgttggaacaaatgcaagctgaaagaggggacttctgcagttggagcttagaaagttggaggtgaaggcgttgttttattttatttattttagatatctgaggttttcattaagcaaataaaagcatctatatgttcgacaccaaaatgtacaatcaaccaaaaaacacactcagacacacactacaaaaagaaatcagagtagcaaaagaccttacacaactatatcttgacttaaagaaactcaagtaagactaacatatataataaacacgccatcccaatggcgtaataatttcactttggtttttgagataaaaagtaaaagctatacttttttttcttacagaactcttacaaatgctgatgtgacataccgtgattaatctagattcaaagcgccgttactgaggtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaactgcttcgttgagcctcctgatcctctgcctcgccgcgctcgccgcggcggccggcgccgccgccgcggctgctccgccgcgcttgcagtgctttgagcacccgccggacatgaaggccgccggcggcggcgaggccggcgtggtagtccacgacctggcgggctacgaggcctacgtcaccggcgccgcccactccgaccgggccgtcgtcctcgcctccgacgtctacggttagtacgcacatatgattgcctgagctagctaattaattaagcactgatcagttatcactacttccatttcttcattccataatgatgattatggactgatgaaccgctaatttaattttaattgctgctgcatgtgtgattgttaatttggttcaactcctcaggtttccaagcgccgttactgaggtaaattttctttgtcatcctcctctttttctagttttcttttctagcacaaatcatattatttttttattaaaatataatcgtgtgagatcttgctgtaaatatttaattataacaaatacaacggtacgatcagatcgtttatatgataaataatttatgaaaaaaatagtttaaagatacgagaaggaggctaaaataaaatatatggaaatgagatataaagtgtgtagctttgcatgcgtatggatagacacctcttgcactagccaaaaatgcaacaatgtagtaggggagagcatctaatttttcaccataaaatcgagtgtcccatttgtagccacatcgcaatcgcacagaaagaaaattgacacatgaaccgctatagaaagagactgatttaatttctatatagaaagtaatggcgtggaaaatgttcattttttatggtaaactgtttttatttcaattaaatggaagatgcaccaacacgcttgcacaagtttctcattccaattaaattctttttgacaaatcctacttttttttttcttgtacaagtcagaagcaaacacactcacgcacatacagagacacacctatgttggtgagtcctatgagtatctccaacatactatccaaattatacgaattagactttttaaacactcatatagccaactcttcatctaatttgtcaagtcaaattcattactcacttcaacatcctctaagtctgtgacaatgggtcccatatgttgaccttcccacccttcttcacccatcctctctattcttctcttcttcttctctccactccctccacaccgctgccgctccccctttctccacgctgcggccacttcctcggccgagagcagcagccagcagaaccgggaggagctgggagcctaggagcagctgccggcgatggcagagaggatgaaggggaagggaagggtgcctcgagatggccaccctccgtgtcaccaccgcggcattccctggtgcatcagctgctcgtccctagcttcctccacgtcgccgctctgtggggtgacacgtgacggagggagggtgggacggtgatggcgataagggcataaagcaacggtgacgaggatgaacgaaggcggagacggtgcgggggaggaggcagtggaggccgtgggtgcggatgccgcggagcaactgctagtccgttaccatggccacaatggcggctggtctagctggcagagggatgaattaaggagcgatggaggtgggcgctggtctaggcggcgacggggtcagggttggtggtggtctcgggggcagcaacagatggtggtggtggtggtggtggtcatcacctgcggcagcaggaatcggtgtggggcggggcagggcagcagtgggaaccggcggggacggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaacgctcgggatgttcaacagaacggaaacggcaacagaatacttctcgggtgctggttcttttgcaacacccgggatgtttcagtactacagctcaacattcttcccgtgtgctaaccacacccaggaagtttcagtcctacagttcaccatcacacgggtagtagaaataataagcaatgaaatagaatcggtacaagcactcaaatattcagcaatgtaatacaatcagtgcaagtactaagcataaactgatctgtacaaatgttaataccagatatttgttttagttgcacacatacatattcaaacagccacaaccaatctatggaatacacacaaaagtaatgtttgctccttcacataggtagatttttttcgaacatcataagtaccagttcttgaataatatctgggagtccattggataggtaagaccaaaataacatgaactacatccaaaaatcattgttccagatcttgatgtttggatggatttctgtagcaatgaatcatggctggcaattggacgcacttgatctagatgatggctgaaaaattatagtgtgtcagaaggtgctgataaatattgtatagaatatattgccagataaatattgctatagcatattatgaaagtttaagagtgcacattgttagagattcatgcctagatggattaaaatcacaagcccaaagacaattaacagtacaaatgtcaagcatgccatttgtctaaccaagtggttcctacttgtcctgtacaaagagcccagttagcacaaaccaggaagaagatacataaagaactagattgaactatagctagcaactagatacatgcatcaaatgtagttagtcttacttcttaggtacctatatatgcattttacctatttagattaaactatgtgttatatcttaggcaactgtttacatattgaatgcattcagattatatgctttttcgaagatggaactatctggtaaaaaggtcattaatgttggtataagattgctcgcctaaatagacagtggggcatgttggggccgctggtcgtggaggcaaaacattagctttcatcgcagattgaagcgcctgaaatttatttacacatgacaatgcaaatagttaaatttatacatgttgatgaattttaaaattaataagtacatagaggaggcaaaactacaagttaccagctgtatcgcagatgttaagtaacatgtttcatgttggcaagccttaccatcaatgggttatttcatcaaatcaggacttgcaccatgcttttccttaacaactccaaaataagcttcctggatgataagttgggtgtttattcaaatgggaagagattaaaaagttgctgatcaaattttgtgcaagctagagtgcaactacttacaagcttacccttgacacggtcagtacaatagtcctctccatcttttccattcttccttgcttctgcataagcctcaaatatacccactggcctcttctccttcttctccttcatgaaacaaaataacaattggattattttaatctgtaaaatacatttcaagattttatgccaatatgtgaaaggtgatttaagttaccatgttcttttggaatcggtcaagtgaagcgctgccttgacggtgtgctggcccatccatcatttccctgtataccctaccttcacatgactcttttatccactcttcattacaccaatgcagttccgcacacaatttccatccttccggagtcttttgagcccaccaatacacaaattcagtgacaaaaaattcctcggattagtcaacgagtaaaaagaattcatactacaatgtccacttctgttgttctacgttcagcaaattaaaggcacaaacagtgcactttaatgaaaactagaatatctctctagtgttaagctgaaaaactaaaacaatggcaatacatcgctagtaatcagaagtacaagtcctaacaagtaaaaatctacacggccagataactaaaatgagaagcataaaaggaagtaaatattagccatatcacaatgcattaaacatgtcaagtttttttaccttgcttatgatctggatgaccaaatcactctctgaacaaaaaaaagtgaacggatatggctgggtgggaacaacctgcaaatcatcaaaatcaagcacattatatgacagaaactgaatcttcattacatcgaacaaaactagagggaactaaactgaggaaaatcagaataaaacataaataccagtgaagccgaggagggtagaggaaggcctggagatggagtatggctcaacctggtggatgatggctgaggtggggatgagctgagtgggggaagaggaggtccaaaggggtgacggcggaggcggcgatggacggtggaggcggcgatggacggcggagacggtgggggaagaggaggattaggcagggaggtgggtggaggagttggtcggcgttggggtctggcgtgggggagttgcgtggaggagttggcctgcggcggtggagcggcggcggcttcgtgcgcaggacggtgacgccgcggagtcacgcgctggcggcgtagttagggatttctcagattggggatttctcgggagagagatggagtccgaaaaaaaaatcgggaaacaaggaataaaaaaaaaatcggcgctctggggggatggagaaaattgcatatctaccatcccataagaatggcttcgctagaataccattatgaaaacaggcttcgctggaataccatcctcaaccagagtgtcttcgccaaaataccatcctggacggaaatgcccctggctcttcttcttcctccatcccgcgcgtgaagagctcgccggcagccatggccatctccaccgccgcgccgatgctgccttgccgacggcgattggggcgctgccctcccctgccatccccacctgcgcctgtgcagctgaggtcgtcgcggaaggactccggcgacgacgcgtggatcccgccggcgcgcgtgagccggtggcgca

SEQ ID NO: 64765 - DNA, 12763 bp, Oryza sativa
ggcagggagggagctagccatgactgctaggtgagctcttcacgcgcgagatggaggaagaagaagagccaggggcatttctgtccgggatggcattttggcgaagacactctggttgaggaaggtattccagcgaagcccgttttcataatggtattctagcgaagccattcttatgggatggtagatatgcaattttctcggggggatggggactcatgtacacgccaatattttcatctgacaagtgggccacagtatgttgcaacaaatctcacgttatcttggacggaaaccgttgccacgtatcttcccgggagttatacaggcatcccgtgtgcattgtcccacgcccaggaagcttcccgtgttctttgtaaaacacccagaaatactttttgacacccgggaaagtttaccatcctggtagtggtttttgggtatatgaaaaataatatattcaaatttgttgtgacaaaatctttcatatgatattacctactaaggggtgattttgatcttatagttgcatagcaaaaccttcagtccttgacctggctgagatgcttatggagggtaatggatggtttctgtaggaagctgagggtttccccctctgttttttagaaaattaagatgcatatcaataagtcaaaaggttgaaattgagtcaataagttgatattgatcagcatattcaattgaccattcatggcaggtgaaagaagctgaaaaggctaaatcaatatttgcttttctaagaaacgaaggaaaatcagtcgttggagttggaggatattgttggggtggtgagtcatattgatcaaacacaagaaaatgtatttatgtgtttatactttatatctatatatatcctaatctatgaatattatctaaaaaaatcttaatctatgaatacactcttgaaacttcctatccacattatactatgtttgatagaaattaaagtctctaaaaacatgtttatctggcaggaaagtttgctgtgacggtagcaaaaaccaatgaggtagaagcggttgtcatctctcatccttacgctgtgactgctgatgatatgaaaggtgaagttgaactttttggcgctatgcaatatttatcatttgatctaatctgtattatttactcatattaattattcccgttgataaacagaggttaaatggcccatcgagatccttggaggtcagaatgacacagttacaccaccaagattagtctaccagtatgtgcatgccttgcgtcaaagaaacgatgtgagttcttgtttgatttcgttgagcatgtttttgtctcgttacctttttttctcggataaaatcttcattttccactaaaagttgacacgatttctaatttgtccatcatcctctcaatcacatataggttaaatccacgtgttgatgactcatcgtgaataaataagggatttttttaaataaatcggcacatgcagcaaatttcattgaatagagaaggaaaaaaaaacttatgtatgttataataagggattgaaagctctgaacaactgaaactgaaatatttggcaagttaacgaggcgatcaatgtacaaggcacttgtaaatcaattaaaaaactgtggctttgacccaatttcttcttctagcatatacggtacagagtaacacaatgatattgttgttgttgcagattgatttctacgccaagatttttccaggagtttcccatggatttgccggtcgatataacaccagcgacccgtttgctgtcgaaaccgggaaacaagctctcgccttaatgctggactggtttcagaaacacttgaagtgatgaaacttaataaatactacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcggatagattcaaatgttacacagtaaatttggtcaaaattaggtcggaattcgtcgaaaaccaaaccgtgatacgatacgacggggcttgaatggccaaccggtaaatgtataaagggtaaattggaaccatgccattataattttgtaaagtttgagatatgccatcggtatctcaatgacatgtaggacccacatgaattaatgacatgtgggtcaggatggcatatctcaaattttacaaaattataatggcacggttctaattttccatgtattgtataaacccttgccaatgccttgtaagttgtatcgccacgtttcccctctctctctctctctgaatctctcgcacacccgcaagccctcaaatcacgccgccgcgccccgccgtcgcggccgccggcgacccctcaccccgcgacgccgccgacgccctgccatcgcgcagtccccccgtatcatcagaaaaatcagggggcggcagaacccggcgcactcccggagtcgtcaaggttttctctcgcggagttccatcccggccgtgctcccctcccccacccccctgcacgtgccgcgctcctcctgtcgtgtcgtcgtcgctccaccgcaaaaattctgtggctcctgagaggtacaatggtgccattgctcccctagtgctcgatgatatgcctttagggcgctttttttttgtgggggggggagggggggtaataatttgaggcaaaaattcagttcaccctagacaatcatgcggttgaatgagttttgatttccctacgaaacctatttgatgattgtgcaatttttagatctaatttcatgatattcattgcagctgataaatgcctcattatttttggagctaatttcttaatattctgttgatttatctttgttcctttagttttttcatggattgccatcggaaccttgtagcttataccctgtcatcggaaccttgtaggactatatacctttgtacatattgatcttccatatgcattggtttgttgagtataaacacaatctagatgaatatgtttcctgacaattgtttttcatttagaaaggaccaaatatgctaaaactattcactaaaatggtcaaacagaagaattccactgtcacactgcactttcaaaagtttttactcatactggatttgattctctttgtgttccttcagtattttgcaagattggcgacgccaaccgcgccgtgacctccccaaatcacgcagctgtcgctctcctcccacatcgccgttccctacgccggtcaggatctcccccgtcgtcgccacgcacaaccacctgaggcgctccctccgatatcggaataccctgcgcctcccctctctttccatcagtcacccaccgaagatcttctgccaacaaagtgctgccgtccgccgctatctttcaccaacgctgcgcggcgttcagcctctgcaaacgattgccaagaaggccttgccgccttccctccgattgagtgctcaatctgcatcgacacggtggtctacggaaaggctgtggtgcggtcacgagttccaactcggtgagcagctttctagccctccttgcaattttttagtccttacaaatcttaggctgacattgccgtgatacatttattcaaacctgatcgtttagtttattttgttctccttttgcattggatcaatgtgattacccttcataatttgggagcggctgcgttatacgggagcatgataacagatgctatgaatcatcctaatattaaattatcgatggctattatgcatctgtttaaaagtgactgaaatagagataaaatagtgaataaaaatgaatatatactttctgtttaattttcctccctcccactatagcatacatcagtgagaattcctaatgcttaccaattgctgcatcttgattgcaagctccagaaaaaaatattgtcatgattattgtgccagggggagaagtttcggttttttatgtgttttgtatgagaccagtgcaaggggatctacattgttctggattttgttttggtttcaattttgctggtcctactacgtgtgcatatatagacagaaagccttgacgggacataccaaattcaaaaactcagaaggaatcaccttgcgcttgtgcctaattgctccaaagtataaggttggcacaaatagtggcccgatttttagttcactgatttttatgctttcccaatgttgcggttaggctattactgtgtttgaggaaattccttcatatagttttatatgttccgtatattttgaaatttatgcccatagagcaccctaattttgttgacgtgatcagacaataaaaaaggcaccatgacagctatggtggataatgtcatttagtaacacagggcaatgtgttgtaaataataatgggaatggtttgtatcatttgtttcttctatgctcaagatcctggactgttatgcatgtatcatttgttgcccctcgagtcagattatttgacgtggatactttagtactttggatcaaagaattagggtatttatattgtacatagctaacaattgcatatactacctccgttttttaatagatgacgccgttgactttttctcacatgttcgaccattcgtcttattcaaaaaatttacgtaattataatttattttgttatgagttgttttatcactcatagtaccataagtgtgatttatatcttatacatttgcataaattttttgaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtggcaccgacgagagcggaggcactgtccctcttccggtccctcctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgcgcgaaaccagcttataacaaacacgtctcatgtgtctgaaatggcgtcctaacgtttactgtaatatacttcaatgattcatcaggtatacaatcagcatcacaaaataatttgtatcgcttaattaattacgatgtttcgaatggtggctgtcggtaacttacagaagcatgcatgacttctgattattgttggtactagtagagaaaacaagacggcatcctcactctaaccgtgtaaaattttttttaattcagtgctaaatgtcaacagatgacatatatgccatcaatgaggaacgttcaatgctctccccaagatttataagtctggtgcagatatagttttcttaccgagggaatatatatacacttcgtcttgaaaatgtatcaaatatcactaaaaacattagaaacaaatacttttagtaatattacacatctacacgtaaagtcacatctttaaattcatgatatataaagagaaaaatacaaaattcagatagacttatagccttaaaactgttaaatatttttgttatgtctaaactataatgactatggggttaaaattttcattataggtgtgtaatactactgaaagtatatgcacaatttttttctagaatttattgtgatatttgttagttggtatacacggagtatgcacatgaatcttatatgtagatgttatgttcccatccatctattatgatatataagcatttgttggttgtttagaaaagattaaggtttataagaaaagactttggtgcatcttattaaataagggagggtaagggtgagagagttcttggcagtagtattcgtgctacaagtgattatattttgatataagttttgcaggaggaaagacctaatcatcatttcattactgtcaaatgactacatattatatgattctggtttaagaaatagcatatgacaaggaggaagcaggtagaggccgatagaaaatgcaaacgttaaaaagtatatatagctgtatatctatagttggtggagatgctagctagaacactactaagaaaaccatttctgcagacgaaacccttctatttttcagacggatgtttattttgaaccgtatatacatcctcttatgaaatgcttattgctttctcgcaagtacaaaacggtacggtgtcaattaatccttggttgatatcaacggagctatggatcgattacaattaatggcgctctgatgtgtgtgaaccactataatgtgtaaattaaattgagaacattttttttctgaattacacagtgcaacacagacactcacaatgcacgcacactcatgcacccctataaacgcacgcaagcaaaccctacccctatgagaatcttcgaagactgggccgataaatcctagaaattgacgaagtcaccataggcgcctcgacagggccagtaaatcctgtcgacgggtacatcacctaccacactgaaagcacaaagtcattaaatcctagaaaatttgctcccacggggagtcaaagccaggaccttaggtactactgaggctcttgtaaccactagactagaagctcttttcctttaattaagaacatttaattcaattcaaagtaatagaaaaacacgtgtacattgtcaaaatgaaaaatataaactatagctctgatgatctcactccaagtccgtcccgtttgcctatatagttagcaacgagctgctctctcagtattactaccgaacgattaaagccacgtaaagaaaacaaaaatccaaggtatctcggtagagccaattcttgcatgagaaccatggcatgggcgttgttactcagcctcgccgtgctcgccgccgctgcggctgctgctccaacgcactcccagtgcctcgacaacccgccggacttgacagccggcggaggtgaggccggcgtggtcgtacatgacctggcaggcttcgaggcctatgtcactggtgccgtccattccaccaaggctgtcctccttgcctccgacgttttcggtgagtgcatgtctaggattatgattcagggtttaaaatttaggtccgtgtttagattcaaacttttttcttcaaactttcaattttttccgtcacattaaatgtttggatacatgtatggagcattaaatgtggacgaaaaaaaccaattacacagtttgcatgtaaatcgtgagacgaatctttcgagcctaattacgtcatgatttgacaatgtgatgctacagtaaacatttactaatgacagattaattatgcttaatagattcgtctcgcagtttacaggaggaatctgtaatttgttttgttattagtctacgtttaatacttcaaatatgtgcccatatacttaaaaaatttttggcacacgaactaaacacagcctaggttttaaattttcaaaattttggaacccccccaaaaaagtaaaaagactaaattatttcgcccaaaaatttcaaatatttttagtttgtatgaatttagtaaagcttattcaatttcggtcaaaaaaatgtttaaatttcaaataattttgttctattcaaaccctatgatgattagggatgaaaatggttcggaaagttaccggattctggacatgttttcggaaacggaaagtgccggtcggaattttttctgaaactttcagaaacgggaacgaattcggatttttttttgaaacggaaacgaatatgataaggttgctatcatcagaaactttctggaaatgaattcaaattttctctcggaatcgggaacagagtatttctcatgtacaactaattagcttcagctatctcctcttaatatttagatttatactatgtattgaggtgcttaattaaatagaaatattttttgttgtctagtactttagatttcttttggctaatgttttttttttagtttttattaggtcatgtcatacttcttatagttatagatgaatatagtttcttttctaaaaaagtaaagtgtacaactagttgtattattactattgataaaaaaaaatagaaatgtcgatttgttgttttagaaaaaaatatttaactacatctattcgtcgtcgatttgagaagttcagtttaagagctttttatattccaataaatatccataccgtatttgctccgattcgtatttgcttcattttcgtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcgtccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaatacattcaactaatcacaacaataatacgtcattacatgtatagtcattaattaattataatccattaaacattacatcacatatacgtcattacaagtcgtactttttgtcgttacaagaaaccaacagctattttttgttgaacaacttgacaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgtgctgttttgttgcattgaattccactgaatatatcgtgaattatgatccagtagtagatccggaaacaccttaaaagcatatgtgtgataatgatgctgaaaattacaggaaaatagctgacaaagttggtcaacaggatattatgtcgctgtacctgatttct

SEQ ID NO: 64766 - DNA, 11755 bp, Oryza sativa
atttgaacaaatattgtcaaaattcacgaaaaattaaaagtttcagtcgaaataatatcgtatgggggttccaataggaccaaaatttcggaaattttgttacgaaattttgaaccctggagctagcaacaggagcaatccatggttcccacaaataaatgaagcaacacaggtgtgtcctccactatttcagaacaagatatcttaaccccttattatcagtgtcagtttgtataaaactggcataaaagaacatcaccaccaattggtttttatcatgataaaaactaaattactagtgggttttatcatgcaccacaagtgacaattatttaaaatatttgcatccatgctcctggccatcaaattggctatagatcatcaatgcctcctctctctgtctcccatgaaacaccagtgcaatgtttcttgagaataattagggcgtgtttggttaagtgtcaacaatccgggcacatatgcttactgatcgaactcccatgtgcgcatgcgtgcactgttatattgatggatacatcgacgataaaccaagcattaacttttggcgaaccggatgcactaccaaaaagtccagcaatttggccataggcctgcagcttccaagttcttcgctttgactttgcacaataattgatgattgcgtaggtagtaaaattcacaaattttatgagggaagaaatttaaatgacccaataaccatttctctttgtaatcctgcctccgtacctatataagatggacatggagcccttaaataacatggccaaaactcgatcgtcatatcaatacaacaccagacggatacaatatctaaatatgaatagggtaatacttctcatcgagaatgcctcaacctttctaaatttgtgtccctttacttactcattttagatctcgtgataccccttcttactaccgatttatagaatcaacaaggtcaactactataaattaaacatgatgttgaactcataaccgctgggcttgtggactgtcatagactgatgtaaacctatatgcgtggaaggaattcagcctcatagaagtattctcaagttgaaatttaaaatctccaaatttcaaagagatggtccttgtttgattgtccctaagttttcacttaatctttctcaggcctccacgttttgctcaacaaggtcaactactataaattaaacatgatgttgaattcataaccgctgggcttgtggactgtcatagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgaccttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatatcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaaccatggcaccagcgttgctctacccgaccatcctcttcctcgcagcggccgccgtcggcgccgccgctccgccgcactcgcagtgtctcgacaacccgccggacctgacgacggccggtggcggcggcgaggccggcgtggtcgtccacgatcttggaggattcgaggcctacgtcaccggcgccgtccattccaggcggaccatcctcttggccaccgacatcttcggttagtgcatgcctgcctgagctgccagcttatctgtctttgaaatattctttgatgatatattgtggattcatttattactaaccattaattaatcttgaattcttgctgttgcatgtgagtggttgcgtggttgttaattgtgggtctctacttcaggattcgaagcgccattgctgaggtacaatcttcttcttcgtttgtataatagggaaattgctgtatgtacgataaacttgttatgattttggtacgatccagtcatgcatcgtacacttgcatgaacattagcattcaattgtcatgcaagttacaacaatagaaaggtgactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctcacattaatcggagaaaaagaaaaagtagaatccatataaaaatataatttagaaatagctgaaattcggaattaaaaaataaggaatatagaagaggagactagagtccatatagaaatacaatttagaaatagttgaatttcggaattaaaaaataaggaatattagaagagtagactagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaagaaaaaaatagaaatttggaattaaaaaataaggaatattagaagtagagtatagagtccatataggaatttaaaactaactaaaatttggaataaacataataaaattaaaagtagagtttagagttcgtataaagatacaatttacaaataactaaaattccaaattaagaaaaacatgggaagaagagtttaaaatcaatataggagtacaatttagaagtaactaaaattcgaaattaaaaattaaagaatactaaaagatgagtttagagtccacatagaaatacaattagaaataataaaaatttaaaaataaaaataaataatattggaagaagagcatagagtctatatagaaatacaatttacagaaaattcggaattaaaaaaaagaaaatattaaaagataagtctagagtccatataggaatatatataatttacaaataactaaagtttgatattaaaaataattaataactaacacgtatataaaatataatataaatattacccattagtagttttgtaaagttattgcaaaatttaaaattatgttctcattttaatatatttgaataatataatgaggaaacatatatgctattatatgagagaaaatataatgatactagccgcgcaatctgtgcaggccactgtgctagttttgagagtaatttcttagggttttcaatatgttatccctacatggagatgatcagcagcatagcgacatatatatattggaattgtttcatattctatcctcctacagctaatctctactacttaaaaataagtagaagacatttccgttgtccgtaccgataaaaaccacgcgaaaaaaaggtttccgcatgtaaaagaagcaaaaaaaaaaaagtgtgaaaaaagtttctgcccgattaaaaaaaatcatctgtataaaccgttatccaaaaaaaaaaaacaatgttagtgggaaaaaaagttccgtcgtcgatactggaaaaaggaaaaaacgtgcaaagaaaaggtttccatcttccgtaaaaaagagtaaaaagtagtgcgaaaatttttttgttccgattcttaaaaaaaaaacccttctcccataaaaaaggaaaaaattatagtgcgaaaaaaaaagtttcgttccgattctaaaaacaaagtccgtataaaccggtcatcagaaaaaaaaagattagtgtccgattctaaaaaaacgggttacttttccaaaaattcctaaaaaaaataggttggcagaaaaaaaatgttcctcacaccgttaaaaaaaaagtccgattctagttaaagaaactggttcgacattttcagcttttccaaaaattcctcaaagtatatttgaaaatttaaaagcaaattcaattttccccttttgaataattcttttattcattcaaattatcatatatcaaaatccacctaaacatgtcaaaatttatataaaccgcgtgaggaaaaaacatcaccatttataaaataaccgatttgaaaaaactgtctgactcaacgtgagaaaaacgccaccttttataaaagaatctggtttggcaccatgcaatgcgaaaaaactgtctaaatttagaaagaaaaaacatccaattccgtgaaaaggattcgtaacatttgtattgttcatcgtctaccacgtcggtttggtttttttaaagcgtaggtcgaattctgacatctggaactaagacaagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccgctggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcaccgccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccacgaaaatctatcgtttagtagtgattatcatgaaaagtgtcagggttatggataagatataccctctacccttggatacacgttgtatactgatacggtatacccgcgcctatacggatatttcctatgtacgttaaggaaattcgtcacgagatagatgcggaatccacagatagaaggagtcctactcagacagaactgggtcgttactgtatcgtgtggggtccgatgtctccgagttctacttggagaccaactgacctgcggtataaaaaggaccaccccgggaggacctaagacatcaaatcttaccgccaacacatccaccacagcctacaaagccggagcctacgggagccaagtcgccgggtgatttagttgaaccaactcgactacgatctcgtcggtatcattgagttccactattccctttctaatatgtgattttcattatataatcccatatcactggattagagctattacctatcaaggggcctgaaccaatataatccctgtttcctgtttgcttgatgtcgtactacgtagatcctcatatcagcgtaccccaataccctctatatccggtctacgggtatcccccgtcgacaaaaagcatatattgttattagaatttttcacccgttataacgcacgggcatatttgctagtaatataaatataccaagaggttcaaatataccatttaatagtgtggtaatcatggtttaatatctttaactagtacttagatagcacatataattggacagcaatttaaaatgggcgagtatatgcgccatgataagaattccatattgtgcttacttaaactaaaatatgtttttcatgacacatatactattgtacatcattgtatagtgtgcacatctgcttagggacaattaatatatgtaagattgtgaacccaatgttaattcagaacttattatgtgatcttccattgccaggttgtacgtcaagctatttctccatggcttgcagaaactctgtttatctgccagtactttattttaattttacatttgaaaacaatgtaaaagcagatgtttgattataaggttgctgacaatttcaggaaaatagctgataaagttggtctagccggatattacgtcgttgtgcctgatttgttccatggacaaccctacacatttgaccagaaccgtacagaatggctcagtgctcattctccggtaattcatttcaccatattaattaatttgatctaatattcccctgtaactttaccttgaaatcgtgatatatgattgagacgatagagtaaaagaaaactcgacagctgcaccaaggatatacacaaagccacaaaacaaaactttatcccaaaaatgtaacttatgcgggatgcttataaagataatatgttaaagttctaagaaaagataatatataaacagttataaacgattcaagataataaattaaagttctaaagaaagaatatataattaatattgacaagcattttcaattgatcttgcaggtaaaagcagctgaagatgctaaaccaatctttgctgctctaagcaaggaagggaaatctattgttggagttggaggttactgttggggcggtgagtcacatctatcaatcaatataagaaaatgtagttgtaatatcctgaacttaatggtcaaaatctttgatatggaattccagaatatataattcctaaccccatatattcaacaagcagttatttaattcatattgaagtctctgaaaacaaatttgttttactgacagggaagttcgcagtggaggtagcaaaaactaacgaggttgaagcaattgtcatctcccatcctgcagcggtgactgctgatgacatgaaaggtgaactttctttcttttgttgcgctgttcgttgttacaatagaaaatagctaataattgttttcttattccaagctctccttgattaattaacagaggtcaaatggcccattgagatccttggagctcagaatgacacagttacaccaccaagattagtttaccagtttgttcatgccttgcgtcaaagaactgatcaggtgagttcctgttgattttattgacggttggtcccaaatacatccatgttttttacttctaaactccatctcgctcttcaaatacttgttactggattctatttactctctttgttctaaaataaacaaaccttagataaaataagtctttacctattacaacgaatttaaacaggcaattgttcagatttgttgaataggtaaaagctcatcctatttaatatttgtttattttaggatggaagaagtagtttttgacgttgaccattcatcctatttgcaaaaataattatattacatattaacgatgtgtgttctgccataatacaactacataagttaacttcattaatctttaaaaagttattaatctgaaaaaatgatagtcaatagcgacaagcaaaataatagtttctaaatacaagttgcatgtacaaaacacacaagctagctctcactaactgaaactgaaccagtgtttaatatgctaaaaaaattgcaactgtaaacataaaagagaattaatttttactgatgatgagatgttaaaagaccttgctagctctatttgcatttttttttgagaaagaatgctagctccaatttggaagaataagtgctataacattgcatattacttccttcgttccaaaataaaaaggcaaaatcatacctttttatgttgtagttaacaatcatctccatcttccctaaatttgtttttttcaatcctccaccccaagatctttaatcacattagatgcatgcatcgtattatattgaggtaatccaaatgagaaggtgataatattttttttcttggttttcgtgttagtggtggtttgtaccttatatttttatattttatgattgcgggaataatatattatgttttataactaaataacctcttatatatgagttattgttgcagattgattattttgccaaggtctttcaaggagtgaaccatggcttcgcttgcaggtataacgccagcaaccctttcgaggtcaaaaaagctgagcaagcacttgcgttaatgcttgactggtttcacaaacacttgaaatgaagattgctaattaatcatgctaggaagaccagtgcaattatttcatcgaaataaaactctcgttctcgatataaaagtttgcatatcaagcagccatgcatttgatgtacactattttctttaaattatatggagtgaattaatagtatgttgtcgagttgatgttcgttatttatctataaataattatacggatgtacttgtgccattgatgttcattgctggctataaattacatgtggatgtacaactcaattttcacaagggtactatatatatactttagcaaaaccatcaaatttattacaaaactgtacaattatgccacagcatcagcaacctatatatttaaatcacaatttataacaaatttccatgtcacaaagtttcaatcctagcattgttatcctgatgaaactttcagaatctctagctttgtgatatgaaaaaaaaaagtttatgtagttttgtgatatattgtatcttaaaattttcttttaaaaaataataataataaagatactgtggatttacatgtgcaatttaaaatagctttattgaaatatatataattttacaaaatttactcactttaatttatatcaacttgtaatcagtatatttctaacaattaggccatgaataattgaaagggttgaaaagctaactatatattaccccatttatttcgttgggccttgggccattcatgagtaataacaataacagtagcaaaacatacagcaatgcatggcaataataataccaattaactttctaaaaaaataataataccaattagaagtctgtacgtatgcttacaaacttgtacgtataagttcgaaacaaatttaaaatgcaaatgaaaaaatagactttgatttgcattttcctaatatgaactttaattgcgaatcagcactctcgtcgctctgcatgcgtttccagtcgagatcggccccaggcatgcggccgttctctctcatgtgtg

SEQ ID NO: 64767 - DNA, 3655 bp, Oryza sativa
gtatataaagtttatacatatgctatcgagtgggccaacgagatggtatcgacgcctcagacaaccgccggcagtgtgcctagccatggcaccgggtgatggggacgatggcgagacgaatgccaagaatgcataaaacttttactagggaagccaaacctaccccttgcaatctggcatgccgggccgctcataggccaagcagcggcacgtagacaagctagacgtagcggagaagaatattgcacggacggggatacaagtttgtctcgcggcgagttgcccccctccccccccccccgggatgatgagatagtggtgcttgaggccttatgtgcagcgagcttcgagtccaccatggcttcgttggtggtgggtgtgctcgacttcttccttgttgtcgagctcctaatactgacagccaacgccatggctcacatcgccatctatgagtgaaacatgtgggtggacaacaggcaaggctccgtgaagcacttttccaccctccaattagctagttgtcaccctaataaggtgatgtaaggaagggtgacgaaatcattgaattgttttagaatctatttctaggtccacctaggcatggcggagtactttccctcacgggctaccaatgaccgataggccactaggtgaccttcgcgctaattctactaatggtgggggacagactcggggctctgctttaccagtcaagacatacggtactagtggaagctggatgtggactcatgtacacctagagggggctccgctgaacaccatcctccgccgcatctcctctctctagacgatgaaggatctagtcaaggagtcctgcttgctgggggtcacatggctaaaagaccaatgggatcactcccttacattgggcacccaatagtctctatgggaggacctaggccccttcacatcgcgtggttgataaccccttaaatctttctaccttgcagtagtgctccacttgttgtctccccattccgaccttcggtacacactgcagcgttctaagaccattatcctagtcacaatggtgatcgcggatgccaagaagatactagggagttcgctacccaggaagaaggtcgctcgcctggctcgaaagaatgcatcagtttgacggaatagtgtggccaagaggtttgggcttacactccttgccatgccttctctccatgagctagaggagaccaacaaggatggaaagcgcaaggggcatcgcggggcggacgtggtccatgctcccaagaggtccaagcagggagcaaatctttggctcctccttttgtgggcgtgcctctacaggccaagcgaccaacactgttgttgtcagagacgtcggtgaaagccttcgatcatgacatcatcgaggtcggttcgtcggtctccactatccatgcaccgaaggtggtaacggtagcggttgccatagaggccaacgagacggcctggcaagtggccctcacaggtaagggtctcgtttccttcctgttatcgtgaggctatattgttatctcttacatgcctctctcttcattttccccttcttcattgtaggttttccagggtacaggtcgtagtcgtcttcttcgaaagttgagacaatgccctcgatgccgtggtggactggagaagaggaggtggcgtcgttgccacctcaagtggagatatcaactgatatggtgatatcggaggcggatggcgtccttgatttgactccggagcaagtgattgccctctgtgggggcatatcatggaggcagctccagagggcatccatgcagaggccatcatccactcatgggatccattgcctaccatcatggggcggctcgtgcgtcccagagacttggtggcgctccggttggatgtggaggcaccgatctggtcctccctgcttggggatgacgctcgtgtattggctactatgatgagatcaatggagctaatggagctgcaatgtgtgttggcctagtaggtgcgtccgtctgtccttgtttcttgttgggtttgttttgagtaatcagagtgccttcctccttcgctcaggccatggtggtcgtcaaagcatccatcaagcgtgggggaagtgatgcagcaacacaacacgcggagaggcttcgtctagacgagattatagccttaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatcaaaggacctacagtcccaaaggacaatgcccccatcaccgacaagatgacctggtcgatgaggtaggggcttcaccaagaaggtcatcgccacctacgaggcttggtgctcataggccaccacccatatattgtcgttgcttcaacaggagtgtaggcacatcgacccctctgtttgcttggaccccgtggtgttctccatcctaatgtagggcgctccagcacaccatccccgcgtcgtgacatgaacgacctcacccggaggattgggccctcgttgggtcacaacgttgtagtggctgagctcgccgcttacaccgaggggaaaacgaagggtgtgcccaaggtgtagggattagttaattttttttagtaaatttcataaaactacagttacttcgatcaaattatcataaaactacaaatttaaggcactgtatcacaaaactacagatttaacacaagatttgaggccaactatcacaaaactaaagatttaatactagagttatcacaaaactatatattttacaacttaaatccctaccactactgctatgttagagtgataaatgttgtagttttgtacttaacatgttgcaaaacatgtacttttgtgataatattattactaaatgtgtagtttggtgatcttccaccttaaatctgtagttctttgataaagttggtcctaaatctatagttttgtgatacaccttaaatatatagttttgtgatagttttgtcaaagtacatgtagtttagagaaatttgctctcttttttttttctgtgttccctgtttcttttatttctcttcatgtagccttctctctggcttagccttgcctactgtttggcctccagactatcctttttcttaccttctgcaattcgacataatatataggaaaaatttgctagaggacggtcaaattttctggtatttcctaacgaactcctaaaaggcgtgacatggctctaggactcctaaaagacacgtgatttactagtggacaccacagtcattatttcatcattcctgggcttaatggagggggaaaccatgagaaaaagaaagttctgcccctctggctagcacgttgtatgtacattagtggctttgcttatgccacgaccttaacttgtgtcttgagccattaccctttaacacatcgaacgcttcaccatcctcacccct

SEQ ID NO: 64768 - DNA, 3698 bp, Oryza sativa
caagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacaccatggaggaatcggtgtcggattgctcttggatgccaccgacacagtagcactcctcggcgatgatggttctgatctagtcggaagatgtcttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggttgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtgtccccttgtccaagtagaactagggaaaccaatatggatacaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggaccaggcagtagtcgtgacttgaccacttaaagtggaagttgtgggagagacgctacatcactggtcgaggaccaggcagtagccgtaactcgaccactgaaagtggaagtagtcgaggaacgctacatcgctggtcgaggaccaggcagtagccgtaactcgaccactgaaagcagaagtggtgggagaaaagctacgtcgctagtcgaggaccaggcagtagtcgtaactcgaccacttgcagtggaaatagtgggagagacgctacatcgctggtcgaggaccaggcagtcgtcgtaactcgactatataaagtggaagtggtgggagaaacgctacgttgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacatactgatgcgagaaccagtgagcgagcagaattatctctcgaacaccaatggaagttgcggtgcgagagattgctgcgtactggtgcgagaaccagtgagcgagcggaattatctctcgaacaccaatggaagttgtggtgcgagagattgctgcgtact

SEQ ID NO: 64769 - DNA, 3452 bp, Oryza sativa
tatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttgtcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattccaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattagcaacagctagtggaaatactcaaataatactgctatgcccaggaaacactagtaattactacctccgtccctcatataaagtcatataaaggatattcactatttttaaaatactaatgtttgaccactcgtcttatttaaataatttgtgcaaatataaaaaagaaaagttgggcttaaaatactttagatgataataaagtaagtcataaataaaataaataataattttaaattttttttaataagacgattggtcaaacagtacaagtaaaatgttaaaatcccttatacgagttgacggagggagtaattaaatactgtcgccgttttcacgtcgctaccgttttaatttgtctgcaatataacgaattaatccggctatctgcgatatagccaatatatcatatctatgcgttatcttgttggaacgtacaggatatggccatccatgcgatatggccaaaaactctatgtacggttttgttacatcttaatcttctccgtcgtggccgatagagaccacacgtattacaagctaatcacaaatctagggatagctatattatatatttgtttatgacccatatttttcaccccaaattagtaagataagattcttttttacattgtaaatttaaaacttatacatatactacatattaaattacattatttacatattgttattttttttctaatatacgagtataaaatgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctccggatccagatccagctcctgtcggcggcggcgtaccaccttcgtcaacagagggcggagcaactccagacatggcgatgagcagtcgtgcgga

SEQ ID NO: 64770 - DNA, 11901 bp, Oryza sativa
gggttagtggctgcaaaaggatagcgacgtgacgtgacgtgaagcacgcacgccgccttggcccttgcccttgcccacgcccacgcccacgccccggcccggcccggcccgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaacttaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagctcttttcaagggtctcttctctcagtcacacaatagtttgtttcaccatccaaattcacgggatctccgatcacaatggacaggtttctactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacatatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttcctgaatagcacgctgggatcatcaggagtaggagctggcttgcagtcactatatccaaagagactcaaaaccttgtccacatagtgggattgcacaagtgtaatcccacactcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaaacttctcatgccattgcttcggtgcttgcttgaggccatacaaggatttcaatagtttacacaccattccctcctgaccttctagtacatacccgtctggttgatccatatagatctcctcctccagctctctgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccattaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcgggtactccagagtttactattaagaatctataacccacactgtggatagcataaccaagaaacacgcaatcaacggttttttgtccaagtttccgctttttgactataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttcgaaagccccgcagtgtctaacatggcattcaccatctcagttagagtacggttctttctttcggccaccccatttgattggggtgaatagggaggcgtcatctcatgaataattccaaactcttcgcaaaaagatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacataagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggatgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagagactccgaacttggcctcgagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtctaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctcctgtcggcggcggcgtatcacctccgccaacagaggcggcagcaactctagacatggcgatgagcagtcgtgcgggaggcactccccaaaaacctgatcacccgcctacccggtgtagatctcaggccaatctctcgtgcgtgcaagagatcagaagcggggaagcgagagagcaactcaggcacggagggaatcgtgggaacgtgggttagtggctgcaaaaggatagcgacgtgacgtgacgcacgcacgccgccagccacgcctcgcccacggcccgcgcgcgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacataaaagaattagaattaaaaaataatttattattatcaacttaaaagagtatatagaagatatatatatatataggaaagagagtaatcacataaaaagactaaaattaagtgaaaaatatatgcatggtgtcataattttagcaatcccgtctaattttgcaggggccaaaacgcataattttcctctggagcagctatatatatgagactctacgtgctcactccatcgacactggccatccatcccgcctatgggtagcacgggagaagtaatgctggcatcgggaggaggagcggcgccggcgccggcgacgtcgcgcgacgggcggggcgccgccgcggggctggggcccgtcgcgttcaaggacgccgccgacgccgacgccatcccggtgcgccctcccacggagcacgacgccgccgtgtccgccatgccggcgcgcgtcttccacaacctgaagctgcgacagcaccaggggtactgggtgctcgacgcctgggcgcgcggcgcggtcgccatgcagcgcggcggcggcggcctcgtgccccgcgccgacggcgacgtcctcctcgccagcctccccaagtcggggacgacgtggctcaaggcgctcgcgttcgccgtcatggcgcgggcggcgcacccgccggcgagccccgaccacccgctccgccgcctcaacccgcacgactgcgtgcccctcgtcgacaggctcttcgcccccggccgcgacgcggttctcgacgagctgccgtcgccgaggctgatgtgcacgcacatgccgctgtcgctgctgccggcgacggtggccgacggtagctccggctgtaagatcatctacatttgcaggtatccgggactttgtgcgtgataaagtttgaggacactggctagcaagtactcctatatactggcttagtttattaacttacacatgacatgaggaagataaccaattgtggagtaaatggtaataaaataaagtgattgaattaataggacaaaaaaaatgatgctacatctttcgcaaaatccttatgtaggccacaatgcaaaaaattcataccgaattcaaatattaagtctaaactcaaatgtgccggatattaaaagctagatattaggcacatgaaaatttgaaaattccaaacacctaaaattatgcattaattgctaatcataaatttgtagtgccatgttaatgtgttcgattttagttcattttaactacaaaaatatattgtagtagtatatagatttactttatttttgcatttcactttgttttttttaccaattgttaattaaattatttcatggtatttgtaaaattactttaagtttaggttataatatatcattgttacacctcttatctatgaaataaggataactttgcaaacagatagatataccacagggaacaatgagaaccgtgccttcctgatgcccttattacaatattgcttgaactgtcataggtaccggttagaaactggtcataggtatcggtttccgtagtcggcacctatgcagttgcgcataggtgtcggttcttaccacctaacaccggtgtgaggaacaaataaagcaaggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcaaggtggagatgtacaggcccggcagggtgtgcagcggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagaggaagaggaggcagaggagggaggagtggcggcggacgaagatggatgaggaggaaaggcccgtgtggtggggatgtgcaaaagatgtggacaaggagtacggggtagggagaaaagtagggagaaaatgtgaggatagatgtgtgaaagatgtggataagaaagtggcttggctccgtcaattttatgggtaatagttaattaaaaaatcagttcatataatatattataggttcttttttaattattaaccagtacctacaatatattacaatatattataggtcctagttcatttgaaaatattatgctgattttttctttagaactgacatttatattactcaaaggtgtatgttctatatttttttcatcgtgcaaatgtgagaaaatatccgtaggtaacggttttaaatgtcgaccgacacctatgaatcgatatcaataaggggtattgtagtagtgttaataattgtgatttctgtgatgaataacaatgggcagagaagaatatatagaatcatgtcgttattatatatatgtgcaaacaaaatatgatgagggggagagagagagagagaacggggagggagagagcgactggagggtattgtagtagtgttagtacagcgcaaggcgtacttgtgctagctacgtgatagaattggacaattaacgtggaagtaggtgactgggtgttgtcatatcaattaggtgtaccggatatttgttagctacaataaggacggtcgacggaatgggactgatatatgcatgggctagctcgaccaaagttgctagctactgtgtgtccttcaggtaattaatcggacagatacacaccacactttttatattatactccccccgtttcaaaatgtttgacatcgttgatttttttaagtacgtgtttaactattcgtcttattcaaaaaatttaaataagtatttattcttttcatatcatttatttcattgttaagtatactttcatatacacatatagttttacatatttcacaaaatttttaaataagacgaacggtcaaacatgtgctaaaaagtcaacggtgtcaaatattttgaaacggagggagtaagttgtttgatttttttattagttaaactctcttaagctttattaagtttataagtgtgtgtgtgtatatatatatatatatatatatatatatatatatttctaatataaaacaaacatattatcaaaatatattcaatgttaaatttaataaaactaatttaatgttataaatgtgacctaaagaaatttgactaataaaaaagtcaaactacttatatatcaaatggagggtgtatataattaaacaacctctatatatagccataatttgggcacatatattcctctttaatctctctcatcaacagaccgggagtaaatacataagatcttatacacatactctctctttctctttctgtatatgtgtgtggtatatatagatagacatgtcgatatatataatattcaatttgcggcccattatatttgtaccatgatgaagtgataattaactaagattgttaatgtaaacaagtgggatggaataataccaccattttcaaattttgcttggtgcatgtgcgaagaacctagatcactgaaagacataaaaaggcaaaaattaacaagttgcttgtgacaaatataattctcatatgatatatgttcatcgttttcatggaacacatcatgatcaacaatgttttactcctatcattcatcaaaaatccaaaccacaatttgataattgcatcgtgaataaagtattagagcacacacatcgaacgactataatataatcactgcagcatgccatgtgtaattaaaaaaagagcacatcgatcgatctaaagacaaattaaagtttaacatataatgtccagccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaatgtacatgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaagggggtggcagggggttggacgagccacatgacccctgagatgggaagacgtctggatgcgattctccgggacaagtttgatgggtcaggactcactatctgaatatgcatttagttttacgtgtgtttcgtcttttaatttatgcttaacaatatatagtagtacgcaaaaaacgttggattgttttttttcttgttgaaccttttctccatgtattgaaataatggtgttgtttggaagtatagtctgtaaccttttatgcttgtaaaacggttataactttgtaatttccagggcaccaaggaaaaccctttaattgtaatttccctaattcggttaatcacaatgtagcttgtattttggtaattgttagagttactctggttactgatgtaatgggataatggactagctatctggcataaatacataatgattccccacacattgctgcaagatggctgtggatatcatttgctttggagagatgcgcatactatataaaatgctttctagaagtctatcatcaatgattactgcaccctaagacaaatttagtaaattaaggcaaactgtttcagcttacttaagaattcaactaacttcatatatatttcccaattcaagatgactaaactaactaagtgtaatgtcaacaatcaatccagtatactgttcattgaaatataagctagaaaaattcaacctctaattctttcttttgagaagaataaaggaccaggtcttcgacaatggaagcctttatgccatatccatgtacttgtttatgaagtcataaatcctataaatcctataaatcctataagtttatacaggatttataaatttaatatagattactaagtatgctagtgttattgcccaagccccatatgatgagtcatcttaagggagggagggaagtaattaattaattcacacatctgcaattaatatggagatgatatatactcctcccgtccgtgaaagggcatatagcctagtggttgcagtgatctgagtagcacccaaggtcctaacttcaaatttccatatgagcgaattttagattgagttattagagggcaagttccttatttgataggctaagttcctaatttaaaaaggctgcatatatccggttggatgcagaatccgggtaaaaaatatccttcttaaaaaaaatactcctcccgtccaaaataaaacgaacctaagactggatgtgatacattcagattcgttgtactaaaatgtgtcatatcccgtattagatttggtttttatgggatggaggaagtatatccagtattagatttggttttttatgggatggagggagtatatactgctcgcagcctacatgaagaacatgtcattgcgcctccgctgagttggggcttctatttttcccattttcactgatagctagatctaaattttcatgagctatgtttttattcttactaattgtgtggaggcaaagcagctgtttgcatactgttcgtggatttgtgtatcaaattggcatgtgtgtgttacaggatttgttctagtaatttggcacatgtaattaatttggcacatgtgcgtggatatagctaaaactgctgatttagatgacaaatcaa

SEQ ID NO: 64771 - DNA, 4776 bp, Oryza sativa
ttttgtatgtgttcttggctcgtagcatatgttcgattcgagccgatgcatcgagcattttttttattcatggaatctcaaaagcaccaatttctagaccattctccacatcagtgtcacatgaagggtgccggttgtgaatttgacaccaaagaccggttcccaactgacacaaaagtgagttcctatagtagtgacagatcgaatgtaactgcagcatttacctaaacagaggttaattacaataattaacaaaaaagatggttgcctatggtgattgacaaaaacgatgggtagcatcggaaggattttatttggtgcaccgaaaattacataggtcatagatgtacctgtttataagcataaacagttaaagttaagcctccaaacaggctaggaggctttgttttattatgaaacacatagcttgaaaactgtgactacaaattaaaagatgaaaccccggccataatggcgcatcatatggtgagccccgatccatcaaacttttctcgcataatcgaatccagatgttcgcccatcttaggagtcatgtggttcctccagtccccttccacccccttcctaaaatacgagtcgtgcgagaacttgatgtacacaccttgtatgccttctttgttggctttctggctccttagactctctaggctacatagcttgacgatctccgcaacaatgccagcttcttcctctgtgtcagagaatggctgcccgacaaattgtgcgagctctctaacggtgttcactgggtctcgaagcacctcctcatatttcaagaagagcactcggcctagatctattttgcttgccctccagtaaccaagcaagtgatcccagacaggaccagcaaacccagtgccatcacatatagactcatacacttcttggagcaacagatctggcacattgcgtttccgaaagtgccagatggagaccaatctatctttctggtccctacaaaatataacaagctagagtaaagcaatgtttcattgtcactaaagttaatactatgtgaataaatgttttggattttggtttgcaatttctctctttctaaatatacatattgtatccaggacttgcttttgcgaattcatgaaattttggacaatgtttggatcaagtatgtaagaacaatatttttttcctagggtagagatcgaggttgttgaacaagtccaacaagctaacacacgagacacggggctctttacttctcaaagggcaccatggtctagagcatcatgactcattgcaagggagacaaaataagtttgtttttcaccgaactcttgcatactaatacaaagcaaaaagactagaataccctctactttatcagtcccctacttacctaattacaattaatgcatttgtcccctactttcataaaatccaatgcaatgatgactcaaagatgaacttattttgggacatacaagagggggcaaagataattatatttcagaacagagggactagaagcttgcgacactatagaaaaacatgaactgcctctccatcgatatggatataaggaaaagggaagccaattatttgacctcatcaccttgaactcttgtaggaggataatggcaccagtgaaagacaccatctaccaatactgcaaggatgactctcagacggaggggagtgggtgtggaaggggatttctttttgctttgaaggggctcttaccaaggtcatggttgtaattgtgcgtttatcttcttgtatagaaaagagtagattctataaaaccccacctattatggttcaagttgtacaaaaccatagagattttggcatgtgacacataatctcaagtattatgtgtaaccattttaatgtgctcctatatcaagattttaaaaagtggacaaaacatttatatgatgaataaaattctcaaaaatttaaattgtaattgtagaactaaaaggtgtggttgatcaaaaatcaaaatgttcaatagtacggttttatgaaattttagaaccataatatccggtgtgatgtgccacgtatcaaaatccttatagttttacgtaacttacaccataatagtagggttttatgtactttacttatagaaaaatacaatgttaaataatgacaacaaagtaccagctaatctagatcctgcaataaccaaataggaaacatgctacatcaccatatttggtagagggtcccgttctgtcataataatactacgcagttgtatcacacatagcacagcacgtggtcatgtaccatctttcttcctaacgcttttctttgggaaataaaaaatctctatttaacggccatatggcaaaatactcatttttaagggagaaatacataccatttccaaaattagtttaaagttttcacacatgagatttgagatgagagcagctaatatttgaatctgatatgtataaatttcggctggtgtacaaaaacgaaaacgaccggatatgattcaaaactaagattccccttagtaaaataatattacctccgtcccaaaataagtgcagccgtggatatccgtgtccaacgtttgaccgtatgtcttatttgaaaattttgaaaatatttagtcacacataaaatattattcatattttatcatctaatagcaataaaaatactaattataaaaagttttcaaataagacgaacgatcaaacgttgaacgtgaatagtgcaaaactgcacttattttgggatagagggagtaccaataacaatataacgaataagggatggctagctatagctatggttatgggtacctgcaaatgtagatgatcttggtgttggagttgccgtcagccaccgccggcggcagcagcgagagcggcatgtgcgtgcacatgagcctcggcgacggcagctcgtcgagaagcgcgtcgcggccggcggcgaagagcctgtcgaggaggggcacgcagtcgtgcgggttgagcggccggagcgggtggtcggggctcgccggcggcgggcacgcgcggcgcgccatggtggcgaacgcgagtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatccggattcttaggcccgtttagtaggactccaagctccaactcccaactttaaactctaactccagtgatagctagctcctataggagctgaagtgggtatataagtatttggctagattgattagctccacaccaacacgtcccttgttggcatttagttgaacacctggttggtgtcgccccactgcctccgccaccgcacgcgcatggccctgcctgctgccgcagccgacgctactctcgcacctcgccctgccgccgccgaccacactccaccgcccacgtgccgtctcccgccaccgttgccgctcgtggccctcgccgccactccaccaacacctgccaccaccgcctgccgctgccgacaccaacggcgccgccggtgtcaagggatgaagatggggatgagcgagaacgggagatggggtaggaaggggtagttcagtagcattttggtataaatagactaaaaaattaaagggtagtgggtcttttgcggtggagtgaagctgtggagtagcaaaaacctagctccacccccgtagtacaaatttgtggagcagctctactaactccgctccaaaaaatagagaatctataccgtttggcacagctccagctgtaggttgtgttcgtcagttggagttgaaaacactttcctcattgcacgcaaaacgaaacaacagtttagcgtatatttagttaaatattagctaaaaatttaaaaaatctaaagtagtgaaaggattcatctttccactggtggagaaaccatctttggtcggtctggcaaaatccacaatagtcccggttccaaaaagaaccgggactaaagataaaaattttgatcttgatctttagtcctggttcataccctgtcagatgtatgtcagggggccgaggatctttagtcccggttggtgtcaataaccgggactaaatatcaccattttagtcacggttggtactcttgatcattagtcccggttggtaataccaaccgggactaaaattaaacacgtagtatataatccctatcacttatcttctcatccacagttataacttagacagatcgaatctcaccccctctcctcagatctatcctctctaactctcttcctcgtcccctctcctccagctcctccccttcctcctctcctcccccttctccccttcc

SEQ ID NO: 64772 - DNA, 3792 bp, Oryza sativa
atctttagtcctggatccttacttccggttggaaaaccgggattaaatgggggtttccaaccgggagtaaagatggtttctccataagtggtctcatcatcacaatttgccacgtcatcagaataatcagagccgttggatgcaacatgcattcaatagataacgtcggatctagagtgaggattggacagtaaaagatgacccaggtcagggttcaggtcttgggaaaggatctagagaaaggaagcatagtagcagacctatagtcaaatggaaaaaaaaaggccacgtactaagcttcctgttactattatatagaccgtagctattgggtttacacatgatgtaatttgatcagaaaggaagttagttaatttaagggtttttattttattaacgcattagagactgagttgacactggttattttataattgagagtaaaatatttgaaaatatgaaaaatataattgcaatgcaataacatgattatcaaaaatagaataggagatataacaaaggtaaaagataggaggatcaaaattatattgaataaaagaagaaaaatatatatatattcaagtaaattatgattcaaatggaaaaacatgattaaatttgtaatcttaatgcccatggtaaattacctacggtaagagataatttatatgcgagtttctaatttatgaaagataattaccactctagacagattacttttcttaataccacttttaataatttaccaaataaaaaatggttttaagatattaaacatgtcaacggatgcatattaatatcatttctcaatcatttacaaacacaaaaattgaaaacccattcataatgcattcatggctttgtggtatatttcttgcaattattatgaataaccttaaacatgtgattcttttgtaaaatttatatacaataatataattctttttgtaaaatttatatacaataagtacaaagttatctataaacaaactcttagcttcggggtttgcaacaaggtgaatatagtaaaaaatgaatttactataacaaatgcactggtaggttatattaaatgttgtaaaatttattcaacatatgaatgtaaaattgacgacaaacatagaggatgccatagtccttcttagtggcatatgccatagtccacatatagagattgaaaaaagtcatgatagtcgcgcaatgggtgacgaatgtggctagtaataatatgaagtttttaatgcaactcttctacagaaatttttttaaaaaaaacacgccatttagaaaaacgaggaaagtgaagttagggaaagtagactaaagaacgtaacctaattagaatctatgttataaaattcagaaaataaacaagaagcaagaaggtatgaaatctaacttttctagtttattagaaacttaactattcaatcagtttttttcttataatcttaaactcttctcaacacagccacaggggaaaataatatctaggattacatttctttttttttacttgccataggattacatttctttgatgtccctccaatcagtcatttatcatttggatttgggaaaagtctgacttatccctccccaaattattgtcttagtttgttgaaatggtacagttcctagggttaattattcaaaaatgctttccgacgtacgtccgagcgcatgtgaaatatcggacggcttcatccttatccaaaactccaactaccttctcctccacatcttttctattaacttttttcctctcgctctccctccttcctcgaaacttccagccatcgagcacacggctcttcgcttgcttgtgttcttggctctcttcatgccttgcttcttcctcctcctcctcctcctccccgtcgcgtgctcctgttgccaccacatcctcgcatcctcctcctcctcggtacggtattcacctcttccatagcggaggcatccatggctgcagcggcagggcaaggtgatgcaagatagcaagaagatgctgacctcgccggtgcccacacaatagcggcagcaggagggcagaacgtgaggatgtcggggagggagacactggacttgccatcggcgtggatcagatgtggtggccctggctaaggtcactcctctcacgaggctgctcatatgtgttcttccctagccattacctctcccatgctgcatcattaacttgatttcggcggatggagtagatgaagaaaacaaaggtgggttcatttttgtttggatttttaacgatgttgcagcctattatttatctctattgcactttattttattaaggtgtttcgttttcttttgatttgatgttgcatatatcaattcttcgtgttgcaattggtgtgtttcgaatgttgtatttggttgaaacaatttcgttcaagcgatgaaacattttcctttaattggtgaaacatttttatcgagtggtgtaacatgtgaaacatttcgtgcaataacgtccgacgttttgcaaatatggtgaaacattttttttgaaacaatgaaacattgcgacatctctttaacacgtagtgaaacaccgtccggagttttacaaatctccggatgtccgacgtgtagtcgtctccttaattattgaacgaacacaaagttaaatgcattttttttacttggtaaatactagtatatagtaagatatttctgccatgtgtctataggaccgtccgctgctttattagggaggcccatcatgaataaatcttttgaaaaatatctatgcagggcttatgcaatgaatcgaagttccatgtcttgcatttctcagctggagtcccatttcacatgagctgtgatagtagtagagaactgcattcatacactactttgtacactgcagaacatttgagcatgatgaggtacgactttccaaacagtaactgcaacatagggggtcaatcattaatgactagcagcacttctttgacgtacaagaaaaccaggacgactagcaacacgggtagacatagggtgtgtagagttcatgctaaaattagaagttttattaaaattaaaacgatgtgacaaaaaagttaagaagtttatgcgtgtagaaaagttttgatgtgatggaaatgttaaaagtttgaagaaaaattttagaactaaaattaacatctgtaggggttttcactgtcatctagcatctgatgttcgaagcagaaaacctcgtcatatcatagtactctcatttttaaatagatgataccgttggttgatttttgtctgatcatttgtcttattaaaaaattatataaatattatttattttgttgcaacttaatttatgcaaggtgtttttgccctcaaattttcgtacgttgtcccattttttatccatcgtcgcgtcggcttggttgccgcacgtcgctcggagacggagatgtacaggcgctgttctgcatctgaccgaggaagcgctcgtgagtcctgaatttttttttttttaccagctgggccatctgcccatcgccctaggcctcttgggcttcttcctgcctggccggtcctgctccttcccagctaaatagttaatgatttttttttctgttgtattctctgctttttggtataaataaacgggagaagatcctgtacatgatttatgatgaatttgataattttatcaacccatgcgtttttcatgtaacgtttgtgttgtgtacccttttcactaagccacttttaactgtattcattatcttccttggtgattcaccagttaaatatgtaatatttgtattt

SEQ ID NO: 64773 - DNA, 3302 bp, Oryza sativa
tttttagcatatttataccaaattttggaactaaacaagggcatagaaaattaacatccgtaagggtttccactgtcatctagcatctactgtcatctagcatctgatgttcgaagcagaaaacctcatcgtatcatagtactctcatttttaaatagatgataccgtatcagtatgacttattctttagcatatttataccaaatttttaaataagacaaataatcaaacgttatttcataaaagtcaatggcgtaatctggtcaagtgattgaacccaagtgattgaaatgcagaccaaaatttggctatagaattggtgctagacaacaaggtcgatgataatatagtatcaggaaaatgtaaaataggaaataggtgaaacgaacacacgaaacatcaaagctgaataacaaggccctgcattggcaatcaagacaaaaaaaaattaaatgataaagaaatgttggtattagtcaagtactccctccatactcgttcgtattagaagtcgtttaggacaatgtttaagtcaaactttcgaaatataaatcatgaataactctcaagttgttgagtttgaaaatgtaaaaattatatgaatagatttgtcataaaaaatactttcataaaagtatacatatatcacttttcaataaatatttttatagaaacaagaagtcaaagttgtgttttggagaccgtgtcgctgtccaacacaatttcctttacgagtacggagggaatagttatttcagttacttcttcctgtctcaaagcaaacgaaaattaaataaagattgttgtttgagcttcctttcaccagtccaaccaggtccccataagcaattttgcaccaaatttgttgcagctggaaatttaaaaaatgaggaaaaaacaaagtgtgaaggacgtattttcatgcttcaacatgcctatcatgtttcgtgtataacactacaagttgggggaagaacgaattgccgcagtcctcccacaagtttgttttgaaaaaaaaaaatcgccaccaatccttccggtgataaatgtttgtattcatctatttgccacatgtcacctaacatgctcttgtttcagatttgttcctttcttacaaaaagaatcagtcagcaatgccaaaaggtttcaaaaagatgttggaaacattccccctatctctaatttgcatgtcctatctgaatgaaactaatttatgcagcacaccagacctagccaaatattgttccactcaagtacagctaaaattactggtagtaaggtttgagcatccatgttgcatcatttttgcatctttgcaacattgctatttccttcagcagattcttaaatagcagcatatccttggacataatggagttcttaaaatgcctggttaatgcttgttgagctggctgaagcctgaaggtgcatattggtaaattaggacttgaggttgcatgataatgttcctagtagaagagcttgatgcatgacctttctatgataaacttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagattcttcattcatgccgagatgagctatggtctattttttttccgcattccatgcctggatgagtttggttcagtctcggaggtcgtctgcacatacctgatcttgccgctagtcatttggaaccttggtattcacatcttcagacaactcgctgaaaatattggatgtttcagtcaaacatctactgaaattattggatgatcagtctatatactatcacatctcctctcctaccctatcttaataatgtttgaagacattaagcttctctctctgcttatgaaacggttttcagattattgtgcgcatggagtatgttgtatatggaggagtgttacgaagtaatcgaactatttttgcaattggttcaattatcccatgagtagctatgagttcaacaggggaaaaaaatctaatgttacaaatttcaaaaagccaagcgctagtgtctagcgctgcctccaccgagagacccgactgtgtgcctctatagggcatctttttggcagggggtcgcctgccgtgccccagtaggggatcttttcactgctttttttttttttttgcagctgaaacggtagtgcggatacacgccctaccgctgcccattgcagtcggggtgggtgcctctggggtggcgatggaatggaatcaaatcgagctaataaacaggtcgtgttgtctcagaatcggcgatatggtacaaaactaattgttggatggattcagtcggagccaaagaacagcggcgcagaccgacctaggagtagaggcggaagcatacctgctctccacggaagcccggcggcgaggggcgccatcgatctaagccggtgctgaatattcgcgccgccgatgtaggcatgccacggagactacaccggagatccacatcctcctggagcttcgacggcgcgtccgcagcctgctgctcgccgccggagccggaattggggaagcggcggcgtcgggggaggaggaagcgacaaggtgagggggagagatcgagggctccagtttcccatcgtcccataagccacgggttgggcttctctcttcacgcctggtttttttcccatcgtccgcagcctgggcatcgagcccaagctgctgcaggcccagttcacgcctggttttttttttttgtggataagtacaccgaagctccctcaacttatcatcgagttacaaaatcgtcccccaaccgcaacaccggatacaacacatcctccaacttacaaaaccagtaaaaactaggtccctcgacggttttgactccggttttatccgacgtggcagctgactcaacatgggccccacacatcagggtcaccacatcgtcgtcat

SEQ ID NO: 64774 - DNA, 2692 bp, Oryza sativa
ggtgaccgccatggtggtggggaaagttagcgctggtagcagcttctgggcgccacggcggcgtgagcttggtgagaggatgctacaacggatggagcatcgctgcgttgtcggctggctcctccgtcgccggtaccgcgttgatggcggggacgcggcggccgagcttgtcctcacggatagggtggaaggaccgaaggattggacgtggtggtggatgaggtagagagggtttggtaggctgtccttggttaccctcccacacgcgagcccccacatgtcagagctgccaaataggtgaaccttaacaaaatagtgacggaatggtgtggagagcgcagtaaagttcaacgatggcatagagggaggctcgaactttttagtggcacagagacaagcaccatctttcttaatggcatacaggtaaaaacctcctaaaatggactatggatgtagccttaattgagagacctaaaatggccgtagcctgtgttggccaagactcaaatcgtgcaggagcagaacagcccaaaaaagaatcaagaccatggcccagcttttttcgatggaccgccctgggcttcgaccgaaaaccaaaagatatttctgactcacaatacgtagtcatcatgtatgaagagtggaagacagacctcaaaaagcagtttagtaattctgtgtttaaaatgtcttttttatcacgtaaaaatatactgatcaaacacgtgaattaaacgatttgtcgatctgcaaattaaacgataaataaaaaaataacagagggagtgaaaactctcgggtaccagacataaccgacctcgcccttcactcgttaaatcccttggcaaatcatgctcatatccaatattgtttgaaagtaatttttcccctatcaagcatatcataaaacccaagaataaattccgagaagagccgtattaaacaaagggaagctaagacgcagtttcctttacctctgagcatacggtacgtacacatgccaagcttggcaccggaagcaccgccggtgccatcttccattgacagaaatgacgccgacaactctcatgtgcctagacatttgcaaagccagaaacgaacctgatcaaaatgcctttttttattcccattccacgaggaggattggggggggtttcccccactaaaaaaacccggtccctttactagaggagggggggaatgggcccttggggaaaaagggcccatgggccatgttaatttggttaatactgcaagcccctgcaagctgcaagcttcacggtcttctacacagacatgtggttaaaataaaatggacactgactgtaagtggagtcaacgcaagatctgtaagaatgacaaactggcaagtgaaaaatactggcatcctgcgccaaattccagaagatggaatgaagaaatgctgatccatgaataagatgcagagatgtatgtagcttttgtcagagattgtagaaacacatgaaaagaattgataaattgatgcgatcactcaccagatgcttggtgtaatttcagtggtatagttttctttttacttgaattcagtagtataatttgtccagcaattaatcaaagccccaacaacttcagtgattaattccatacttcattagtatcattaccatcctggagaacaaaaatgtatatgagaattatatttattcagaaaatacagataaaaatcagacaacttaaacatgagtggtacggcaggatgcagtaagcgcaaaagatttgtttcaatttgggaaaaatacaaaagcaaacatcagatttaactcaaacaagtgctatgttgacatttttacgatcatttaaagcaaatccagttgactttgtcccaagacaacatttgagcttctcaaagtacggatatgtgatgaacttgtactaagatgtaccgttataaatttgcaaattgtttatagcacaagttctggggttttgttcccatgagcatccatgaaaaaagaatatgagtgcacagccgcacatagggcttagtctgaaacttggaggtctgaatttactggtggaattttggtatgcatcacctcgtaatccacaactgacttaccctttctgacttgcagatcaatttgtctatggaagaacagttcaccgcgtcacttgcattagttgggtttctagaccagagtgtcggtctacacaaaaaccatcagatcaatcaaattaatccaccagtcaggagtaactcctttgaaagattcctctgaggaacgactgatatctattggagctgcacaaacctgacaataatgagggactgagttgaacaacagcaaatcattggtaactgttccgaaggcattgactggaaacaacttgtaactgcatatcatttttgtgtacttccagcctttcacaacctagtagatgtcatataacatgagaaaccagcaagcaagattagatgccttatagctgaactaataattaccttttatgtggatctagtgacagattgcaccacaatggccaaagggatcctaaaactcttttgtcatcataacataagccttcagcaacttgcttgagaaccaccttagcttgtcagaagaccccgtgggacggctcgcagatttggagccaagatcgaaccctagaaccagttagtcaacttgatcaccattctggctttaatgga

SEQ ID NO: 64775 - DNA, 17934 bp, Oryza sativa
tttatttataactctgaaatcctggggaggtccatttggattttggttgatttctcctattttaaggaacccttagattgctgtaatgctgtggctgtgaggaatcaaatccaaaatcttattctccgttcatttagttttagccttttagatttttattttctccatggtgccatccttaccagtcttatccatctatcctttgtttgatgatttatgtgcttcttcttcagcgagcaagattgatcccaaggtgcgggtgcagattatcttccaaacatgtttggggctctactgggactccatggcacatgttaagtgctctggatcgcttgctattttctgctcctcaatcgtgctcattggctcacacatggacggcttcagttatgcacaaccgtcttgtacgtggctgtttcagcagtttttcagcagcagcagcatcggctattcgtgtacctgttgcaagctatgggacttctgcagcacaaagcacatcaaaggaccagcatggcagcaacatcaacagtgcgctaaaagttttgaatcttgtaccaagaaaggctgactatgacaaagtgggaggtccatgccatcaccaactaatccatgactgcatgaatgacatcttgggggttcaatcaaatcatactatacacaagggaaatggtgtcacttttaactcatgcagcaatcctgcacaggctaaatttgatagctttgtttcaaataatggctcggctttgcgttccaggactagattcataaaggaggacatgtttatgctgataatggagctgcacaggaaaggagaaaccagtacagatcaatctattttggcagctgccatgagttcctgtgctgataggcaaatgttcacccaaggcacacagcttcatggtctattggttaaagttggctgtgattcaactgtctttattggcagctcacttatcaccttatattcgaggtgtagccagttggaaagttcgtacttggttttccagaccatgccaaccaaaaacacagtgtcatggacagcaatgatttctggttttgcgctacataatcgggttgaaccatgtctccatttgtttgcgtcaatgaggctttcaagttgcaagccaaatgacatcacatttgccactctttttagtgtgtgcactaaccacgcacttctagcacttggtaaaagtgttcatgctttacaaatgagaatgggtttccattcatatgtgcatgtttccaatgccctgctgtccatgtatgcaaagtgtgggtgcatagatgaagcccagtccatatttggcttcattgcctgtaaagaccttgtttcgtggaatgccatgatctttggatgttcgcagtatggccttgctaagcattgccttgacttgctgaaagaaatggagaggcaacacatagtaccagatgctctctccttccttggtgtcctttcttcatgccggcatgcacgccttgtggaggaaggccgacactgcttcaagacaatgattgaacatggaataaaaccagggctcgatcactactcatgtatggtcgaccttcttgggcgcgcaggattgcttgaagaagcgtgggatttgatccaaacaatgtctatccctccaaatgccgtcatatggggctctctgctgggttcctgtagggtgcatgggaacatttcgatcggcatccaggctgcagagcaccgtcttaaacttgagccaggttgtgctgcaactcatatacaactagcaaatctgtatgccacaattggttgctggagtgatgtggccagagtgaggatggcaatgaaggcgagaggcctaaagacgaacattgggtgtagctggatagaagtcggtgataaggtttattccttcacggcagagaacagatcaaagagccaccaagtaaacaatgtcctggctattcttgattgcttgcaagctcacatggaatgcaagtatgatatgcttacagaaagcctggagtagtggagtgtgatggctgtgaacatgtcaagacgactataaacactgtatatattaagaggaatcctaaagaagatccattgatgccattataacacctaaacattatgtgtatggactgattggtataaagatctgtatggattgacaagattcacgaccaacaagacatacaggtactgtattttccaagtctcttccagttttgttcctcatttgtctaagaagtgtggggaataagtattcttgcattctgccaccacccaacgatctgcaatttatgtcccccatccatgttacattttcttgttagtttagttctccaaaacacaggtaattagaagaacaatattcagattttttttttgttttttttctttaaattctttctggccaaggttttctgacttaattgatgtaactgctacgagacttcctatgccttcccataaaaaaaagtacagttcattcatcctatctattcattgtgtagcagcctgttgtggcggatggtgatggaaggcctgctttccagcttgaaggaaagaactgaaggattgaaggttaagcggcataaacttgtcatagcacatctcatgtgtctgataacataatgcgttgatgtgtcatatgtgcaatcagcgatcttgtactgcttaattacaatggttagaaatgtagctcttgacaaagtaatgattcaggagttctgataattgagaaaacaagacagcatcgtctaaatgtcagccgatggcttctctgactgatgagtatcaacaattttcatggaaacgaataggattacaggagtgtcaacgaatatgatatttgcggggaaattgaagaaagtttttaacaacatgccttcccagtcttgagttagagaattattgcatggcccattttctttgggggtcaaattaggtaggtggtgaatttgacaatcagcatgccgttagtgtcgaagacaagaaatgattctttgtattggtgctgaggaacaaataaatggaaggaattctactcaaaatctcaacaatctaagttgaaaggtaagatctccaaattaaacgctggggataaaaaaagcaaagttgaaagaggggtgcaaatgaaactgaaggcgcagtttcatcttctttagatgagatgctatcatccaacctgctaacggaagtgatttagatgaatattaagtatgggtatataaaacaagaaaactattagtatatgattaattgagtttttattatttcaaacttagaaaataaattaaaaaatggttttatctgatatttcaaagcaacttcgtatgagatgtaccatttaacagtttaaaaaacgtgcttacaaaaatcgagataaaatctttgaaacgaacttggccacgtgtaacaaagatttagcatgacagaatggcacaaattgaaaaaggtaggattgcaacatcgatgcgacactaacatgtcaagtgcgtcttctttttgctacctaccgtgctaaagccaaaatgtagtacaaagccctctgcatctaatgaccattaccatgcaagctaaacccatcaccatggcaacggcgtcgatgctcctccggagcctcctctgcctcgccgtgctcgccgcggccgcggccgccgctcagccgcggttgcagtgcctggagaacccgccggagctgacggccgccggcgacggcgaggccggcgtggtcgtccaaaacctgggaggattcgcggcctacgtcaccggcgccgcccactccggccgggccatcgtcctcgcctccgacgtctttggttagtagtctgtgtgtgtgcatgtatgcctgatttgcttactgatcattcactgccatcctttggtgattatcgattgattagccgttaattgttgctgttaatttggtttcttcaggatttgaagcaccattgctgaggtacaaaatcttcttttcatttcctttagcttcttgttcgttgtcatcttcgacagtaattttcttcatttcttcactctctggattataggcgcagattgtttattttattaacataacaaattaatattttgaaaaatgaactttgcaaatatctaataatgcagtagaataaataatattttttaaagcatggaccaaataatctgtagcaattatccgggggaaaatctaaagagaacagggcatgacaaatacttgacacttgaacaactctggaaagagactgatttaaaaaaaagaaaaagacagacatggcttaattgtgtaccatacctgtttttcttgtgacaatgggttcaggtcatttttagtgaactatctcctatctttctgcagtgacttttgtgagaaggataacaggtttagactttagacaccaaaaggtgcaaaagcaaataatcgtccattcgccctcaccatccatgagcttgaacaaagaatattcaacattgctatgtacatgtttcttccgtttcaaatactccctccgtttctaaatatttgacaccgttgactttttagcacatgcttaaccgtttgtcttattcaaaaaaacttttatgaaatatgtaaaactatatgtatacatgtaagtatatttaacaatgaatcaaatgataagacaataattaataattacttaatttttttgaataagacgaacgattaaacatatttaaaaaatttaacggcgtcaaataaacggagggagtagttagtatcttttttttttttggagtaaccatcaattcatacggagaatcagaagcgtatactcatttttgctattttccatattctgaccttctaatgatataaatatgttaagcggttgaaatacatcatttactatcaatgtgcaatttcattattttaactactctacttagacaacatatatgctaaaactttcatcttctgtatccctacaaagttgaagataaatctactactccttccattacaaattatttgtagttctagttttatcctaagtcaacaatttctaactttaacaatcattttttttaaaaaaaatgtatattttaatgacataagttttaatatgttttttgattcacaataagaaatacttccaaatatgcaatccacatgtatttaaattatacaaattgctagttattaataggctaaaatagaaatatttgacttgggacaaagttataacaataattaatttgaaacaaaaggagtagtactatcattgtatactgtattactgtgcataactatgttcattacatgctttctaaaacatcatttctttaggggcaaacgctgtcgtaactcaatagtcaatagtaatatctcattgctgtccttgtaaagctgatttatgaatggataaccaagcaacgatccaatttcagaaattcagtttttctgtaaaaatatcgtggattccaatggtataacagcaatgatttcttcatgtggattgtactaaggtttctgtttttgattccaattttaagtgcttcctttagcttgaaagtattgtaaaacgtcccaactggattcctttcaatacaccttacatttttactcccattctagattgcaaagacaacttaaaatcaaatttgtggttaataatgctgacaattacaggaaaatagctgacaaagttggtgaagcgggatattacgtcgtggtgccagatttcttccaagggcgaccttacaatggagacccaagtataaacattacacaatggatcatggctcactctccggtaattgttttcaccaattacatagcttattcgacgacgattatcgaggagtcaattgatattgatcagtatattcaattgaaatttcaggtgaaggcagctgaagattctaaaccgatctttgctgctctaaaaagagaagggaaatctgttgttggagttggaggttattgttggggcggtaagcaaaatcgatcagcaaaaagaaaatgtctttacatatcctacatcagtacattagtaatacatacactctaaaaaactttgtaaattcctagttaatttccatatctagacttaattcatactattatagtctaaacaacaaaacttcaattgacaggaaagttagctgtcgaggttgcgaaaaccaatgaggttggagcgattgtcatctcccatccttcatcggtgactgctgatgatatgaaaggtgaacttatctgttttggtgctattgttgcgcagtatatagatgaatatatagttaactgattcatgtacgctgtatcctagtagtccctgtttttcttattccaaaatgaccttgacacagatgtcaaatgccccattgaaatccttggagctgagaatgacgctgtaacaccaccaagattagtgtaccagtttgtgaatgccttgcgccaaagacctgaggtgagttcctgttgattttcattggcacttgatgccaaatgcatcagcatagtcccacggtagacacacacgagaaaaatctcccactgatgatgagaaattgaaagatcatgctggctctatttttctttttgaggcaatactggatctagctaattagtaacattaatgaaaagtccaaacactagcacaatgtcaataaacaagtttacaattgtttcttaaacacaaccactcaatgatctttaagaaaagaaacaagttatgaagaggctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacattagctaatcatgcatgcaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctttttgtaggagaacaaaaataatgtgtgcctctgttgccattttaactagtcgatatgttcaatcaaatgttgtatgctactcatcttaagcacagcatatattgggtacctcttgactgtttcttatggccacaaattagacagatgaaagtcgtgcttccaagaaattgctagcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaaccttttttgtttgaaaaaaagctaagatttaatgtcctccagggagttaggcatatctggtctcaccggaagccagtggcgaggttgctgtagatctggccagagctgtgtatcctgcctccgccggatcgtggggatggcatcttcacatgagcatatctccacctcatcctatatatgtgcgccgccacatccagtgccaccccttggttgggttccatcgaggaggtcaagggagattcatgttgccttaagcttttgacaagggtcgaggggcagctcttccagttcatgtaggtgcagaaaaactatcacaacttccaagcatccaaggttggcgtgtgaagcttctgtctctaggtgcagcttctggtcgtcgttggcattcatgattgatcgcactctgagaaaattaaaatatatttagaaacaaaatgttgaggaaaaccatttgccatagggataacaaattattgctacatgaatccctgagcatcataaagacccttcaaaatgctggattcttcatgcacttgggcagagctatggtatattttaccctttgaattcctggatgaatttggtcctgtcccggaggttataactaatcttgttgctagtcattaggatgcttggtattcaaatcttcagaaaattggctgaaaatattggatgtttaaatcaaacctttactgtcatagtcttgcagcgtgaataaatcatcatgttgctggctttaaaagaactcctctggtgagtgcctttcagtactttgatttcagaaaatgctcgtgtatttgccaatgatatagacttactcctctagcattccacttataatcagtctatatactgtcatatctctagcttgccgaattctctatgcacgttcactagcctaatccacagagaatttaatttgttaagtagagtagaattaccattaaaaacaaaactacattaaatgacaaagcgttaccatgctaacaatagtatcggtagagtatgatagaaaattattcatctaccagatcatctctcactggcatccaatcaaaacttggcaatgaggttagaaattttgcatcgtacggcgacattgtagcaataagggcatatcactggcatccagtcaaaacttggcaatgaggttagaaattttgcgcgacattgtagcaataagggcatatcactggcatccagtcaaaacttggcaatgaggttagaaattttgcgtcttacggcgacattgctagcaataagggcatatcaaaacattaatgtatctcctctgctaccatatcttaatgtctagttgggtgtttcttataagattaattttccttttaagaaattaagcttctctcagattaagcaatgagttcaacagagaaaaaaaaatctaatgttagaaatttcaaaaagccaagcgctagtgtctagcgctgcctccaccgagagacccgactgtgtgcctataggtgtcacgtcctgataaattcatcccgaaataaaaatcattttctaaaaggaataatagaattaattaaaattcgaaaagaaattggcaaacattaaaatacgtacaagaaaaattcgaatgtggctcggagaatttttgttaaattcttcttggtctaaaaaggagccctcaaattttacttgaattttcagagcaccggaaataattattaaacaacaaaaacaattatcaaagtttaataaaaagaaaatctaaaaataatcctccttttcttttgggccaattttggcccaaagtcctccctctctcccctcggcccgcggccgaagtctccctttcctccctctcttcctctccctctcctcctctccctccttctcttgggcctcctctcctcccctcccggcccactccctcctccctctctctctcgggccgttcctccctcccctcccggcctgcccggcccaggccgccctgccccctcccatctgggccgtgtcccggcccagccgagcccccccaaaacggcccgtatcgtcccggtaacccccggtaaacaccccctcgataagcgcccccgtgcccattgggggccccccccccggggcgagtttttttgttcccctcgggcgggggcggtacttttgtttttcgcgaaaaccataactcggtgccttcccaaaatccgcctaaataaaaccggggattccaaaattaaataggggaaattaaaccccattgaatcctctgcaattccccccaatttcccccttgaatggcgcccccaatcgtcgggaacggtcgcgcttttcccggccaccaaccatggccgccggccgccattcccgtcgccgttccgccccctcccgagcccggctcccgcccccatcctataaaatggaaccccctctttgcgttctattgttttagccctttctcgagctcccccgtggccgcagcacccctccccgccgtcgccctctctctcccgtgccgctggacgcctccagccgcccctaccgccttgcctgagcgccgcccggtcgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcgccgtccggccgcgccgtcttctccctcggcctcgcagccacctcctctccctcggtcagccctccgtttcgcgggggaagcaccggagacgcgtcctcgccggcaaaacagtggtgttgccgccactgttccacctccggccgccactgtcgcgtttcccgtgcgccggccgacgtcgccaccacctccctcggctccgcgacgccgccctcatccccggcatcacctcctcctcacccgaatttcgccggaacaccgtcgcccgcgccggcttctccttcctcctcagcggcatctcctccggctgcccttttcgccatgcccgtgcgtcagccggcgctgccgtcccctccctcggcacggtgacgtagccctccacctcgtccacccctcggtttcgcccggaagccgccgcacatcgccgcgaacctctccatctgcctcgccggagtgttcggccgcccgtccctcctcgcccgtgcaccggtcggccacacctccaccacctccggcatgcagcggcaaagccatcctcggcattgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgtcccacgtcgtcctcgtctccgtgcagccactgccggctgccctcatcgcctcctcgccggccccggtcgtcgtcgtcgtcgtcctctcgtcgttcccggtcgttgtggcgttcgtccctccgtcgagccgttctcgtccgtcgtccgcgttcgtcaagcgagccgccgcagccccatcatcgtcttcgtcctcggctccgcgtcgtcaagcctcgtgccggccgtgtctcgccttcgttcaaggatcgccgccgaagtcgttccctcgccgtccgtctccgccgcgcccgttcgtcgttgtcgttcccacgcctcgtcgcgtggtggtaaggttccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgttgacccgtggaccgtctctgtgtacccggtctaccgcggtcctttaggttgacatgtggggtccgcatgtcaacggcgcagccttcctgtcttttccaggctagcgtttacacatgttttatagttgcaaagcttaattataataatccgcaaatctccatacaacagcattaaacttcggatgatcatatcttggtcatacgagctccgaatcgacccgttcaagtctcttaatgtttgttataacctaaagaaccatgtgctttctttttatgtattgttattgcttctttataggcttgtagctttgcttgtgtgcttcgcgtagcttctgtcgttccggaggttccagaagcgtggttcgtggtcgtcgccgaaggttcggaaggccgttctctctgagaaaggcaagtcacatcatccttgaacatgttgaatcccagtttataaaattattttgatttaaattattgcattatcgctttatttaaattcccgcgtgatcactgttttatttagccatgcctatttacctttgttataaccttaatattattgttattgatattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgaaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttggtcaacaactaaaatgtggaatggttggcctaggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccgtatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgcgacaatagggcatcttttcggcagggggtcgcctgccgtggggatcttttcactgctccatttctttttcttttttttcagctggccggcagggggtcgcctgccgtgcctcagtaggggatcttttcactgcattttttttttgcagctgaaacggtagggcggatacacgccctaccgctgcccattgcagtcggggtgggtgtccctggggtggcgatggaatagaatcaaatcgagctaataaacaggtcgtgttgtctcagaatgggcgatatggtacaaaactcattaccggatggattcagtcggagccaaagaacagcgcgcagagcaacctagggctaggagtagaggtgcgtggcatacctgctctccactccacgtcgagggcgccgtcgaactggccgtgctggtgaagtttcccgccgcccggccgtcgccgtcgccgtcgccgctgacggccggatccagattctccggcagcatcaccagctggctgctcgccgccggtcttggggaagcggcggcgtcgcggagagtggagagaggtcgggagcgagcgagaagccgagaaggggaggaggaggatgacccatcgacacccatcgactcaggcaaatgcaggatgctgggccatgagtccacgatgagtccatccttctgacgacgcacgtggggccatccttctgacgacgcacgtggggctcgagcggaagctttcccaggcccagtttgctactgggctgatttatcttgtttcgttttttgagtttcactcgcatccttcaaccacaaagaggtactatattgcatccgtcaactatcaaaacaagtggaaatcgagtgtcatagttatttaaatgacggtttcgactgatttggtgtctacctaaaatacccttatggacatataaggttaacggttgatttatatcaagtttcaaaaaaaaatatgaaaacttttatttggcctccttacacagtataaaagtttgtatataagttttaatttttttcatttctattttttaaaaatataacttatttgttatatgctatataaaatattttttgtgttgttgtttttaatataaattatctttcatatgcaacataagatattttttgctattatctttcgtgtaagctatttctctatgatatacacacaaaaatattttctctgatatacacacaaaaatatatttttaaaaaataaaaaaactaaaacttatgtacatacttctttgttgtgtaaagaggccatataaaaaatttcatattttttgaaactttctaatgagataaattgattgttaaccatgtatgtctctaaggtattttgggtattttttaaaaaagaggcccatcataattgataaagtcatcagtatatagtagaaagagataatgacagtggtaaatcgttgaactgggataaactcagtagcatagaatagattatctcaactttatatacacatataaaaagtttatacgtatgtatgtaaagtatatacgtacgtacatataatataaatttttcatatgtatatacttttgatgtataaaaaatatatacacgtataccaagtttgtatctaatttaaacattcaaatctttcaactcgaaaattttaaaaaaataattatgtatagattttaaaactttagattctaagttttaactttcaaattcaagttgaaaacttccaagtcacctatttatttcattcctggttaaggacgtaggattggaacgtcgatgcgacactaaacatgtcataggtgcgtctccttttgctacctactaccgtctaaatccatgtacaaaagctgcttcagcaactatgatcagtagagctaattaattaccatggcgccgtcttcgttgctgctctgctggagcatcctctgcctcgccgtggccggcggcggcggcggcggcgctgccacctctgccgattcgctgcgcttgccgtgcctcgacaacccgccggagctgacggccgacggcgacggtgaggccggcgtggtcatcgatgacctggcaggcttcccggcctatgtcaccggcgacgtccactccggccgggccatcatcctggcctccgacatctatggttagtagtgattatcaactgattatcgagtgatcagctgttgtcgctgttaatttggtttcttcaggattcgaagcaccattgctgaggtacagtattcgtcaatttctttagagagaatcctttatatgccactgaaaattggtctgaacccttatatgccattgaaaattggctcttcccttatatgccattgatacaaatttgcacaccctctcatgtcactcccgttagttgaccgtgtgttgaccgttaattctcaaggaaaaaagacgtatttacccttctaaatatagggcatgcctaacaactcagagagggcaaatatgtcttttttacttgagagttaacggtcaactgacggtagtggcatgagagggtgcacaaatttggaccaatggcatataagggaagagccaattttcagtggcatataagggatcagaccaattttcagtggcatataagggattatctcatttcgttaacctcctcctcctctctttgtcgtcgttgtctgtcatctttctccgcaattttcttcattttctccacaaatttagtgaaagaaattaacacctgaacaactctagaaagagactgaattcgagggaaaataaacagagtaaacatgacaaataattgtatgacttaaaaggtgatattgtcatttttactcaattatccctatctttctgcagtgacatgcgtgaataatagttctcatcacccatgaggccatcatcagtgtttcaacaaataatattagacaatgctcatctttcatttcaaatagtttaatttcctgatctttttgggactaatcatggttttaaactattccctcccttcatattataggccactttgggtttgacctaagtcaaatatcgtcaagtttgataagtttataaaaaatatagaaacatctacaacatcaaattaatttcattcaacaactatcgttcaatatattaatttttctataaatttggtcgaacttagagaggtttgacctataacaaacctaaaataatttataatttgaaatggatggagtagttaccaatgcatggagaatcagaagaatatatactcattttgcaatttttccatattctatcctcccgctaatgatataaatatgtcaagcgggtttaaatatatatatcattttaatggaaaaattcatgtccacacatcgtgcatatatatcaagtgacaaatacagtgaaaattattgaaaatactgtacatgccaataatattatacctatgtgtaaagtctatgcattatactgaaataaataaaaattctgacagttttacaagtaaaaagccatcagattttgtccttagccatcagattttgtccttaggacaaacgtagtcggaactcttttttttgggcaaaaaatgtgtaaagtctatgcattatactgaaataaataaaaattctgacagctttacaagtaaaaagccatcagattttgtccttaggacaaacgcagtcggaactcttttttttttgggcaaaaaagtgtaaagtctatgcattatactgaaataaataaaaattctgccagttttacaagtaaaaagccatcagattttgtccttaggacaaacgtagttggaactcaatgaaggactgagaatgatccaatttcagtgttccactttctgtagaaatatcttgaattccaacaatacaacgacaaacccgtgatttcttcatgtggattttactaaaatttatgttttacgttccagttttaagtgcttccttgagcttcaaatagtacgacatcccagctaaatttatctcatacaaattctacttttattcccattctagattccaaaaacaatttacaagctgatgtgtggttactgatgctgacaatgacaattacagggacaatgctgacaaagttggtgaagctgggtattacgttgtggtacctgatttcttccatggacaaccttacaatggagacccaagtataaacgttacaaaatggatcacgcttcactctccggtaatttgtttcaccgtttacatagggggtgtttggatcctagagatattttttagcccaccccttttagccccaaaatagcttaaggggatccaaacaggaggaagtttacatcttgtagacacgtggtgtgactgttgtttctttttttcctctatttataactttttagggctatggtcttgtaattttttaatgctatatcaatatgaaatctcacatggttcgtttcaaaacgccaagtaataatgatcatagttgcattaaaaaaaccttttctagatgatgcttattgtggagttaattaatggatattgatcagtatattcaatttgaatttcaggtaaaagcagctgaagatgctaaatcaatttttgctgctctaaaaagggaaggcaaatctgttattggaattggg

SEQ ID NO: 64776 - DNA, 4775 bp, Oryza sativa
  unsure (1)..(4775): unsure at all n locations
nnnnnnnnnnnnnnnnnnnnnnnnnnnnnnnnnnnnnnnnnnnnnnnnnnnnnnnnnnnnnnnnnnnnnnnnnnnnnnnntactggtgataattaatgtaatcgtacattgatttacagttgagatgttttgattaagttttctcttgttaattttcttaaaccacctggcatgcatacgcattgtatgttttatgcatatgcactagttaataaactgttaattaatgtaggtgtttaatactacataatacttttatatatgtgtcctatatatagtgatgagatgaaatgaaccccctggaccatgcatgattatactctgctgttctcttttgatggttggttcatttctctgaaatttatttattgggtagttcaggataagggtaactactgaagtaaaggtcattgtcaaagtgtctcgctagctgcggtggttcacttcgttgcaacctcaagtttattcgtacgaacgtacggtatgttgagagatcaaaccatcaatagattagagacccaacagttaactgatcatttcttcgttagactctatgattattgagatcccagattagctctaagaattcatgcaggcaacaagtaaagtacctatctgtgacgaaatatgatactgaagacctggaagctagctgctctgtccagaaattctagtgtacagatcaccgctgacatcaacaagatcagtcatcctttacacttggaaagttgaagtcgatcgatcgattgaaaattggaacagattttgatgactggtcgcagcatcactaatctgctgacgtcaatgactctgcccttgtggttcaaaacttcaaactgtactacacttatgtcaaattcaaacacaaaccagttttccgcaaggttcaaataccgcgggagcagcctggtgagaaaaaccaaagctgcaggctaactgccctgacctgatcatcacaagtaatgtgtggaataatacagtgcccagaccataagttgcagcagcaaaaacaccacccaaactgtgtacaagcactctgaaaatgttctgcttatgttacagatcaactcttaaaagcatatgctttgagggaggcaacaaaaagttcttgcttaatttccctgttcaaagcactggcagcagtcaaaaatcagatttcttttaagagtaaattgcatcgtcggtacacgaacttatcaggtgggtgcaatctagtgcacaaacttgtaaaatattcattttgatgcacgaatttgtgtggtgcgtgcgggagaagtcaaaaaggacatgactaatgttattgacttagaggctgattaggatactatgttaacatatatatgaggaggatgccattagacatacacctattcaataaaatatagaataggatttagtgaatgtagaaaaagattaaaaaaatcgagcactgatataagggttagaaacatatgaaattcatcatttcaatgatgaaggataaagtagagactaaatttataaatattgcatgttttataataatcactgcacgtatgcacgtcacatcctaatcaacatcaactttataaaattaacattgccaaattattttggttctcgttcgcacgaactaggcaagttcatatactgaaacgagcattttataagtttatatactaaattgcacccacctaacaagtttgtgtaccaccaatgcaatttactcttcttttaatcttttcaagaaacagtagagcctaaagagatggagtactccatacaaagaggaaggaaacaccaccaaggacaaaagaaaatattcactgaaatcagcatgcaccagatttgtgatgcacagcacaaaggataatcccctgagctcttttgatgacaaagactgatggtggctgtaaagtttgatggggaatatgcctcccaacagctacagatatgtatagattgcagcccaacgctaaatctcaagaactgccaccaaatacaaaatgatggcacatgctttttgacaaatatggattaaattaaaaaaatgtgcagtccaggacaagctctaagctaacaggcatggaaatttcagttttacattctcagatgagttgaagttagaagaggagggtaattgagttgcagagtagctgaggttaccaaagaaacaagtttaaatttcatgtaacagaatgacctagcactacaacaatatctgcatggcaaaggcttgaatatactgattaactagcatgtcctagagtcactagcttggaaatcaaacggatcaaaacaacaaaattgcttttcaggtatcctgatgctctctcaatgtatgttgtatgatgtatgtggctgtacattttcatcgctgaacaggctgatgaaggggttagtagttagatatcctattctattctgacaaacctcttttctgcaatctgacaaggaaagtaatcgacttcacagcatgccgaagacggctaactgggagtccattcagtgttgggtgagacaactccgctctgggttcctcgaagctttcttttccattcgacttatcagagctacacccttgttcctcatcgctcccgacagtctgaattttctccaagggtatatcttcagtgtcgtggaactgacaataggcagaatgaagccggtggtgaatttcatccattcttcctgaccgttcgtcttccctgtccatgtcaattaaatcctgtacaatcaaaatgcagtagtcaatcacccacgagcaaaaatctctaccagtcaccacaatgatagaatgtggagaccatggggttattttttaatttgttgtccacttaagtccatcactatacactatgatggaactaatacgaacctgtgctggggtagttctgaataatgggagaagtcgatttctgcaatactgattgaataacagagtgaggatgataagaggtatggtgaagcctgcagctactggtgattctttcaggccaaatacaccaaggcagataatctgtgtgagcacgagagagaatatcactgcgttgtgtgcgattggccagtacaaaccccctgtgtcatatcttgtgcggtaaacattgagcaactgaaaacaccacgaatagaatatcattagcatggggaaataatagggttgaagaatgaagctaagaaataagaaatactatttcagtaaacattttttacaagaacatgcaattttctttccaaatttaattgcatgaaacagtgcgagctactcaacaaatataatggtgcagtaaggttcatgtaaaaaatgttcaccaccacggttacaatttgcaacataataaaatattcattgatgaagatattcatatttgagaataaaaatatgttatgaacatataatactccaagtagaaatgaagaggttcctcacctgattgcggtacacgatgtaaccaaggaagaagtacactaacagaaaaggtaagatcaaaggtgccagtacagagcatgtgaagcccagtagtccgaacagcaaaacttttggcacttctgtgtgatatgggaatgagggaacaaactctgtgtcttctggcatacgtagaatatatttcctcacaaagttccatattaaaccaaataattgcataagttcagatgataaactggcccatcctgatgtcagaacataggtgataaagaaggtagcctgaaaatatttacagaatagcagagagaagttaagaaaaaaactaagggacaaaaacagtatctttttggagaaacctttcatcatgtactccaaactattcatatcttctgaagcacaaagacaaaaaggtgtttggacaatatttacctggacaggtatagctctagcaagctggacagggatgtcctttgggcttgataacacattcaattggcttatgacagtaccagatagtacatttccaaagaatatgttccaaacagtgaagtacagcactttacagcaagcactcctcttcctttcactgtgagatataggcccctctaatgtagaaaataatatcattatcggtgcaacggcatataaaaatatttgcagtatgacactgggaaggtacccagttacaagctggctcatgtatttcctgcacacgaaagagtactcagtagatgctgcatagaaatgaatagaagcccgtatttctacattaaatattgcctcagcaacacaagagaaaaggaaacatcaaactgtgttcctttacacatttgaattgactaactgcagaacatgttaaattaattggtctaatcacaagaatagggcctcacttttaaaatatatatatatacatgagatacgattcgcactacaaataagaacaagctttgtaataacaagagattggttccattttaacatgtatacttacttctccagtatccccttcaggaaaggaagcctctgctgcaactgctctagctgagatagtccttgtataaatgtcactggtatcagaaagaataacataaaaacaattgaaccaaggagcgtagctattcggcgaatccaaagctgcttataaggtagccaaagatttgaccaatacacatcatctggttctggagctagatcagtaacccatttcatagggttagatgtttggagtatttctgaggcaacaagagcagcataccgagttctgaaatatacaaaagcagctgcacattcctggtacaattcaacagttaaagttactggttttatactgactaattgacgaactaccagtaaaagagctaatatt

SEQ ID NO: 64777 - DNA, 2174 bp, Oryza sativa
attctgctcaagcccagttgccaacagctggaaagaattagatgagggctccgcacagacagcaccggtatgaaattgctcgacacctctgatcaatagtgctgtctgtaaaaatgtttgaatttcctgtatgccttcttagcaccagtctgccagaatatgactagaattgttacacaataagaagaaagtgaaataaaaatatgcaaagccataaattcaattcaaggaaccggagattaatgaacactactctatataaaagcacagagctgagaatcaaattagtgggaagaatgtgataggttttgcttgtttcccccagtgattacccaactacaagatagtagacccaaaattaatatcaaatgacaacaactatcaaggccgtcttttaaaattcccaataaacaatcagcaatattctttattacaatatgttcaaatttatatgcagctcatcccttcgagtgcagattttaccattatcttctgaacttttccaactttgtaaacaacttgatggaacaggtagcttgatccatggtacttggtgaagaaatcatcaatagcattactgcatgattctttggtttcctttggtattccacgaacaaggacagtaaaatggcttggattgggcattgcacaagtaagatgacggagcctcagcctagcaatgtgcttgtactcctaaattatcagacaaataatgttatatcaaatctactcctcaatatgaggaatgagaatgtttcaattactcctaagagaaaaaggccttacaagatataggagaatgcaagctactcctgatattatgtacaaggctacacaatggacccaaagcctgcaatgcaaccggcatataaatcatatctttctcaaaaaaaaaaaaaaaaagaagaaattattgattctatgaaagtacttttgatgacaaatctattttcacatgtctttttttttttgcatttattagtgatttgattgcacacattctaaaatgtcgtctatttgagagcggagggagttctctaaatgccagcactcaagaggcgtaaatgtcatgtagaacattggttaaactaccctgtagtaaaactacaagaagtttctcatctcaccatcttgatctcactttcacattcccaattgtaaagatatccaatgattctgaaggaatccgaacatgatgtatatcttgcccaaagtagttcagtggtagaattccaaacacacacagaatggcagctagagagaagatgcgtaagctgttgaaaaacaaatgtattagcatgtaaatttggatagaggtaaaaaataaggaatataaatctttaaataaaagacaggggatgtgctactgtgcattacaacaagtcaggaacttatgctttatacagctacaaattttcttctccttctgattcatgcccatattgaagtttaaaaactcagcaatcagataccaccttctaataatatataaacaatacagggaagtaaaaatacctgaatactagaattctattgaaaacaacagcatctagcccagcagcagccaagtatctcttcctcggtacactgcagggcttttactatccagccagtagatggtacaaatctctccaagataaaagcttctcggagccgattatgctcctcggcaatcctcctcccaaagtagaccctgacattggctggctgcttcctcagaacagaatagagcgatataaacagcacagaaagagcgatattgatgccagcagaggtcagaagtccgctgattttcattccttcctagcaagtgcgtggcgcgcttatgtcatccaaatacaagcacaaatttcatccttggtacccagaggctcagcacctgcaggaagagatcgctaaagcaaatcaaatcaatcctgcaagtacaaatcgctgcaaattctgtaatctccacaaagagaaagagaaaaaagaaagatagcaaaacaacagataacatcatcactgcctatttctacaccatgaataaacaaacgcacattccaaaagtggcaccaaggtaaaatcagatttgagaatgaagccaattcctcggagtgggtgtacggacagtggaaccttggagataataagtagtaattaattggctaaaacaaaaagtagtggtagcatgt

SEQ ID NO: 64778 - DNA, 9440 bp, Oryza sativa
tttgcgtgtgagcatccgcatcaccacaacaccacgcgacagaaagcggattgcctgcaaactgcaactctacctgaccctgcaggcttagtatagaaaccaagcagaaaattactactacatcgcattaaccgcgactcctcccccattaacagattaaccgcaaccgcagcaagagaaggaacagaatccaactccgaaatcgatggacaaagaacggggattaacaactgaaatttctgtctaaaccaacgcgtagtaaatccgacgaactaaaacgaacaagtagagaagacgaaggaggaggcgagattaacttgcctccaagtcgaccgcccgctcgccggcgcaacacagcaaccgccgccgcctcggtggagccctgcgccgccattaagtgaaaccccaatagaatgagaaggaaatcaaccaacgaagcagcacaaagcagcaaaaaaaaaaaaggcagcaggagagcagattaccacggcgacgaggagtgggagtgggttaaatcaagcgcggccgcggcggcggcaatggcggggagatgcggactggattggagcagacgagacgaggcgaggcgagaggaggaagaagaagaaggggatgatgaatccaaactttttcctctctctctctctcgctttttcgatttggtttcgattttggtttggttttgatttgggtttggagagagtacgagacgagagtggaagggaagaagcccccaggagttattgcaaaatcaaatacggagtactacagtgtcctttaagttttctttttcttttttttcctccgaggaataaaggattggtgcattttactactcctatcaattttttttaaaaaaaattaaaattgagatgagaaaaaggagatgccacgtaaggtgggcagtggagaacgtggtgggggtggattggtcccaacagtggggcccacacgcacgccgtgatgacacgtggttctcaccgggccattggaatcagaggccaagcagtgtcttgtcatgcttggttaccaacaagtaaagcacacaattcatcacatcgatcgatcttgacatcaaattaatcaaagagcatgatttgattttttgtttatccagatcgtggccaaaaagtcccttgtaagttactcctatgcaattagcatctttatttgtgtttggatttgagttcggggagccttacggcatgcaccattcatccatttattcgtactaacattataagatttataaaaaaaaaagtcccttgtaagttactcctatgcaattagcatctatattcacaatgataaatactttcataatatataatccaaatattgttaacggtggggtttttttcctaattggaatgtatcatatcattttttttaaagttaccaaagatttgcttggatttattttttttcgccaaactttgataaatacaaaaaaaattctgtcataattttgataatattgtcaacttaccgaaataccaaaatttgtaaggtgtgttttagctacaatcttaacaactccctaagtgttaagttcctgtaaaaagtcaagctaacatccatatatataatatgaaagaggttaatacatagtatagtcacttatttacgtacgtggcagctgtctaaaccttaattaggcatcatcaatggaagggcacaggcaggtgagctaatccaagaccaattgatcaagccgaccaagacaaggacactttgcttttcttttccccatttttatggactttgacgtggctataagagaagaaaaatcagtgggcatgtgtgagattaccatctacgagtagtttccaccagaaattccttccatacatatatatatattatataaaatgcagatcgatcagcgtttcatccaaaaagatataatacatcggtttcttaatatttaacgccgttaacttttaacgtgatatttaactactcatgttattaaaaaaattatataaatattatttgttttattgtgacttttttcatcaaataaacttttacatatttacacaaaatatttgaataacatgaatgataaaacatcgtgcgaaaagtttacgctacgtgtagtataaaaaaaccgaggaaatatagaattgtggtacatattgagaaaattcggcagaagctgtctgtccaataataacaagacagtgatgacacacgacaaagatccaccacacatttcacatgcacgttgcgtacgtaccggccagccagcctaacatgcagcgtcatccacgagaaggagaaattctaaacaacacgtacgccagccaaatatacttgctgatgatctacaaattgcatgtcaatttctctaaaaaaaaaaagaaattgacatcatctgtcatccttccatcgatgatgctttgtgttgtctgagtggctaattgttaggatcagcctaactctttgttctcaaaatctgaatcgtaatagggtcgacgagggtcggtgttttaaactcggaataagatcactttgactccctcaactgaccaccaaatctaaatcgtatccctcaatcgcaataccagaaatcttgacccccgaacttacaaaaccagtgcaatttaactctctcggtggttttagagggtggttttgctgacgtggcgcatatgtggcagtgttgactcggtctttgtgccacgtggcattgacgtggcacttatgtggcactaaaataaaaatatatatgcggggcccatttttcattctcacaaaaaaaaaattcccgccgccaccgccgccgccggggaaggcggaaatggcgggggcggcggagggagggagagcgaaccctaccacgaggcgccaccagaggacggcgatcaacatatctcctcctccacggcatggcgtggtggcgcctcgccggagtgcgcggcggcgcgtaggcgtagcagctcagcttaggcttcgccctaactctcgatcccaatccccatgcggcgtctctacctctaccaatcaggtcaggctccgatccccattcgctcgtgctctcgtcggcgtggaacaacaggtgcaagaagctgggcaggctggccaagatgtccagcgccgacgtggaaggggccgagaaggtggaggaactccatctcgtgatggaagagtagctgcctagctagatgctgcatggctgattggtttcaagtaatttcatgggtcttttgttttttgagacagtccattttgctcagtttgatgtagtgatgttcatgcatggcgtgcaaagtctgaggacttctctcattttgctcagagagaattaatccattttgtgcagagtatgaggacttctcaagcaaatgattttaaccaaacattgcaaatgattttgtgcagagcctgccgccggctcatgtaagggcgggagagagagagaaataagggagagaggaggaagaagaagggtagtgagagagaggatgagatgtgggacctacatgttagtggatcccacaattttttttaatgacaaatgggcccacatattttttttcttttaatgtcacctaagcgccacgtcaatgtcacgtgggataaagaccaggtcaacattgccacgtgcgcggccacgtcagcgaaaccgccctccaaaaccaccaaaggagtcaaattgcaccggttttgtaagtttaggggtcaagatttctggtattgcggttgagggatacgatttagattcggtggtaaattgagggagtcaaagtgatcttattcctttaaactccgaactcctatggctatttcgtgcgctatctgtaggcttagatgggcctgagtgggaatgcgactctctcttctggttgggccagaacagtatcaatgacatacatgcggcccatatttattgggccggaacgggattgctacttcgtgcggtctgtatattatggagtcccccagtttatctcttctctacaattataaaaatcgaagatatttttgccggtactttgatacgttatttgagttggtttttaagttcgtttgcttttagaaatacagaaggagtcaaataagaaatctattttttttaaaaaaaactcgcatgttaatttgagatgaacagcctgctaactgcaacttattatgattttctaaaaatatacatatctaagcgaattcctatagtcaatttcaccttaaataaacataacaataataagattaaaatagttttcacctgttaaaacgcacggatattttttttatataagaagaagaagaattgaagaagaagaacggtgaaattttctttaccgccttcacccacgtgcaagccgaacggtgaaatttcctccgtccatatccgattccgtctccattaatccgtcctaattcatgcaatccatatcctcctcaaatagaatgcatgcagtagctagcgaatctcatattttaactcaattaaatttcccaagccagcaacgcaattaagctaagctagctacgcatggactgctgctcccagctgccgggcgaccttgtcgccgcgacatcctccgccgcctgccgctacgcagcctcgccgccgcgcgcgccgtttgccacgcctggcgtgccatcgtcgacgaacattccctcaccacgcaggcggtcgcgctcctcccaaaccatctccgcggcctcttcgtctgcctcaatgaatcgtgcctccatggcttcttcgcccgtccctcgccgccggccaccatccccggcatcgacctcgactacgacctggacgacgatgccaccatcgaagtccactgcaacggcctcctcttgctcgatcgccacatcgtcaacccggccacacgccagtggatgcgtctacctcctgtccccccgtacgcctcactgcccaacataatgtacggtgatcggggcctcgtcttcgacccagcagcgtcaccacactacgacgtcctctggatgccctacctgattcttcatcgactccctgctgcgtctctgtcggatcagtggccgccgtcgccgttcatcctgcacgtcttctcctccacgacggggcgatgggaggagaagtcgtttctccgggaaggcgacgccaccatgggcaccatggctgatgtatccttggcaagggtaccttaccactgcaagactcactccgtctacctccggggagcgctctacatgcattgccagaatgattgcgtcatcaagatcacacttaacgaccacaagtatcgggtcatcagattgcctggcgactctgcatcaaacagaaagactagggaccctttcctaggaaaatcaaaagacagagtgtgctacgtattggtcaccggtctaagtcgactccaaatttggctcctcaacgaaacttcttcttcttcttcttcttcttcttcatacgacgacaacgagtgggtgctcaagcatggtgttgacctagggccaataatacaaagctacccctgcaaccatggtcgtcagcaatggatatggcataatgctgacactaaacaagacaaaaccagggaattaccagctgtaaatgatatggaggaatttgaatgggctatcgataaggactctgatgacattattagtggtgccaatgaaagcatccaccataatggagaatacatctccgctgtactcggatttcatccttttaaagacatcgtcttcttgcacgatacaaatttaagagttgttgcatatgactacaacaaggcaaaggttcaagacttgggtatgatgttcctataccataatacagatagagtggtaagctcatttccatatacaccttgctggatacgtgatttgcctggaatgcactacggttgattttaatgtatatttatggatatatgcccacgttggacggagcggagtttgattgccctatagctttttcactcgtttatcatttgtaacaaagagtgatttatttgtttgattgtatatccggaagactggtccggtatattttgaaattgacaaagtaacccaatcccttcttcctataaagttatcccccactaagtgcaattaatctcctaaagctcaaacctcaatgttccacgtcatcattaatttacagccgttggatcggtagattacatcccattttagccgtcggatggaaaggctcagggttcacagcacgtgaggcccatgtcaccttcctcctcccatctcattctcatctcaccatcccacgcttttggactcccaaacgacgctgttgcctttcgtcaacccccacttctccttccccgccgccgccgctcgccgcccgcccgcccgcccgccatggatgaggagtacgacgtgatcgtgctggggacgggcctcatggagtgcatcctcagcggcctcctctccgtcgacggcctcaaggtacctctctcctacccaatccgattgatccgccgcctcccgtgctcggatcggtgcttgatccgtagaacggccttccgcccccttcatctcatctgggcttgacgcagccgcactcggatgagctgctgctggttgcttttttttttttacctcgccatttgatcgctgcacagagatcgaagggagggcctgccatggccgctcaacgtactcccgccccctctccgccctccactgccttctacacatcggctcctccctctccactcccccgcttttgcacccaccaccgcatcccccgcccggagaccggcaacgacggagggttagcttcgacgagcgaccgaccacgagatatgatatgagttcatctgcgccttccctcacagcgtccacctgctgatcatcctccaaaacccggcggaatggtaaagccgcctacctcttgcgtccgcctgagggatgcagtcgctgaacatgtgttgctcatgtttgatcattggcatgctttgcgtgaagcttcctgattgtagcaattcgtttaatgcggtttcaaatcgaagtgatttaatatttttttcccatgttaattcgttttagagttcaaaccgaaacatcattttagagagatttttattttgtagtttatagaggattacaatgtttctgcatatataggtaaaacatgaatgcatttaaacaccattgtaaatttcccaatgacgaatggaatcatgagaatatatccaattttttcttctattgctggggcgaaagttaatattatagtaggttctcatgtttgggctgaagaccctgaacttgcctgggtcgatggagaagttgttaagatcaaaggcgaagaggccaagatccaagcaaccaatggaaagaaggtaagctgctaattcgtttttggccttcagtttgatgtactgctacttatgtttgtgctgtcaattcttttagatcattgcagctgctggtggagttgatgatatgacaaagctatcatacctccatgaaccaggagttctgcagaatttggcaaccagatatgaacttaatgaaatatatatatgttattctgcatggccatttactgtaaatatgccattgtttcagtcgtactgtatgacctataactttaacattttgacagacatatacgggaaacattctcattgccgtcaatcctttccaaagattgccatatttgtatgatccacatatgatgcaacagtacaagggagcaccatttggagagttaagtccacatgtttcgctatggcagatgttgcatacaggtaaagtaaatatgataggtggtatttgagtcatcagtgtttctaactttctactcctataaatcgtggatcatcctgctgtctttttacatgaaacagagcaatgattcatgaagggaaaagcaactctattcttgtgagtggtgagagcggcgtgggtaaaacagaaacaacaaaatgcttatgagatatcttgcctatttgggtggccgagctgctaccgagggaagaatagtagagcaacaagttctcgaagtaatgaatcgagttcttatttttggaaggccattgtattattaaattagttatattccaattgaatttttgctacatattctttttatgtctgcagtcaaatccagtccttgaagcccgatccgtagatcggcccctgcccccttcatcttatttgggcttgacgcagccgcactcggcactcggatgagctgctgctggttgcttttttttttttatacctcgccatttgatcgctgctttacttacctattcaagcgtagcgggatggtaaattgttcatacatcgtggctgggtaggtggtgcgccatggttgtggtggttgcttgcgtttggggaggaattgtgagtgcgtgcctgagcttacgacttccctatcccacttaaaagagtagcggcatagtgattttgggggagttcagctaacagaacgatgtatttgtcatgtatttgaaggtgttgcacatggataggaatgactactatgaaagagattccacctcgctcatcgttaaccaggtaagcaattgcaataaacttaatttgagcagtagagagtctctatatctgtgtgctcatatcatgtcaaggaatgcttatgttattacagagtacattatttgctataagatagttcaaacaatcatgtatgtctcaattggcaacctttcattcaacattatattcctcctcatattaagttgcactatactataagtcattatgtgttgcaagcagtaaaacaaagctccacattgttagcttatgagcttgatatcatttcaagtatttcttacttcagtgcctattttacctatcaatttgttttcagattcaaataatacaatctaattgttcattcttacatgcatatttcatcttttctaatgtgcccgccgcaacgcgcggggtttcacctagtttaaaaagatgaggaccggggtttaatatttatgatattttgcgatttaagatataattcgaactcggtatcaagatgagtaacataacatgaacttattcctagatatgttggcataaaataaaaggcccagtgagcccagcccactacgcaagttgaatacaccagtcatgatggcttcttcttcttctctagcgcggtggtagcatcttgtcgaggccgaagcgcttggcgaagaaggcgtcgcgcgcccacagcggcgccgccgccagcgccgcgaacagcaacgtcatgttcccgtacacgatctcccgcggcggccgcgcgctcatcacccgccgagccacgtgcgccgcgaacacgccgccgtccgtcgcgccccccgcctgcgacgcccgcgccctctccgcgatcgccgccgcgaactcccggtacagccgccactccgcctgccctccggcgagctgcgccgtgttggcgtggcccagcccggacctcaccgcgccgggcaccaccttcaccacgtgcacgccgaacggccgcagct

SEQ ID NO: 64779 - DNA, 10792 bp, Oryza sativa
cgcgcccggtacgccgcgacgccatgtgcggcgccacggcgcgcaccatccggagctggccgaggaagttgacgtccatggcgcgacgcccggcctcgccgcggagctcggcgagcgggccggtgcacccgatgccggcgttgttcaccagcacgtcgacgcgcccgtgctcggcgaggacgcgcgccacggcgccctcgacgctctcgtcggaggtgacgtcgagcgggaggtggtcggcgtcgaggccggcgaggtcgggcacgcggtcggggacgtcggtggcgacgacgcggcagccgagggaggcgaaggccttgcagtactcgtagccgatgccgccgttggcgcagccggtgatgagcaccaccggcatctcgggcttgtcgtcgtcgccatctccggcgtcattaggcggcgccatggattattagtgcggcaatgcaatgcacgtaattataattgcaacattgtgattggggtttccgtcaccaaggaatatgcaggagggatatgcggctgctcatggcgtcttccgcttggaattaatcgttttcgttgccgttcatgcatgctcgatccatttcgttgtgtgtatatgcttgtttatttaggatttcttttcaccgtctgtgtagcatgatttcgatcgccaaattaagtataaacgctctgcttctcttcactgaaaattcagtttagtctcttgttttactttaggcccattgttttggttttgggctctgctttctgaaacagtgctcttgtgtcttcaagcttcaatccagaattccagagacaaagcccagcatatgctccaagcttatataatactatcatgtagcttcagctaagttttctccattcagatgaagatttttacggtacaatctactggcagtatacaactagttttgttttctgaaggaaaaaaaaaaaacctactcctggaggctggaactatcaagattcagtctatgtctatctgcaggtagctagggttggtaatctgacttaagcgtacccaggttataacagaattcgattgctctgagaatacattagttattacttgcacaattggactgacgaatcttgcttacctgcttaatcagcatgtattaaaacgtctaaacagcggcagaatgggcaaaaaaagattcatgtgttcctttctgctgattagccatttgaaatgcttacaagccagtagcagcaactaaacaaaaagacacacgctagatgcaaccgtaactttgtaagtttctgtagaatgacatatgaatcacattactctgactaattcagagatttagaaacgtagtactaggatagggggcggctgcaaaccaaaaccatctctagaaagatttccggacatgattaactagtatagtcattttctgatggaaaatttgcccttcgatcgtcatcatcattatattatcatcatatcaccccgtttgtcactgtcacgcagtattttgaaaattgcatttgggaagatttctattttttttttggatggatctacttgtacggtattgtgcaagacaaaaatcagcaaggaagcttcattcttgattgagctgcctgttttgttgaacaagaccagtcaatattccgagcacactaaatgataatattagcagagagtgactagaatagaagtcataacaaaagatagagaataagaaaaagaattatatatgattatgcaggccaaatttatgacgatgttggaatagtcatttgcaatcagatgactgatatgcgactaacatacgtagcattaaaacacatatgtacatcatggccagataagtaagttttactagtaatttaaaattaaaaggacaaaaattctctaagatagcgttgtttttgcatgcataatattccaaagcattaaagaactgttggcgagagaactatccaatttctgattagttgctattttgtagttttcccggcaatttggtgctcctccttccgggtgtcagtagtggtcaatgttgatggtttggcatttttttgtggcctaccacggacatgagaaggattttccaactccttgatagctactgcttgcaataatcttttggaatttatcgagaaaattccttatatgatcctcatatataacacctaatcagtctataaactcaaatttggaataacaatttttcatataacacgcagatagctaaaaccatcgacggattaagcaagatgaagtcttcgattttcaaatagtttgttgcaaagttaatgcgtgattgggattcggaaacccacatgccacatgcttgactgttaagtctgtaactgacagacaggtaaacaattggcattctacagcttagatcagatgcctccttatatattttcgtaggttctgaactatgttttctttataatcacaaaattcgtaatcaaattacatgacagtactctgtcctaatatactccttttattattaattataaggtatattttgttttgttacaactaataatctctttactaatatattatttatgtaatgtaaaagtataaccataagtttttttagatgcgaatctaataacattaattttgtaaggaaaaatcctaatagaaagggagggagtagctaaaacttgtttcttcagaagagtaatttgaccctaaacttgtagtatatgggaagtcaagaacttgctttgactgttgtattgtgagctgtaagtctgtagtaactgatcggcacgaggttataggaggtttcatgtgtaaacaaaagcctctgccatttctatgaaaggtcaaatgtagtgccatcaacttggcatagttaattttggtttctactattatttcccccccccccctcaatggattcaagttttggatgtgttattcaaatcgatcacaaaccaaaccttccaaatggatatgttttgctcaaaaagaaaatccaaacaaccaccaaacacgagtatatagaacctaacccaagaatgaagccccatcttctagatgcaatataatgcatgcacgaacgaattaattcatcctgctttgatgatgttacacaatttttatagctagcagtcgtactgacgaacacattgccgccagttttgttgtactggatgacatgcgtgtgtttgtgttgaaaaacaccaaggcaaggaaagaacaaaccaatgacaaaaagaaaaatcagataaggatgcttgtgtatgtatatgatgtcaatctgtcgctgttgaacttgaagctcatctactctttaacgaattcatgctaatgtactgtacatccaccctttgcttgcaatctctgtatttctttgcttgcagcaatacatgatccattttattttatagctacgtacataggcgtatatgaatgaaattcagttagaaaaaccatgggaaattaaaataagtacatcagtgatcaatatcgtcttgcagttgggctgttggctaaaacaaatactactaacaaacaggaaagaaaagaaaaaggagaaaaggagatgaggtcacatgttccaatccgttagccttccgtgttccaagctacactaaactgtaaccgaaacaaattaaagagcataataagctccattttgaagggcacacacactacccacacgattggcatgcatccgtgcatgattcattcatgatccatctccatcaatttctccactgctaaaacccctctcatctcatctcatctcctatccttcttccaaaccaaccaactccctacttcttctactcctcgtcttcgttcgtcttcgtcttcttgtacaattaattcctcctctttctccgcccaagaaacccacaccaaaaacatcttcttcttcttctccgtgtcaaaacaaacactgtttctctctctctctctctctctctctttctctgtgttcagagccaagaagtctctgctctgcatgggtcaggaagaagcagcagccgcgccggccaccgtgatgttctcgtgggagcaggagctgggcgtgcccaagcagaagatggcttctgacgaacgacatgcccgagagccccaggaaggcgccgccgccgccggcgcggcggctgtcggtgccgccgcctccgggggcggatgctgatggcggggagcaagagcctctccaaggcccgggccgtcccggccggaggacgacccgttcttggcggcggtacctggcctgcaccaagagcagcaacggcggcggcggtggcgttgcgcgggagagcaaggggcagaggcggtccagatgggccgggcttgggcttgggcttgggctcgggctctcttgcaagagctcaaatggagttgtggaggacagcatggtgaagatggccaaactgcctgaggttcatcctagggatgcttagtgatgatgatccagttaaatatattctcatcttctaccagtctaaaaaaatcatcttctgtctcaattctcttgtttgttttctttgatttgtttcttgatttggaatttttagtgatggtgatcaagacttgcttgcctgcttggtacttaggaattaattagaggtatagaggaaggcacatgtagatgtgtgcttgtttcatctttctttgcaaaatggagcatatcatttgtgcaggagattatcaagctcatctgtctataagttcaagattgtgtgtgacttgcatgctcttttctctctcgctctctctcttggtgaatggcgtccgtttttgtgtgaatggcaacttagcttgtcaaagacacagtttgaccaaggtttcctagaattaattccattgatgttttaatttgttcatattgaatggctgaatgtttagtgaatagagaattgctatggttgttcaacaaacgcaggttggtgtatgcatgcgccaccctaatacctgtagaaattaagataaaagattgtacttgtgttcccggaaatatatatagatgtcacccaaaagaaaaaaagaatcagatgtcgtcagatcccaagctgattatccgtgatattttgtgaaagcatccttagttcagtttttcttttcattttatttatttttttgagaaagcatcttcatcagtcaagttctctctctatagacgaaggtgccaaatcgcaatggatcgatgtttagtactcaccgagaaagagctgagctgatgaagttgaaatatatataaactcttctttttttatacgttctataattgattgatcaccgctgttaagtccagtccagatgtaaaaaggacattatttttttccaaaattttactccccagtcgctaaatatctgatgctattaactttttaaaatatgttgaccgttcgtcttatacataaacttttgtgaaaaatataaaactatacttacgtatacataaaaagtatatttaacaatgaatcaaatgatagaaaaagaattaataattacttaattttttttataagacgaacggttaaatatattttaaaaagacaaccgtgtcaaatatttaggaacggagggagtcggtactggggttcctagggggcgcgtgcgtgccggctgcttaactggcgcagccgcgcgcgtccccctgacgactagttcacgcgctgccgccggtaattatgataattagtgttaattactgtcattagcattatttttaaaatagtaacaacatacataattcataattcagttaccaatctttttagaaaagtaattgaaagttttaaatttgtagtcaaaagattttgaaatttgagttgaaagttttaaatttttatttcaaattttaaaattttgacatagaagttttcaagttgagttgaaagtttttgaaattgaagttgaaagttttcaaatttgagtcaaaagtttcaaaaattaagttgaaagtttttgaaatttgtcttgaaagtttgtaatttgatttgaaagtttcgaatttttagttgaaagtttttgaattttgagatgaaaattctaaaattgtgagttgaaaactttcaaatttgaatcgaaagttttcaaatgctgagtggaaagttttcaaattctgagttgaaaacttttaaatttgaatcaaaagttttcacatgctgagtggaaagttttcaaattctgagttgaaagttttcaaaattttcaatttaaaaattaaatcttttgttaaaaagtttagttaaatgttctaaccactgtatgcatgtatgtacgtgggttttccaattacaattagcacatactactaccaattgagtgtgttactattgaatcatcgttaatcatcgttgaaaaagtcattaggcccagcaggtgtagcgctcgttccgtcgtggcgcctagcggaaaaactatctcttaaaaaccctaattgcgaaatccgttcccttgcttgttgactagtgtccgtgccatctcagatctcaaatccccgatctgtcgccaagttcaatcccgaatccaaatccttcccaaatcaaatccctccgcaaaagtctatttgcctccctcgggttcgatgggccgaattcctctcggcccatctccccctccctccccggctctctctctctctctctcgcccgctctgccgtgagccgcgccgagccctccctcccgctcttgctgccattcccgccgatgccgccaaatcgccgcgccacccgcgcgcgcgcgccgtggtggccgaccggccagtcgccgccgctgtcagcacctgccgcgcctgccccgcgtctgccgcccgtgtcgccgctccactccaaaccagtccaccgtcatcgccgtcgtcatcgacccggccccgccaccgctaagcgctggcttccaagggacgaaggctgagccccgccccccctctgccgcatcgccccctctccctcctccttttccccgaagtggcaaggaggcaagccccctttctctccccctttttcccttttccctcccgctggcgtcatcctccccccctgtcgccgctttggccgcgaccgcggagcgctggctcgctcccttgaccgcccaaggtcggtttccaaaccaacatcgccgccctataaacccaagcgcctcccttcctctttcctctcccaatcttccccgtttctcgcccgcgccattgccgtccctctcgccaaccgttcgtcgtcgcgcgtgtcggaggagccgccacgagcgaggacgcggaaggggactccgggcgctcgtctccttcctcttccccggcccgaggctagagaaatcactcccgtgccagcggcctctcgtcactgcgccccatcacccctgcacggtagtgtctccctccgttctctctcctcgttccatcttctccccttagactcgggtagtagcacgagtagcctccccgtagctagctggcgccgccccgaccgttgccgccgcccgctgtgtgctcgccgccatcgccgcccgtgctccgtagcacccgctcgtcaccggcctcgctcgacgtagctccgcccaattcgacactagcaacggattcccgtagccgtgtagatgctctcgccgccgggaatcggcccctcatgacctcatcactgtttcccccttctcccaccgccggttgccgccgccgcaatccgccgccgtcgagcatcccccggcgaatccgagctgttggctcgtctcccctcgtcctgtgcgacatcccggtgtgctcgccttcgcctatatcgccatggttcgctccgccgctcgccgctgtcgttcgccgtctgttccggccggcgtcatcgtctacctcccgacggtccgcgtggcagccacgtaggcgccacgtcggcgccacctcggctgcgaccgggtcaagcagaccccggtccgccgcttccctccgccccctcgcgcgcgcggtccaccgcgagccgtgaggctgcgcgtgggcctgccgcaccgcgtcctccgcgaaccgcgcgcatgcgccgcatctcccttcccaaaccctagcacaccccgcgtgcacctcgctcacggtgagccgagtcaccgacaagcgggtcccacccaggaccacgcgggatggacccggcccaccggctctctctctcccctccccgcccgcgcgcgccttgggccgccttcttgggccggccggcccattaagctcggccgagccgcccctttctctcaggccgcgccctagccgcccgagtaaagtctaatttccctccctccttcttttcttttctttttcaaaaaggatttaaataaatccttttcctttagaccaaaaatccaataatcttagaaattcaatatcttcccaaccgtaagcccatttgactccgttcaacttccaaaactcctcaaatcttgagatctatctaatggcacgcctagaggtccataatagggctttattttcgccgtttgttgagttgtcccgtttcgcgtgtagtttcggagcctgaagacccgcagtgcgaggatttcgaggatcaagctcaagatctcgagtaaggcaagccacatttgaacatcttgaacctatatttgaatgtaattatgttacttgaaaaatattatgcattgataggattgcacttaatctgtttgccccgtctgcaaggcagaccggtgggcctacctaacttgttgcatctgatccttccattgttaattgttatatcatgtttccttgtaaccacctggtcacgcctcggtattcgtgcactccgtgcgagtatcgacggtcgcattcaaacttaaaatctgagaaacatcttgggtaaaacttgggttttacaaaagacttggaaaacccgacacctgggtcggtgcttgcgaactaaatgagtttccaaaatcgtggaccggggaacgtaccgggtgtacggtttcccgctcttgcacttaaggaccgtttccttggaatttcatccgaacataagacaagtgcgaccacatgggtggaatgggacacccctggctgagtaactagctaaacgggggagccatgatgccaagagacatgtggatttaacggggtggtgtcggggagaacccccgggtttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgcgctggatgatccgggttagtaatgtcgtgtgggtaaagtgtaccccctctgcagaggttattaaactgttcgaacagccgtgcccccggtcatgggcggatgtgaggtgattcctagcgtagttttgtttgactactgctttgtgaaatttgctgaggtggtttgggattgatgtttggaaaatctgcggctgatgggatcagccaggcccgggtggccgtttgaaagctgttggccgggtgccaatcttgatcaattcaaaagactgatatattgcacatactccgaccggacgagacgcactatctcatccgtgtcgtttgagaagcactcacttagttgtttcagacaagagtttaaataaaatcaattgcaaaaacaacagcctttccttgaagcctgcattaaacacttatttcccatggcttgctgagtactcctgtactcacccttgctctatataaataatccccccccagttgctgaagaagatgaagcggatcccgctgacgaggagttcttccaggagcaagtcagctacgatgagttttagggttttcggcctagttcccaagtcgcgcctgtgatgtttggtccaagtcttggtttccgcttcccttttgtaatgcagttgtaagctcgggatctgtccgcagcccaacataactatactcctactctataataaagagacctctgttgctgtgatattctgtcttcctgtgataccagcactgtttcctgggactggtatcgattaacaggttaatttggagcgtcacgggctagttccgctcgggactagttcgaggcgtgacagcaggcccatgtcagacacgaagttgaggcattgccgtcgcgaaacgctcgcgacttgctgatctcgcgcgtacgcgcgaattagcaatctcggtaggtactagtctttttttctgccataccctaattaagatggatgattatgagccgtccatcggatcaatcggattcctgtagtacgttgcaattgcaaaaggaataagttcacttcatgacccttaaaagtgatcgaaatctaaaccatgaccctaaactacaaaactggatatctcgacccccaaactcctaaaaccggtgtaatttgactccctgggcggttttgctgacgtggcgccacgtggcgcctacgtggcaatattgaccgagtcgttgttacacgtggcgttgacgtggcacctacgtggcggtagaaataaaaaatatgcgtgggacccgtttgttattcacacagataaaaaatgtggggcccactgacatgtgggccccacatgtcatcctccttccttcttcctcctccctctctcccttctctctctctcccttgttcaccctcggccggcggcggggcatgggctgcggtgtggtggcggccggtgggagctgaagcgccggcggcagcaggagatagctggaacgggttctggagcgccgccggcgtggtggacggaggtggcgcaaggagctcgtccccgggtcaacggcgatggacctcggcgcgacgaagaggcggtcacccccctccgacggtggcggcggtcccccgagtggaggagtcacgatg

SEQ ID NO: 64780 - DNA, 2108 bp, Oryza sativa
agcagggccgagccacccacccgccaccgctgccgctccggccttccaccgcccgctgccgccgctccagcccaccgccgccgccactccagctagctcccgctgccgccgccggccgaagaggatgaaggggagagagagagagagagaagggaaagagggaggaggaagaaggatgacatgtggggtccacatgtcagtgggccccacaattttttttatgtgtgaatgacaaacgggtcccacgcatatttttttatttctaccgccacgtaggtgcgacgtcaacgccacgtgtaacaaagactcggtcaatattgccacgtagatgccacgtggcgccacgtcagcaaaaccgcctctcaaaaccgcccagggagtcaaattgcaccggttttaggagtttgggggtcgagatatccggttttgtagtttagggtcatggtttagatttcgatcacatttgagggtcatgaagtgaacttattccattgcaaaaggagaagggctgggccggcttgttcatgggcctagtacggctgcgaaaaatacagggcggcccagaccatatatgggccaattggaccaatgtgttagctttcctcggatcagccttggactctcgattgaatcaaataatggaagtttttgaaagaacccatcgagctggttttatattatagaagaagtgagagaaactgtacagaagagaaggcaggggaggcgttcccagagaaactcttcctgcctgcactccctaaaaaaacaaaagcctaatctcttaacatatgataatacacttcactcccttgacacctgccatttcccacaaatgaagctcatctatgatcttgctatggaacaaactgatctcaatcgaaattcgatagagctttgtaaacgcgcgtcaacctgttaacagtgaaatttggtaatcggcaaagacgtcatcagcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttaggaaggtgtgtttagtgtccgataaggactttatgttttccttttatctttaggttagtttctttcttgtctgacaaggacttgtatcaacccatgggtataaatatgtacacccggggtctatgtaatctatctccacgatcaatacaattcggcgcatcgccaccttttaccttttctactttattttatcgtccggtgggacttggcacttgacgcggggctgcatcggtgttcgatctccggcgaagggataagtccaatgttccgtcggtccaggcaattgtatcgtctacgtcggcgtcgttcaaggctgcatcagtacattcgacctcttggattactctggtttggataatatatttgcctagctatttatcatatgtctatgttaatctagtcctagcatctcaatttagctctatcggttgtctctcgctttagggtttccgccggtatcggctaaatcgccttgctatattagattagcctagacatctaccaccctgaaaatcagtcaacggcttgattgtctagatattgtgtttcttttcatacttagtgctgcatcagttaagtttgatctactaagtcgtgcttagaaccataatctctcgcttgctttttgactgccaataagggtttcatcggggtttcagccgatgagttatctggacgttgcatcggctcataaggattgcatatacatataagttggatttagccgatcgcaacatagatttcactgtttaatctaatcttgtagatttcatgacatcggacctctgtagcgcccgttccgtcgtggtgcctagcgggaaaattatctcttaaaaaccctagttgcgaaatttgtttctttgcttgttgtctagtgtccgtgccatctcaagatctcaatccccgatctatcgtcgagttcaattccgaatccaaatccttccaaatcaa

SEQ ID NO: 64781 - DNA, 3628 bp, Oryza sativa
tcccctctcccccgacccatctcccccctctctcccgggcgctctctctctctctctctctctgtctctctccctctcaccctccgcctcgccccgcgccgcgcgcgagcgcgagagccgcgccctgcgcccctccgctctgcccgcgcgcgtgcgcgtaagccgcctgcgccgagccaagtcctccctctccgctccctcgctgccgcttcccgcgcgccgtgttcgcgtgcgcgcgcccgcgcggacgccgcccgttgcaagccgcgcgcgcgagccaagtggccgaccgcctggtcgccgccgtcgtcagcgtctgtcgcgtctgccgcccgccgtcatcgccgtcatcatcgcccggcccccgccactccgcgcgctagcctccaaggggcggaggcagcgtccctcctccctctgccgcgtcgcccccgctcccctcctccttttcccgaatcggcaaaggggcaagccccctttctccccctccttttcccctttttcctcctcgccggcgtcatcctcctgtcgccgttttggccgctagccggagcgccagctcgcgccttgaccatccaatgtcggttcccctctcccaaaccgacatttccgcccatttaaacccagcctccccccctttcccttcctctcccattcgcccccgtgccattgctgtcgcccctgttcgccgtcgccgttcgtcgtcgcgtgtgtgccggaggagccggtgcacactaggacgcggaaggggactccgagcgcgccctcttcttcctcttccccggcccgaggccggagagattactcccgcgccgtcggcctctcgtcacagcgccccgtcctgcacggtagtgcctccctccgttcttcctcctcgctccatctccccccttagatttcggtagtagctcgagtagcctccccgtagttagccggcgccgccccgagcgttgccgtcgctcgctgtgtgctcgccgccgtcgccgctcgagctccgtagcacccgcacgtcgccagcctcgctcggcgtagctccgtccaatccgacgctagcgtcgagttcccgaagccgcgtagatgctctcaccgccgggaatcgacccctcgtggcctcgtcgccatttccctcttccctccccgccggttgtcgccgccacgattcgccgccgtcaagctccctccggcgaatccgagccgttggctcgtctcccctcatcacgaacaaaagcccggtgtgctcgcttttgcccgtatcgccgtggttcgctccgtcgctcgccgccgccgcccgccgtccattcgcggccgggtcgtcgtctacctcccgccagcccacgtggcagccacgtaggcgccacgtcggcgccagctcagccgaggtcgggatgggccaaccccggtcagtccctccccgtgcgcgcgttccaccgcgagccgtgaggctgcgcgtgggcccgccgcatccgcgtccaccgcgagccgcgcgcgtgcaccgcgtccttcccccgcccgcgcgcgtgcgccgcgtgctccctccgcacggcgagccaagccactgacaagcgggtcccacccgggaccgcgcgtagtgagcccggtccaccggactctctctccttcctccgcgcgcgcgcgtcttgggccgctctgggctgccttcttgggccggccggcccgttaagatcggccggtccgctccaattcccttgggccgcgccttagccgcccgaggaaaagtctataatcccccccctcttttcttttctttttcttttccaaaaaggatttaattaaatccttttcatttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgtagcgcgaggatttcgaggatcaagctccagatctcgagcaaggcaagccacccgaacatcttgagcctatatttgaaatttaattatattgcttgcaaaatattatgcattgataggatcgcacttaatcttttatcccgtctgcaaggcagattggcggacctacctgacttgttgcatttgatccttccattgttaattgctatactatgtccccttgtaaccacccagttgcgcctcgatattcgtgcactctgtgcgagtatcgacggtcgccttcaaacttaaaaatctgagtaacaacttgggtaaaactggagttttacaaaagacttggaaaacccgacacctgggtcggtgcttgcgaactaaatgaatttccaaaaccacggatcggggaacgtaccgggggtacggttttcccgctcttgcacttaaggaccgtttccttggaatttcatccgaacataagacaagtacgaccacatgggtggaatgggacacccctggctgagtaactagcttatcaggggagccatgatgccgagagacatgtggattcgccggggtggtgtcgaagaggaccccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaaaaggggttcgatgtttgaaaaatcagcagctgacgggatcagctaggcccgggtggccgtttgtaaagtcgttggcccgggtggccgtttgaaaagctgttggccgggtgccaatcttgtttcaattctaaagactaatacattgcacatactccgaccggacgagatgcactgtctcatccgtgtcgtttgagaagcactcacctagttgtttttagaaaagagttcaaataaaatcaattgcaaaaacagccgcctttccttgaagcctgcattaaacacttatttccctggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcatgtgttgattggtccaaatcctggcttccgtttcccttttgtaatgcagttgtgagctcgggatctgtccgcagcccaacatgactgtacctctactctataataaagagacccctgttgatgtgatattctgtctccctgtgataccagcactgtttcctttgactggtatcgattaacaggttaaattggagcgtcacgggctagttccggtcggtactagttcggggcgtgacaacctccagccgatgtatgctttaaccttcagatcagtgcttatta

SEQ ID NO: 64782 - DNA, 22838 bp, Oryza sativa
ccgattgccttcatatcattatctacgttggacatatagccgatgcttaaatcctatcgctatcggctggtattagcatcggctattatcggctatcggctggaactactccatcggcttgtcagccgatcggctgtttggatctactatttgcatatcttgtcagttgcaggatcaaactgtctggcacgctcgcatctaatcaagatttggacctgcacaggagctaaacagatctcccaggccggtgtgttctattttctcgtcaacacagattcttggtcccaccgcggctgcgctcctcccctgcacgctccgcggcatctttgtccagatcggcgtgccaactctcagcggcttcttcgcccgcccctcgccgtcggcagggacgaagacgacgaggccacccatccccggcgccctccacctggactacctcgacaccgacgaaatcgaaaaatcccttctcaccataatcgaccactgcaacggcctcatcctgctcgaccaccacgtcgtcaacccagccacccgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaaagatcgtgaaaaaattcatccgtgcttgattaagagaaaacacgaaaaaactaactcatgcgagtagaaatatactccaatccattcacacggtagcacacatgccggataatcgttggacacaggcctgggcctcacgtgggacgtggcttgccagaaagtgcgcgccgccagcgcgtatgcgcttagttttctcggaattataatggtatattttaaaacatgaaaatttataatggcatggatcaaattaaccccatctttaaacacagagcagagttagttatgtttgccagctctaacattgatttgcatacatttaggttcttcattgatgtttgtctgtctttcagatcaatgattttttttctttttggaagtggaagcttgttttcagatcaatgaattccaggttacttaattttccttccaattaaccaatggagtacttgactaaccaatggagtacttgaacaatattttaatactttttcccaattaactctgtaaccttgctgaatgatgcaactgccagagtcttcggtttcattttgacatggtctcctgctttgcctctaatattgttcatatcatagcacagtccataattaatgccatagtgaagggactttttaatcctggtatttttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatatatctatgatctctcttattaaatcaatcaatcaagactaacgcgcgtcaaccgtagcggccatgcacctcttacccgacgacgtcctccgccacctgccgcgacgcagcctcgctgcctcacgctgcgtctgtcagtcctggcgcgtcatcatagacgaccgctccctgctcgccacggccgcgctcctcccctgcacgctccgcggcatcttcgtccagatcggcgtgccaactctgagcggcttcttcgcccgcccctcgccggcggggacgaggaggccacccatccccggcgtccttgacctagactacctcgacaccaatcaaatcgaaaaatcccttctcaccatagtcgaccactgcaacggcctcatcctgctcgaccaccatgtcgtcaacccagccacgcgccaatggacgcgccttcccccttacccgccagagtcgccgggcagcgacatcatcctcgacggctaccacgccctcgtctttgaccccgccatgtcgccgcactaccaggtgttcttgatgccctacgtcctccgacgagccacggtttcaggccagtggccgccttcgccattgctcctccatgtcttctcctcgaggacagagccagaggggagtacatggcggtgggaggagagatcattcgtccgggaagggaacgccaccatgggcaccattgatgaggtgtgctcaagctcggggtgggaaccctttgacacctactccgtctacttccggggatcgctctacgtgcattgccaaaacaattgcgtcatcagaatcacaattgcaaatcacaggtataggattatcaaattgcctggcgattttgtgggaaatcaaaatattactgtcgatccttacttaggaaaatcccaagagggagtgtactatgcattggttattggtttatgtcgactccaaatttggttcctcaaggaatatcaatcatcatattcttcttattcgaattcatactgtggtggcatcaatggcgacggcggtggcatggagacgacgacgatggatcatgagcacgagtgggtgctcaagcatgacgcagacctagggccagtgctagcagcaggctacactctcaacgacggtggccagcaatggatatggcataacattgacaccaaaaagaaaaacaaggaatcactagtaaaggaagaggaattcgaatggaacgactctgatgatgaaaatggtagcgccggtgaagataggcagtacaaaggatacatctctcaagtatttggatttcatcctttcaaagagatcgttttcttgtacgacacagacactagagtggtagcctaccattataatagatcaaaggttcaagacttgggcgtactacaagtacgtgaacgagtgtcaaggtcattttcatacactccttgttggatgccggatttacctggaatgcacaattaacattttgatttgaaatacatcgacgctggagattaaacaccagctcgatcgtcggcttatcatttttgtaaacaaaacaacgtgttaacatacgagtggaatcatgctagctttgcagagtttgcaggtgtatggtacaggacgagatcaatcaatcgagcgtccaaggtggcatggggatatttgattacaaagaaaagtgttgctacatggtttgctaactgcatccaaaaactgcagctgattatggtagctgatacttgtagataagttagttaattgcatagcaagtagttctgctctatgtgcacgtgtggtcctatataagtacaatagtaatcgactagttagtcatctattactgcatgtcccactgttaattaccatatctctgattagattgtaaggtcgatactaacaacctgcaaattaaatgactgagcatgcaaagttagatgggtgtagggccatcagcaaatgaagctgcagtaattggtgttaacaaatacagtgactgtcctcatggcaaacatgtcataccagcaatttttttctgagcactattgacaaattgcatttggagtttatgcatgcatgggaaaaaaacagtgtttttcaatgtggcagttcatatacagaccagtgcaaattcagttcaccagcttgctagccacacatgtcaaaggatttcagacttgtagattttgaatatatttcagactcttgtgaaatgtcaatggtaaacagatttatctgatcccaactgcagctgcagatttctgcctgtaatgtagtatacacctcagtacctgcctgatattgtccagctgctccaaatctatactctgatgagatgaatcatgaatcccagttaagtggaccactcctcctccatttccataagaaaaacaggaaatttcagagcaccaatcagatgattcaggcaggaaaagttccagattcagatagagaaagttgcagatggggtcaggttaagtctagagtgttaattaagattgtatgatgttgtcactagctctgagatttcatgatcagatctaatcagagctcaagtattcctcgagcatctgaagaagtgtagctgtcataagaaaggaaacatgcaggagagtggagtatagtactatatatgcacatgatacccaacatccaattggttactccagacctcaaatccaattgccatttgtttaacatgccagtatccacatgaaagagattaactactagtagcagcagcagagaccaaacacacaagtgcacatattaataagtaccctgaattaataatgctctatgaatcttgagaggattccatattagtgcacgtattgtacatttgatttgtcatttagcttcttcactttatcagaggcaaacaacataggtctacaacctgatacaataacacttttacacacaaaggagacctgtaattcctaccactgaaaaaaattgcactagaaaaaaaaagaaactacttttgtctgaagaacagaaaagaaaaactcatttgtgttacacatcaaagaaccctatccagttgttttttttcttttcgttttacagttggaatcatcaacaagatgttgtgcccaattggaatttatttacattcaggaggtgtcaaagattcaggcaacaagcatcatgtcacgcacagcctccactctcatctcctcgaagatcatggcctctatgcttgcccctacctgcgatgcttcctcctccctgagccgcctccattgctgcagtgagccggtgaggtcgagctccaccagcgcggggatcctcgagatgtcgccggagatcctctcccaggaggagatgatcatctgctcctccagcttggacctcgtcgtctcgtactcttcttcgtctcctgtctccgctttgcaattcttgccggcctcgtagaaggtgaagcatggagcggcggcggcgtcgagcggattctgctccggtggcggcggcggcgagctcttccctgaagtcgacggcgactcgtcgtccttctcacctgtatggagaaaacagagtcagaattgaattcttgaaatggcgaagcagcagagatcagggcttacggtggccgacgccgagcatggaggacgattcgtcgtcggagttaatatcgaggtcgagtacggacatcgggctgagctgcctcgcacattcctcctcctcgtcgtcgtcgacgtcgcagccagcagcaatgtcgccggcgccggcgtggcgcagccggcggaagctctggcgggcgccgcaggagaagcagccggcgaggagagccctcctgacggcggcgccacagaagacggcggcgcccaagccccccaatgcgcggctcttgttgctgacggcggcgcggcggtggcagaaggcgagcaggcggcgcctgcatgcgtcggcgagggaagctccgccggcgaggaggaagggctcctgctgctcctggagcaggtccgagagcctcctgacgtagcagctctcgcccatgaattctctctctctcactctctcaatctgaagaagaagcagaattatatattctgtgtgaagaagaatcaggaatcaggatgaaaatggtggggtgtggatggcgacgggtgcgtatataaagctaagctcgacatggagacctctcttcgtcttcttgactgtctcgttggaaagcaaaaggaggcagcagcagctacaaacaactgcattaggctgggcctcacaagtgttatgtactcttcactcttcactgtataagtagaagtgttgtttgggcttttggatgaccaggatattaattaaactgttgtagtaggaaattaattagagcaagtttaatagtatagtccactgctaacttcaattcatctatagtcaatctaatagccaattcatataatagttgcttactatatatactatcaatatccggtcccacatgccatacacatattacgtcttagagttcgtgctacagctggctacaaatctgtagcccgctgctcttctctctctttcttttatctctttataatatgtttacagctggcttatagcctgctattgtacctgctcttagggaagcaagaaacacaaagtagatgctgtgtaattaattaagaaggtcccctccccagtaaggtaaggtaaggtagttgctgaatactgtagtgtggaagaagagaaaggtgtgtgtgagtcatgtggtgcttgctactctgcaaatctgcagtgcaatttgccggtgggaaatagatgaagaaaacaacactgctactactgctctactactagtactaaacagcaattaattaattaaaaagatttgattttgattcgtttgtggaggagtatatgaaagtgctagacgccaatggattgtggattcaggcgtggttgagctatcatcaggtggagtacaagaagacatgggaagagacaagcagaaagctccatagttgtagtactcctaaatgaaatgaaaacacatgttgagccgaagtgaggagaagatgtgagagagtgagctgattcactgaaaaaccaaagccagcgtatcatatttgccgtagtggcacgcagaatttgcagatgcagcagagcctgccgaattgtttgttaggccacgcccacgcagctccccttgttgcatccagacataagtatatggatgcatccagcagttctgtactcgtagttaattataattgtaccaccatgcttagcactagcagtgcaggtttgtgtcttgtttcatttgttcgtgtcccatgatattcaaaaccatgtcaaatcaaaattcagagctagtaatactccagtcaatattcagtcactttggtaagatattcattactagccttacaaccaacatcagcagcagctgtagtagttgtagtcgtagtactcgtcatcttttggctgtagggctgagctgagagggggcagcttagcaaaaaggcctgcaagagatgggctccatggcagcttgcatcttgcactgcagcgccaaccttttcccctccctctctctctcccactgatcactcagcaggaccatgcatgcatgatcagcgtcagttcatcgtcaggccattcatgcataattcattgatgcaatgaaaatcatgcaagcaaatgcatcaagaagagcagtggagtgtagtaccagtgcaaatgagtccttgcatgtccttccattgggtacctttctgctgtgcagcacagagttgttcattagctcaagaaaatggccacagcaacaccggttcagttgccaacgagtgtaaaagtggagacgaagttaggtgcatggttaatttacaacagtgtcaatacgcgtttttgataaatgttggcgtttgcagattcaaaatatttgaatttctctggcctgacattccaatcctgtgcaacaactgtatatattgctgttgtatatttcacccaaacaatgaatggatgaaacaaatgcatttgctgctacatcttgctctctattagccgatgacgagatggttcaatgcaaaaaaacgaccaggagtatcttttttatctcttcgatcactagcctcctcgccatcacttcacttctttctttctcgtcactgaatgaaagaaaagagtgttcaagaaagaaaaagaagcgacgaaaggaaggtgagaaagaaaccaaacagacagctttgcttgcttgcctgcacaaaccaaccaaccaaccagccaacaaaaagtctcatcaaaaaaatgaaaacaagcagaaacactgtagacagtaagcttgtgattgtaaccacagctgctgcttttctttcctgccactgccagattgtcaccctgccttgggactgatgccatcttgcctcccttgtccttgttctctttcaacgcacatttcacctgcattttgttttttgttttgtttttctgaaacccagcaaacctgaactttcaaattcagtaattctagtagtatttgcacataaaaacatcatgcggcgtgcacgagatcttctgtcagtcatcaggctcagtaattcagtatgcaagtgtaatcttacaatactgagtagaagtaacattttcactacttcaagtctccaactatagtactgtagtatggcaaccaactagtcatcagcctctctgtaccaacatctttctttttccttttccttttatttgtttctaaaaaaacagagaacttttgagaaagctgctgggcctctcttgtgttggtatagagaggctgatcaaattggcctttatcgaacgggttaatggaccaaaatgcaaagcctctgctactgtaaaatctgcagcccatagctcacaggctaatgggccctgtataaattgtactccctctgagcgaactttctttttttgagaaaccctctgtaactaactgacactgttaacgatggccgcctatcactaattactttcagatggttatattaccataaatgaaagttgtattattatatatttataatgcaacacattacacacgtctttttttaagataatggaatatagcattttggtcttttttttaagataatggaatatagcattttggtcttagtacacacttctataatataagaagaagagaaaaaattatacatgcctacgtacaaaacaaccttgctcgtagctctcctagctcctcatgacaacattctcccaatgtgtttagcgccggccataccacaccaacctaactccttttagatacgattgagcatctggtgctgtcgtctccttttatctaaagattcttccattccttctagattttccaagcgatgagcaataagagagatctaagtcttttttttttgttttattacttctgggtcacttgtttcttatgtccaccaattcaagaggtttctactcttattctatttcaggatgaagtgtccttggcacaaccatgtgagaactccaaaccaaatttgcttcgagcaggcatttgaacgataggttttaagattccggaaacataactataagaaataattatttggccatcccttgatctgtaaccggtcagttgtccacaggtagtcaaagttttaacttaaataataccggtgtcgattattcgagaagcgaaggaataccagttggatatagttcagcggggtaacttagtccattcagtcatacaagttgaagaggacaatgatgcctcctgcaaattttgccaagttatttaagataaatttgtccacttcaggtgtatccatcacaaaaggcagcacagtaggacactgaaagaggatcaacaacgaatcgccatggtgtgatcctctctttttcctgaaggctccatccaaagctgtccaaacatctgttggatgcaaacacatccagctacagcaaagcacagtgattgtttcagattaatgtatctaccagcttgcatctgtagacacatactaccagaatccagaagtaacaactcaacgaacaaacgaaaagaagagaaagcaattagacatgttaattagctagtaggcttaggctcccaggatttctccatggaatcaaataaacaaattaaagtcagggcacgaagtaattaaaagtggcgagagcaacacaagcgccattagcaaacgagacgtaaaacacattgctagctcgaatcgatcgatcgatcgcgtttgtgctttcgacgtggcgatggtgactcgccaccagctcgatcaaattactgaaaaaaaaaatcttgttctaatacttccctctgttttaaaatgtttgacaccgttgactttttagcacatatttgatcgttcgtcttattaaaaattttttaaaatatgtaaaactatatgtgtacatgaaatatatgtgtacataaaagtatatttaacaatgaatcaaatgatatgaaaagaataaataattacttaaattttttaaataatacgaatggtcaaacacgtactaaaaaagtcaacggtgtcaaatattttgaaatggagggagtacatgtataaaagccagccgccattggctcactgtaactaatgttctgttcagcaatgaaaacgacattaattgtatagcatctgaccagctaattaagctttgatcaaccacgggtgattagctcagctcaactgaccgctagcttatgatcttctgctatcgattatactgtaaactctatgattgtgagtgagaagtccgtttctgatggatgcagagaatccgatggatctttgatcaaatggttcatttgtgtatatgcatctcatatatcactttcgcccatgcgatatgaaggaaaaaataatattaattaaccgacaagaatatgtgcaattcaaacatcaactttagtgatcaccaaactcaattccatctctgcttgctcgagagtgacaagtaccaaatacccccacaggatttgacagcacggaacgaaaagtaaaatggctgatttgattgatctcggagaaatttagcccggatagatcgatcaattggtgcactcaagttcatgtcatgacatatcaaatttcatcggcatgatatattgaattcgggacaattcgtcctccaagatcgagaaaaatgagcaactgatggtcgagcgatagtaatagagcgttcgttcatcgttagctttgctcgtccttgccaatttcatctcactgtgattattttttatctcagcaaaatgattgctacttttatctacagccattcgagttcatcagttcatccattcattcgagttggagaattcgtttaaccggcccaggtttgaccaagtcaaaaaagtcggcacgtgcatgcatgcgtccacgtgggatcgatcgcctacgcgatcaacgaggcgagcgcctgcatctcgaagccaccgccggcggcggcggcggagtagagctgccggagagctatgacgcggcgggcggcggcgaggcgaagcgcgagcttgccggcctcgtcgcggagttgcgcgttggtgagcgccacgagcgcggcgcgcgccctggcgccgcggaggcgcgcgacgaggtcgcggctggtggcgcggagcgcggaggccttggcccggagctcgtcgaggtgccgctgcttccgcgcgcgcgaccggcgcgccgactcgcggttcgagatcctccgccggagccgccgccgccgctcctcgtcggccttggtcgtcaccggccatcaccggctcatcagtagccgccgccgccgtcgtgtccggatgcgacggagacggcgccggagcagcttccggacatggtgcgccgaagccaatgtcggcgaggaaggcctcgagggcggtgtcggagtcggaggggaaggggaggccggccatggcagtggaggtgagaggggcagaatggtaattagcaaccaaagagagggggtcgagtggaaggagagggaaaagggagggaacaagtgaaggaagggcccattttatagccgtcgattcgattcaacccagtgggtttgtggggcccactagtggttttctgacgtggcagccaactttgtttgctcttccttccagtcccctctgttgaagctttggaaaaagcttcatttcatatcatagacagacaggtggattgtcgtcgcatataactttgcaagtatactatgtccactcgcattgacgatttgccaaattttgtagaaagtggtaataatcagcgaatatatatatattctgttttccttttcattgccgtggtttttgatccattgcaaagttacaagttactgcttttaattaatccaactaggaaggtagcccgcgcaatacgcgggcatatgtattggcttgttaaaaacaggtatggcaaattaattttaaattagaagtaagatgttttttccatttgcttttttctttcagtgagctgagtcgaatgatttggttcttttttttttcaatttgagtcaaaatcacgcgctctctccctcgtgaacgaaacatatatgcggagtacatgcggctgactcatggatggcatcatcaagcaatggaggatagaatcatcttgaagtttttaagtaggttaagattaatattagatctaatgattgtaaatattaaaaaaaatcaatggttagattattttaaatataattcctgtgattttttataatttattagagggtcgcatgtcatttaggagcagtcacatgtcatttaggagcattggtatgattgccgcgtggcgatttaggagcgtttataggatctaaatttaatatttgtttaatatgttgtttaaaaatttgctcttaaacatttatattagaagtttgagctatgtatatggatctcgaattatgtatttaattatatatagcacaataattcaaaaaatgagaaaaaaattaacttgagatttacgatcatttagaaatccaattattaatttttgatagattgagtcttagctaaaaaatagaagttagcttaagaaatagaaaaggaggggagagttaggagggttatgtgcgcacgcacgtatggatgtggcggtgagggtgcaggtaccagattttcttttcaaatgaagatcgtatggttaaaattaatgggttcatcaacttttataaaattagaatttttatgatttttattaatttgttagctagaagattaaaaaaaggaaggaaggaaagagggagggagggatgtacgtaccgcgagaagaggtggcccaagaggagggggcggtggagatgggttttgggatttttctaataatgtagaatattgggtccaccgtattaagtgaaaatcgagggttagatgttttgcttttttcttgtaatttcttcgatttctctaatttgttagagtgtcatgtggcaacttagaagcgtttgtaggaagtttaatagactttagctagataataggaaggggaagaggagaggagagcactgagcttttcggagagggaagggtccatcgatttaaataaaactcatggtcatatgcttttttttttctcaaaatttttatgttttttttaatttattatatgtgaaatgtgtagacatagagatgttgtaatggacatctaacagatgatgatatgatataggttgtcaatttttatacaacgtttcgttgctgtttagttgtcacggaaaggatataggtttatgcctaacaatatatttatcagatatcaagaaaggcctaaatggatcaaactaaaaatgaatatattaaaaaaatataatcatttagctatctattgtttatatacaatcatttatactatgtaacgatccgccaccaaccatgcatgtaacagaggaactcatatcccatacttatatctcaaacggctaaattttttttacccattagatacccatcacatgtctatttctatataaaaacatagtaaatatagtgaatataggacttagcttgttgattaatttaaataaaaaatacaaccattcaagcgtatatcataaaagtatatatcgtccataaaaaaaattactgcttgcaggttgcacagccagcttgttgctccatgcaagaagggatataaccatttacaataatacgttatggtgtgtatctcgtaataactaccttaattagaaaaaagaaaaaaacgagaaaatgaggggaggatgcgtacgtacagaagtcgggaaagtgcacgtgtgggcccaggagagaagggtgaggagagattttattttgatctgatggttaaaatcactgggtccactgttttaaatgaaaatcgacggtcagatatttttgtttttttcttatagtttccataatttattagagcgccacatggtggcttatgagcgtttgtaggatgccacatggcggcttgagagcgtttgtaggaagtttaatggatttttagtatataatagaagattgcgcatgtcaaaaccatatattctttctagtttctaccctggttttacccttacctgcagtatttggtacaatttgcagatgaaagctacaccagttcagagttgtttcacctttcaccctatgaaagtgcaaaactttaactgcaaagtaaaaaggttgcatgactagctagttcaattgtctacaaattaaattacagatactgcgatgtttaccaactttaacctgacggccgtgtaaccgcacatagatagtacacatccgtgtagcatcatacttagcaatagaatcttgtgaactacaaaagctcaagaactattcacatgtatctagggtggctgtgttctgtgtacaccttatgatgctttgggcatattcttacatggacaagggagaatcctagattatcatctgtgaaaatgaaaggtaggtagcttagctaggttggtagtcttcactctccagagaagaagatataggatcgaatcacaagaactaagccaaccagaggggggtgaatggttggtatacccaaaaaccgaaaacttttagtggaaataaaagttaccctcgaaatcgacgaaagtcggtctgactgaaattgatctgccggtctgaccgagtggatgccgccggtctgaccggtgtagaatctccggtctgaccgccgaagtcgcctgctacgcctgtcgccgctgccggtccgactgccgtgctcccgccggtctgaccgccgcttgccgccggtctgacagccggtagatcgccggttagatcgccgaaacccggtaaacacaaatcaaagaactcttaaagtggataacgactttattgattctctctgtctttacaaagtgtatcaacatcactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctttagtacaagaaagaaactttacataaccaatcgtatcaaatttggactccttccaaattcgactccgcatcccatacgcacacaataactccatcgtataccatatggaatctccatcaaccacgtgcatcaactctagcctaagtatcccgcatgatctctgaccaccacggacgtcgtcttatccccaagccgactccccgtccatcactgcaaatactctcctgagacatcgagtcacctacacatggaacaaacaaagaaaccatattctgagaccaagctatctctaacttgactcattagcagcaaacaatagtattacatacgtatagtatccatctagaagtcataatcatgaaataaactcggatatccaaataaacaatccgaaaccgaaaccgatacagtgtcggccggtcagaccgcgggttgcgcctgtctgaccgcgcaatacacaccggtctgacggtctgactagtccacataaaatgatagatcctgcgatcacctgtaaatccgatcatctccaaaaccacttcgtgaataaattccaaataacaaaaccaataatctccaatgcccaattgtttatcacagaataataataaaaacacctttaattttacagaggatcgagaagggaagaaaaactagttaaagcccgacctagttactctcattgagaagctctaaaaccttaatcactaaggaaagggagaggtatatagctagctagcaggttcttctaattgttttttgcacgcccacaagatattggatagcaaatcttatattcgatttttttttgctgcctagggccagcaagatctattgatttgcatgctcagctgtcttatatactgataaatgattattctatgactagcaatcgaaaagtttgtttaaacccatccttagtcagtctgacctgaattatttgataagatgttgttgaatttcttgctggattgcaccatcgatctatatatctgaaagcaagcgacagttaaacagtactagtataactaacagaattctatattatattattacatggacacaatgtaatcgtgaaattaaattaatatatgtagcctgatagtagaaattaaaagccattacattatgacattgaaaccatggagcgcacccacaccactacttttgggacaccagcaaacctgcccttgatttttatgcagcaaagctagtgcattcttactgatcatgactgttcgatgataggtcatcgaaagctacatgtaattaactcaaaaggggggcatatatataaacattctggttggccatgctaccttagctctttcatgaaggaatacagatatctggtcgatggagtatatgctcagccactggaatatatagcatcaaagctaatgttacactagtcacccatcatcatctcaaagaataaaacttgtagacaacatatatctatatatgcttccatctatgtggaatattctagtagtattgcatatcatagcaagtaagtaatcttccactgttcctctaaaaaaggtaattgcatctttcctttaatgatcagcacagtgtccacccatgcatcaatatttagtgactgtcagtgctatgtgcaagtaatttgattaggtagagatcatgcatgcaagctgcatggtcgcatgatgcatagcaaagctttcagaaagatgggattaactccaatttgtaagtcatactctagtgcaaatctcaaaggcaacattcacaagttcaaaaaaaaaaacaatgatgcatcattaattatgtttaaatgtatatgcattattatgcataagatctaataagtactaaagctgcctcctttagctagactaataaagcaggcgatgttgaggcacgacctttctgttacagcaagtgggtagcacgagacaacacagagaaggtatggaagatcaaccagacaatggtaagctctagctagctagctcgacagaaagatcaacatacctattgcttagtgaaagggaaaaggagacagtctgagaagagtactgtgagctagggtactaatcaagaagagtcattggagataaaagtatagtttagttagctaacagtacgagtataatcacataatatagtgaaataaaagcagggagttatgttagttaagtgccatggatggacagatggcctccatgcatgtgtagttcctatccatcaaagcctgaattttggtgtctgtacctgaagtctctgaagatgcatgcacgcacgatgagatctagcgactactgcatatatttgcaagtgcaggcacatggtttgcctccaggtttggagaaaagaccgcatctagggaggcttttggaaattcagaaattggaatcttagtttcttgtttggtttgacagggaggatgcactgaggagattgggccaggtgtccggctatatgctagcaacagttctctgcatacacctttatcttatataattagtttttagtagtaattattgtggcttgtcaactttattcagtgtcacttgaaatatgttacttttcgattaaatgactaaatctagtagtaaaagagtaggcaggcatgcatcttttgtagtaaatgtataaatatggtgtatatagttaatttcctactgcctttggattaggaactagaattaagagtcacatattgcacaacatgtgacaggtaggcatagactctcactacaaaaggtctcacaataatgttcttttttcttgttgaagtaaacactcctatgtgagtctgagatcaggagatgatgcatgtagacagtataccattggttgttttcaaagctaaaccaagcagttaaaacagaaaaggcagggcacatgcagttgtcatgctgcctggggccattaggaaatgggcaagtgatgggttaaaggtgttaatcagagttgagagtacacccccgcaggttcagataatcagtggatctccctaataggtaagcaggatcttgagaaaaagaaagcttagttaatgagatgttgatggagaggcactggaaatgtgaattgtgatggacatttgggcatgtgggcttgggccatccagctgctgggctgctgtaaactaggcctactctgtagaagcaacggcttctaatcctagctagctttatgctgatggatggtgcgaatcaggccgtgcagaaaaagagagaaaagaaaaccagtctaaaaagaaagagagaagaaagaacaaacacaaggaacagattcatcatcatttagttaggattaagtgatatgtatgaaaaccgaggtcttttacggtgcttgaaaggtacctcaggtaccttctatcaacagtccagataaagagttttttttaccgtccaacggccggtactgaattcctagacccgatccaacagctggtagagtttggtaccgtgagataccaattctgtccttggtacagtaccgacctaagaactaaggtggaaaggcaaaaatataatttcacgtgcaatagatggatgggagtcaagcggatagtgtgatagggttcccaccaatgccaccgccgctgcctggagtgcgtcgacctcgtccgtgcggcgccgcgaagaactccgcctcgtccgcccctcgccgctaggaagtacgtactcatcctctcggcaccgagaaagaatcctccttctccatccgtcgccgccaggaaggactactcctcctcgggccctcagcgcagggaaagtatcctcaactccgccgcccctgctcacacgccgtcggtgctgaaattgagcgcaccactgctaattttctctcccaatcctatccatcccgaattgaacggtcggatgagttttggcaccgaccggtaccagtaccaggcggtacaacttgctggacagtaaacatgctcccagataaatcccaagcaccgtagaaaatctcatgaaaaccacgtaagttcatccgtgcaatcaagaattgaagatgggggatcagtacgtaactgcacgctaaatattcctacatttcaaccagattaaattaagctggagagcaattgaaccgaagaccattggagtgtgatacacatataggagtatatatgtaggatgattcatccaaaatgaacttatgacatagtacaattcatcagcgagaaactaactaacaattggtttattcatttgcaacatgcatactgcaagaagaagaattgaagactattgattaattagcagtggtggtgttgtcacaacagcgaaagccacccctgctgatcttgcccttcccggccgtcgtagtcgacgtgctcttcttcggcgccgccgtggtggcgcggggcagcagcggcgccgcctcgctgacgacgacgacgtcccggctcctgggagggtggtcgtcgtcgtcgtccgtggggaactcgacgcaggagcagcgctccagcgacgcgaagaaggcggcggcgaggcacccggcagctcggcccagcgggcggccgcagctttggcccaggtgggcgtgggcgcctccgcggttgcaggagaaggacgcgcaccgcggcgaggaggtggcggcgcgcatcggcatatcgatcgatactagtggagtggagtggagtggtgagtcaccttggcttggatcgattcttgcgcgcgaatatatcgatcgatcaaagatagatcatcctaggcctaactattatggtttgacggttttgttgagttgtattccaaattcatttgcacatatataaagaccagcttctgtcagagcgaagcggaagcccattattggaggcttggccggagcgaagcgtagggtatcgttatccttttaagatttcaccttcggtgctgtaatcttatcccaatataataaagatatttttgttgactgatgttcgtgtcttttgtgattgatctatcattgtttatcgtttatttgcctaacgtttcctaacaggttttgcccttgttatcgatcgggtcggatcgccgtcgacgtcaaccagtgagtctcctctccggccgttggccgcactgatcgatccggtaggcgggcggcggacagcgagagcgcagtggagtgacgacggctacccaccaatcgtcatcatcgtttgctcttgctagctccagataaagatgatgacgactggtgggtagtggccgtggccatcggcgagaaggacggcgattccctttccttgtggggaagacggaggatccaacaccaaacacggcatatatgcaaaggaaatacgggaccgctatatgtgctaccattaaccaaaggggttcttttaaaaaattcctagcacaatcaaaatgggcttcacgtatgtcgcattaccatttcggcccaacaaaaacaggcctcttgtaggttagaaacccgtaccggcccaaacatttcgcccgcacgtcgcattaccgacttacagttcaggcccattttatatgggctgcacggatacaaccaacatgggccttcccttccagtgcaacaagaatgggccaaacttgtgacagggcttggaccaagatgggggtttgaaggaccaagaatgggccttttcaatattgatcgatctggttctgtggtgctagaattatagctaaaaaaatctatgtgatttaacgctagtcaataataaatgggagttggggatttgtttcatcaccttatttcttattttgatttatttttatctttaacaaaattttggatgtgtcttatgattgaaggcggagatacaatctatttttcattattaaaaaataatacatgtttgacgattgattgatagaaaattttgagatgcagagcttactggtgaaccgctgaagcaaacatctaccagtagcaatttgtgtagaagtcgtcttgtaaaaataaaatgcgtggtagggcataaaagcccaggcatgcatcgcatttgttgatatgcaggaatagggatcgatggatggaaagagagaccgggattcccctgtcggccggcaacaatcctctactattaattctttcgtcaactgaacctgaatggatatctgtatggttgttcaatcccatccatccaagatgcaggccagctctgagctcctctatttcatctagtgcatgcaatgcactggctgcagtacttatatatgcatctgtctgaggttctcttttctcatttggaggggatcaaatcaaaacacaattaaacagaggagtatacagttagaaagagcatgaaaagttggtttacgtctgcaataaaattcaagcagggatcgcaaccactttactttgccaaagaaactactttaatacttctcttcctgtacgtgtgaaagagcagaaactacgttctactactttactactacgaacaaaatcatccagcttcctttccagcatgcacctgacctcgcgatcgaatcaattcgatcggccgacgcatccatcgatcaatccatgtcgctagttcaaaccgtttacaccaacatatactccctccactaatgtatgacgccattgactttttatctaatgtttgaccattcatcttattcaaatgttttgtacaaatataaaaatatttatgtcatgcttaaagaactgaatcaagtcacaataaaataaatgataattacataaattttttgaataagacgaatgatcaaacgttggataaaaaatcaacggcgtcatacattaaaattttaatgaaggtagtattagatggacatgaaatgatgttgagcttactggtagctttagcttattattgttagcaagtgtcgctagctgttgctattgcaaatgtggtggtggtgcgagacagccatctgccggccggccatgacaagagaaagttacgtatggagtatcatggatgcatgctcatgctggggcctttgctaccactgcctcttcttcctctcaaagtcctaggttcccagctttctagttttgagagcctgttccgaaagtttttgatagctgcagcttttcaaattcagaaggttcctcaaataatttagctttccgttcagattctaagaagttgtagttgtagaattcaaaaattaaactaacaatcaaaagccgagtttctcagcttttctagattctcataatctggcgaccaactagttgtttctcagaatcttaaagcttctccaaacatgaccatatactcctcgtcagggatgggctcagagcgcgcgattacatcatcttggtgtaactgactgagggagtgtttgagagaaggagaaaagagaaaatgcataaaacaatgtgaaccactaacgcatgattaattgagtattaattatttttaacttaaaaatagattagtatgatttttaaaagcaacttttctatataaggttgtcatcggttggccaattacggataatacgccaaatgtttggctattgtgaaaaaaaattggggtaaaac

SEQ ID NO: 64783 - DNA, 9063 bp, Oryza sativa
cacgtgaaaaaacaaggtgaattttctctcacaatcatctgtggacgaacgtaacccagtcttaatagagcttctattatctaaaattagactcctctcctctccaagccaatttagcttccattgcaccacctccctccctccctccatccatctctcttaccacgtaccaacaatggccaccatggctccaaggctgctcatcgtcgtcgtctccgtcctcttcaccgccggcataatcgcctccgccgccgccgcgcgcgacctcaccgccgacccggccggccaggccccgccggcctacgacttcggcatcccggcaggcttcttcgtccccggcaccaacaacccgtacaacggcgatcctgcagcgtgggcagctgggtacggcagcgccgccgccggcgacgtcggcgggttcgggaatggtggggcggaggcgccgtcgatggtttgctccgacaaggggccatgcaacggcaagaagctgacctgcccgaagaagtgcttcgtctccttcagccgctccggcaatggctacgccgccggcggtggcggcggcggctgctccttcgactgctcgaccaagtgcgaagctacctgctgatcattttactacttcatttcctcacccatcgaatccaaggcctcctcttgcatcagctcaatacttcatctatacacatcatcatcagctgatgataccgctccagatatctatctatctatctatctaatctacaggtttggtgcttgcttgctaatgtctactacgtacccatcttaatctgcttaattaattggtgcaaaatatatttctacctatatatgttcttaactaatcctgcatatatattctggaaaacggacatgcacatctgtttttttttacttgttcgaatgctgcatgtacgtgttttcattacctctactgcagagactactacttgtgtgtgtaaccgtacctataaacttgtactccatcacgtaatgatgaatgaataaaggagcgtgtcatattttgtaacccgtgttgtatctgcgacttgtgttgtaaattgttatgatggaggagaatataataccgcatgtttgcctaaccctgcctgcaaaacgccacccgtctcaatgtttgttgtcagccgctctttcagatctcataactcaaaattgccggtaagtacatatatatgcatcttaattcaagctatttcagtggtccaccaaatgatgaatcttttgctgtaagttttcatgcttgccttcttttactgtcaaaactagatgtatgtatctaaaagggtattttcatggtaaagagtatatgtgtttcacaagtgcaggcaagactgagttacccattaattccaacaacatgctcacaaagaattgaaggcaactcgcaactcatcagaaaaaatcaatgtgaaaagtgttcagaaactatcctatcgacttcttctgcccatcatgaggttaactcacaactccaactctcatcacgaagatcaagagctcatcaggtatcgattcatcagtcgctcatgacctcacttccatctgaatgctcagaagcatcagtaacaccccccagatcttcaccctccccactggtttccatatcatcaacttcagactcttcatcatcagtatccttgtcctcataaattatcggcggggatccttcttcctctccggatccatcatcgtcaatctgggagatacatactttcagttatggatttgcaatgctcaaaatgatggcacttgctggtggggtaaaagtaaaacttacctcactgaaaagataatctagacaggtagacaactgcagcgatgatttgaaggtcgatgttcttgcatcaattagctgagagaaatgcaatcagtaatagtaaaatccaaaaataaacatgagcacatgacttataattgttattatgtctccactagtgcactaaaagctgacatattcacagtaattttgacatccacaaattccaaggggctgtatagcctagatgcagacatcctgatgcacatcactaaaggaggttgtaagtggtgcatacggagacaactctttatgcagtacaggccatactttgctgctaatgctataggtatgtaaactctcagaggtatgttgcatatatatatggaaataatcccacgagtcagaaagaatatgcagtcggtaacactaacattcaaaacaaaaatgacctgcaatctgtctcttcatgtctgagctatagcgtgcatactgatacattcaagataataattggcgctaaacaggttacttgagaatacggtgcttagatatccagaggctagtatcattcaggaggccaccatctggtataggtaaagaaagctctcaacttcacttcacgtggggcagtaaagttctaaatcaatcaccaggaaatgatgtgctggtttttcaaaaaaatatttgttgctccaaaggatataaaggaaaaacatattttaaacaactcacatgatagagtgagttgagaagaagctcaattactgaacaatatccttcacataaatgtagctaattgctacctatgcaatcagaattagttaataaatactcacatgatagagtgagttgagcagaagcagagaagactcctgagaaactatgctactcatgtgttgactgagcaaactttgcagccatgggagcaaggaaaccagcactgcacccctgacaaaggggaaaaaatggaaaacataagacctctacgtcaaaatataaccaaataatcttggcagtatgtaaatataatcattgtttgagtagcccatgaaaatccagtcaaacatagatgcagaaaaaagaattgaagctctcctttttttcatgtctactgatgaattacataataacccgaattgtatatcctaagcccatcttctttgtactgaattgcaaaagtgcgtctaacgaattatcctacctcgattgcataagcaatatgaagaacttgagaagcttcacagcgtctgctggtgtaagaagtgatattgaattaacaatgacctgcacagaaaccaacactgaaattatcagatttgatgaccaaattgcatcaaggattagtcaatgttaacttataacatctctcaataacaggtaagaattagtgattaacactagcagagcaagtgatgaataaaatcatatttcagtaccacgaaaatctggcgatatagccgaatgcagtgcaagtgaaacggcaggcaagcatcgcattgcatcattgcaagaagggaaaaccatgacgataccttgtggtctttattgtacaagcaattgagcaaggatgcgtggtcatcagcccgcagagcctgcttgagcaagacgtgaaccgagtccgcgctcggcggcatcaccacggggagtggctgctcctgggtagcttcacctgctgtcccgtcgcctcctccgttgagcagattcagggtggccagcttttcctccatggtgggttcgtcaagattatactccggattagcaccactgtcgttgattgcatctgaaacatagacaccaagggcatgttcactttgatgccaaaaaaatacttaccaaattttggcattgccgaaattttagcaacttgtcaaaattttggcaagatttcttatatagttaccaaaatttgacagcaaactaaatatagccattttttggcaactttatcaaaatttggtaaggttgaaaatgacatcaaagtgaacaggtcccaaatcatgctgtcaccaatggctgttcagagagctcgcgtttatctgtgccagcggctagcctagacaagcagggaaaaaaccaagaactgaggaacagggttacctgatggcaggggagcgcccggggcaggttgcctccggcggcgccggcgagtgaggtccatccgcttacttcagcacgcagctggcgtcggcgccggtggagacaaacgaagcgagagagcagcggcggcggcggcggcggaagaagagagagagggggagagagagagagatgaaggaagtgcaaggccgcacggatgggccggaatacggcccagcccatcctatctccagacattttttatatttcttcctctccttttttttttctagttttctttccgtgtaattcttttgcacgttcgcgaataattttcttccaaatagtagctgctcatactggcattcctgtctaccttttcaatgctcacgacaagcatgctcattttctcattttcagaggttttgtttccaaaaacatttttactgaaagaatttgaggctggctaggaacaccaacagtccaatgcctatggttgacataggagtacacgcaagtacgcaactcgcggcaggtgaagcaaattaatcatccgaacatactcaacaactatcacaaggaagaattagcatttagttcatcattccaacaacatttcttctccatctggagcaaataaaagccatcattcctgcgtctcgcatgctaaaatcaccacaagcttactggacagtctgggctgaatgttgtaagaatccatatctcaaacaggatgtcaaagttgccattaacctatgcttcagttctaattcttccgaagaagacgccgttctccatactcccaccatgaattcaagcctaatgccaagtactagtactgcatatgcacaaaattgcagctgagctactagttaaactgtctctaaaccaacaaaaaagggcttcgggtcactcggcattactcagttcttcaggtccatcgcctccctgagagcaaatctccattagaacatccaacacaatgatatcaaagcacaacttacaatgcacaaataccaggactagtggtgagaatctcttaccagaacagtttgtccatctcatcactttcaggatccaactctataccatgggtcaacgccacgcaagctttctcataatcctaatgaaggacaaaatgcgcatatggtcagccaaatgagatggtagttagttagcaatgagaatggaatggtgaattgaagttttttttatgctgcaccttctcaagcattagagcttctcctagccgatggtaggcctccgacaacttcgggtgatgttttgcgcatgtggttgcatctttcacagccttttttccctcacccatgcgaagccagcaaagacacctctttagaagagttgtggcatcacaaggatcaacttccagtgcctgcggtgaaccaaacagtatctgtcaaatatagtgttgctgccacatccaaaaatttaattgtcacaaagttacatttctcatttatctcagatagagttgaacccatagtgaaattcacatatcaacaagaacttaaaactgtagatggcatagcaattatatgacagaattcctagaagatatatcatcccacataactgctgttgctcaactcatactgaatcatcaaaataactactcgaaggagacactatttcgtagtacatatactttgtgcacaaagctcatgatgattttatatcaaaaaatcattgcttatcctgtaaaaaaggtataactgctgattttttgaatccatgaaatggaagaaagctgcatcttattgacaattcaaggaaacagaaaattttgcattgagttgaatgaaaagaagtgatgagctcatggcactagtctttcagcatagtagcattctaatagtcgatgcactatttaagtagatagaagaatgtacctgtgtgtaccacactgatgctttttcataatcctgctcatcaaatgcttcattccctttttgtttcaggtcagacattttcgtgttaacgtaatcatcatcctgttcaatttataacagcatgagtcagacagattcagaggtccaatgtgacaaaatgcaatgtaacaagtaaaaggggatgtttattgataaaccctgtttctctattgttaggtctgatgaacaagctacgagctattgttaactttgggtcaaaactaatacaaactatcctgctgctgagaacaaggtggcatgttgcctgcaatgggtacaaacaattgtggttccttgtgtcaaaacagggtttgagaccccgctggtaatccaccatttttaccagtgatcctgggaaacctgatgtgtatcagtatctagaaaagcatgtaccaatccccctcaccaggtatcaattcagggaagcaaatttaatatagaaacaaacttccttcatcttctttttgcaagaacaataaaacaagcccacatgaagaaagctaaagagagcaaccagacgctagcaagtatgggcaactgctatagtaacatacctctagcttcttgcgttccagattggcataagtaattaccccatcaacgctccagtcagcaacagttggaattgggttggtcaaaggaaatagaatctcaacatcttcccttgtaccatacacagcagccagctctattggcattctaccatgctgtttggcaaacgaataaagctttataaagtcatattggagatcagagaaaggtaagacgatgcttccttccaataacgctaatttaggaattaactttgctccaccaaggcacatcactaaatgatgtaatgccaccacataaatgactgatgaatatggaatagtacttgttttatcaataattttttcaaaattgctaccatcagttcttgttgtcctaaactttttaaacatgttgccattagaaaagaccaattagcattatgctcaccgactattaattatctctatgcacctgaccaacaaaaaaagctaaatgaaaatgaaaacagggaatttagcaggcttgtgtcaactctagaagcagatgatagtggtctgcgaaacacaccacagaatggtgtacacatgtctcacaaatcaaatcacactattcaactgatgctcaaatgctccaaatcttttgcataatcttgtttccgaaagaaaaaagaatttcctataaccaaaaactgtgaactttcgatgctctataaccaattttgcctagtatcttttacaaataagcgtgtgccacatatgtgaattttcaggaatacatttcattgttccatactagtgatgcatatcaatgccacaggcctaaaatcattgaagctacaaactcaatctgctgatagtgatggtgtgataagcaaaacagaaggctcaccgtgtcaggacaatttgggtttgctccagccttcaacaacaactttatagcttcagttaatccactccctgcagctctcgccagggggttgtttgtagcatttacatcagctccagcctacaaatgtttatgtataatacaaaatgattatacattttcttcacataacttgatgattataacagctctagccatatatagtatcagttatttagccttatcctattgcagcagtccaaaggagaaaatattgtacctggatcaatagcttcacacaaggtaaggaagtagtgaataacgccgcagataaaggtgttgcttgagaagaaggcataaccttgttgggctggaaaagaaagaaatgtattatcatacattatgacagttcctagagaaagagataatttaagaaagttgtttgtgtttcttccgttgttcctattgattattcagtggagtagttgttaatgtgtggatcacggctcagccagacctgggctagctcagtgctcacacatcaataaccaaaatgagagtaaggatggaacagtgggaggaaatagtaagccccaacataagaaaagtataagcatcgtacatctgcttggtgctccaacaaaatcttcacagtactttcatatcctttaatagcagcaaaatgcagaggtgtcccatgatctgatttgccatcaacatgagctcctctagaaagcagcaattttactatttcagtcctccctgaacaatcacataaaaaaattgaaggtcactgatgtatgagagaaacaatttgggggcagacaagtttgagaagccagagcaaagaggcaatttaacacttaactgcttaactggaggataataaaagaaaaagacaaaccagtcctaaataacacacaaaaagagcagttcactcttggaggaacatgtttcagtggctagaacaaaacacacacacacaaaaagaaaccctggcagcaggttgataaataaatatgaggtttatgaagtagaaacagtccaacagttatactaggatgaatggtaaagtgcagataatctatgatgatgtgaatgatatattttaacattttcttatgatgaattaatatgtataggctgatgaacatgaaaagtgtacatcagcaaggtctatatcacttaaacaacacctgtaaaaacaaaatgcgtcaggaaatgctgcattaggcttgctttgttgtacatttgctagacgctaaggtccccatcagttgcttacaacttattataagccgtaacggcttattagcaattaaaaaatgttgtgcgaaaaaaacttttgtatatatattcttagcgacttaaaagtcaaagctgaaaaaaaaactatgttgaaaaaaaaaacatcaaaatcaaattaaaaatcaagttttaaagttcagattttggctttagcttataagccatagggcaaacaatgaggcccttacagtattgtctgcatttttctccacattcaacgtaaggctgctcatcatgacagaatgcagattggatgtagcagggaatcctacaagaagataggatattcccctaataaatccaagggcataatgctgttccactgaacgggattgggttgaagcagtattccgaatgacacatagtatgccgggtagtacagcataactcagattgttcttttgtaataaaaacaaaaaaagaaaaagaagaagttgaactaaatctgaggattggtttcccctgtttatacctttctttgcagctgaatgaagaaaagtgatgtttccttcacgttcatgatggatatcagcaccatgatcaatgagatacctg

SEQ ID NO: 64784 - DNA, 5635 bp, Oryza sativa
  unsure (1)..(5635): unsure at all n locations
ctagtactcctagctggcgaagagacaaaaggaagcagaagagaggatgaatcttgacatgcacctggagtggtgtccggcttgttgacgtccatgttggccacctcgagcaagtagcggtagacgtgcaggcttctggcggcgtgcagcgcgttcatgccgtggaaggccgtgcgcgccacggtggccgcgatcccctccccgtcgtcgtccagcgtcgcggcgatctctgattgagcacaacagcaagcaagcaagtctcgttctatcacttccatgagcggaatcaagaagcccgaaaaagattttaaaaaaagatttttttttttgttttgttttcttgcatgtacaagtacaggtgttcaggggtggcgaggaagagaagtgtacccttgatgcggcggaggttgccgtcgtgggcggcgaggagcaagttggcctccgcgggccagctgtcctgatctgcgcgtgaatggcaggcaaagggatcgaggaggaggaggaagagattagattaagaataaagaatgaagagaagaagacatgatgaatgcagcgcaataccgtcgccgagaagcttctcgaagaggtcgggcagcgacatgatgccgtcctggctaggctagggtttcgtttgttgctgctgcggctgggttgtgtttgggttggggaaaggaggagagaagggaagaatggtccaagaattgaagaagaagaagaagaagaagaagaagcgcttctctgctgcaactctgcaagtgcagagagagcagagaaagagagagagagagagaggcgaggaggcgggaagtgatcgatcgagtggggtcccactcccagacgcagaggcagaggaagtggagcaatggcgggtcgacatggcagcccccaatccccggcttttttctgctccgattctccccatctttttccatgtctttgccttcttctcctctcctatcctcttcttggcttcttgcttgttcatcctgcacaccacactagcagtggagtaaaactgtaaaaagtatttcagatctttgatttttgcttggtggtgagagataaataaaagacaagtcgtctgcaaccctgcatcaataacctccatacagataaacaaactgggccttgagtagttcccaatttttttttctaaaaaagtcgcatcgaatctttaaacacatacatgcagcattaaatatagattaaaaaatttaattacacagtttacatggaaatcgcgagaggaatcttttgagtctaattagtttatgattagtcataagtgctacaataacccatatgtactaatgacggattatttaggcttaataaattcctcgcagtttccaggcgagatatgaaattagttttttcattcgtgtccaaaaaccacttccgacatccgatcaaacatccgatgtggcactcaaaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcaggagacaagattcaaagcaacccttgttgcggcgatcgacacgtgaaaagcggcccaacagcttgtaccaaccgagtgtgtggacccagtagaattgggctgggccacagtgagggagagaggtccatagctcatcgctataagagaccggcagggaagagaacgaatcaaacattgtagaaacaaatattcggaaatcaattcaaatctctccctgttctattgctgcctctacctgttcttagctgttcttccccaaactctcaattctctccctaaatcctcaatttcttcccttgttgtggcacaaattcttcagagacgtaacatttggtatcagagcaatcatcctggagaagccacgctatacatctaggttgcaattgcaagtggaggcgatggaaaagcagaatctggacttcggcaaaatcctcggcgacatccaggaatccctcgcatcgctcaacaccaagcnnnnnnnnnnnnnnnnnnnnnnnnnnnnnnnngatgcgggagtgagtggatggagacctcaagtggaatcagcaattcaggggttgcgcgaggaagtcagcgaacttcgtcagtaactcgacctcgtcggcaaatctcagcaatctgcaccggctgcgtcttccccttgagtcccatcgacgggtgaggaaaggaaggcgccgctgctgccgactccatcggaggcgaaggcggcgcggcttccgacgccgccgacttccacccaactcgccgcagccgaaggaggaagcaaatgggctgcaggccaccacgttcagatgaatttccggggaaggacaccggtggtcagttcgactcagggtccagccccgggcaagggtacgattgatttcaccccgaattttacttctaaatttgatgggggaggttgggagtctggggaatttgattctgagcatggtgatagacagtacaatcatcgggtgcctaagttagacttcccaaaatttgatggttcagactctcaggagtggaggatgaagtgtgagcactattttgatgttaacaatactttcccggggttatgggtgaggatagcaaccatttacttcctaggacgagcagcatcttggttgagatcttctagagctcatttgagatttccaatgtgggaagatttttgtgctgctgtttctgcaaaatttgatagggatcaacatgagaatttgattaggcaaatggatagcataaaacagaatggtacagtttgggagttttatgaacgctttgatgaattgatgaatcaactgttagtttatgacccaactcttagctcaaagtacttgactcatagatttactaaagggttaaggagggagattagaaatgcagttttgttacaacgtcccaaggacctcgagtctgcccttgctgttgccttgttgcaggaagaagtgatggaaaattctccacctaccactgtcagagagtttaagaaatcagatggaagctcttctctgaagattaatggaaaaggggcttggccattaccattaccaccaggaaaaggagggggagtgcctgtcagtaatcgtgcagatgagagacgcagttcagatactgttcgcagtccgacaagcctaactgaaaaagtgtctgctctgaaatcttatcggcgagctcaagggttgtgttatgtctgtgctgagaagtggtctccaaatcataagtgtgcttcatcagtgcaattgaatgtggtacaagagttactatgtctgttcttagaagaagacagtcatgttgaatcagagaatgctggacagaatggttctttgactagggaacttatggccatttccttacaagcagtacaagggactgaaccagatggaaccatgcgaatgttggggcaattacagggtaaggagttattggttttagtggattccggcagttctgtcagcttcattagttcacagatagctgaaggattgacaggaatacagcctctctctagaaggttgtcagtccgagtggcgaatggagagacattgtgttgtggagcaattattccaaactgtgaatggcaagtgcagggtcataaatttcagacaactctaagggttttacctataaccagctatgacatgatcttgggaatggattggctaatgaaacacagtccaatgtcagtggattggtctctgaaaactatcactttaagcttgcagggaactaccgtcacactgcaaggggtgcattcagaattggctcattgcaaaattctttcggcaaatgaaatgcaacagttccaacaacgcaaggctgtggcacatatggttcaactttgttcaatcacggatgatgttgagcctgagaccattccagttcctgtacaggaactaatgcaggagtttactacagtttttgctgaaccaaaagggttacctcccacaagaccctttgatcactctataccattgctacctggggcacaaccgatcaatgtgagaccatatcgttacacaccggcacaaaaaggatgaaatagaagctcaggtcactgaaatgttgcaaaatggcatcatacaacacaacactagtccctttgcctctccagtcttactagtgaagaagaaagacggatcttggcatttttgtgtggattacagacacctaaacgccatcacagtgaagaacaaatgccctttgccaataattgatgagttgttggatgaactgtcaggtgcacaatggtttacaaagttagatttacgcgctgtatatcatcaaatcagaatgaaagtagaggatgagcataagactgccttccgtactcaccatgggcacttcgagtttagagtgctaccgttcggactgaccagtgcaccagcaacatttcagggaataatgaatagcatcctgtcaacattacttcgacgttgtgtgttggtttttgtcgatgacatattgatctacagcagaactctagaagatcatatccatcatcttcgggcagtttttcagattctgaacaaacatggtttgaaggttaaacagagtaaatgctcatttgcccaacaaaagttatcgtacttggggcatagcattggtccaaatggagtggccacagaaactgacaaaattgcagcagttagagattggcctacaccgcaatcggtcaaggagttgcgcagttttctgggcttggcagggtactaccgcaaatttgtcaagaatttcggcatcatcagtaagcctcttactaatcttttgcgtaaaggtcagttgtttgcttggacctcaatgactaatgaagctttcctcacccttaagcacacacttgtgtcggcaccggtccttgcactgccagatttctctattccttttgtggttgaaactgatgcatcggataagggaataggtgcagttttaatgcaaagaaatcatcctgtggctttccttagtaaggcgttgggtcctcgacatttgggattgtccacttatgagaaggaaagtttggcaattatgctagcaatcgatcattggagaccgtacttgcaacatgccgagttttcaattcgtactgaccaccgcagcttggctttcttagatgaacagcgtctcactacaccttggcaacacaaagcactcaccaaactgcttggtcttcagtacaaaattctctataagaaaggttctgaaaatagtgcagctgatgccttgtctcggtatcctgataaagaaactgtggtgctgtcagctctctcagtttgtattccagaatggactcaagaagtgattgaaggctatgcccaggactctgactctcttagtaaggttcaaaccttatgtatcaataattctgcaatcccagatttcactttgaaaaatggtcttctctattttaaggataaaatgtggataggaaataatcctattgtccagcgaaagattttag

SEQ ID NO: 64785 - DNA, 936 bp, Oryza sativa
taactgaaaggcatgaatcaggtctcaaaacctttttgagatgctttgtgcatgctagtccttcacaatggagccgttggttagccctcgcggaatattggtataatacatctttccactcttcgctgggtactactccatttgaagttctttatggtcataaacctcgttattttgggttgacggcctctgctgcatgttctgcaccggaattatcagattggcttcatgagagagacaagatgcagactcttattcgtgagcatttactaagagcacaaatgcgcatgaagcatcaggcggataccaagcattccgagcgttcgtttgctgttggtgactgggtatatatgaaactccaaccttttgtgcagcagtctgtggtcacttgcaccaataggaagttgtcatttcgtttctatggaccattccaggtgcttgctaaggtgggatcagtggcctaccgtcttgatctacccccttcctgtcttattcatccggtgattcatgtctcacaactcaataaggcagtagctccatcagatcaagttcattccaaattgccaatcctggatgatgcagatgctgttactcctgttcctcagcaggtgatagatcgtcgatctgtgcataaaggtgctaagatggtggagcaggttctaatccgatggtcaggtccagactctgctgtggtgacatgggaaaatctacaagaactacaacaacgttttcctcagacaaaagcttgggaacagcttcgtttcaaggaagggggaatgtcatggcatgcactacttcaggaccatctcaggaaggcgaagagcaaggcaggagacaagattcaaagcaacccttgttgcggcgatcgacacgtgaaaagcggcccaacagcttgtaccaacccgagtgtgtggaccccagtagaattgggctggg

SEQ ID NO: 64786 - DNA, 1540 bp, Oryza sativa
aattcctgcgcgctgttttaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcaggagacaagattcaaagcaacccttgttgcggcgatcgacacgtgaaaagcggcccaacagcttgtaccaaccgagtgtgtggacctagtagaattgggctgggccacagtgagggagagaggtccatagctcatcgctataagagaccggcagggaagagaacgaatcgaacattgtagaaacaaatatttggaaatcaattcaaatctctccctgttctattgctgcctctacctgttcttagctgttcttccccaaactctcaattctctccctaaatcctcaatttcttcccttgttgtggcacaaattcttcggagacgtaacaattatctatatagaaaattttcatgcaaaacgtataatttggagtagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcagcggaaccaacggtctaacacccaacaccacaggcgacggctgggaaccaggacgaaaccctaatcttcacttctccttatcttctcttcagggcggaggaactatatatatatttatagagcaagggtgagtactttcgtactcagcaagtcacgggaacttaggtgtttggtgctagcttggaagagaggcaaggttgttttgcaaatcttttgtttgaaatcattttgaaatcactaagtgatttatttctttctatgtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagtcctgctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaa

SEQ ID NO: 64787 - DNA, 2774 bp, Oryza sativa
cctcatgccacatagaaggatcaaattctctcataaacataggcctttttaggcgtgcacaaatcaaactccaaccaccttgtatcggtaagtgagcaagcttctcgtttcttgccttaccaggaactccggtttgtccgacgccgccccggcgatcccactattggcatgcgaggtttccctaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattctaataatgcaagttgcaaacgaaataataatgacttttcaattataggagcaattgatcaaagggtgacttgccttgcttaaggtcttcacgaagcttcacgaatcttcgagagaacccgcgatcgacgaaattccgattaccgcaactatacgcaaacaatcgaaaacctaaacaaaagaccaaaagaaagatcctatttagactaattattagtgccattaaatagatctcaattttacggaattactggaggttgagcggagtcaatcggatgagcggttgggaagatatggattttctaaggtttaaggattttctaatcaaaggagaaaggatttaataatttattaaacccctttctggaaagagaattgaaggagggatgtaaactagacttgttccggtggcattggcgcggcccaagggtcgaaggaggctcggccaagccattgggccgacgcgggcgcaagcaggcggcccattagggcgcgcgggagggagagggggcggtccggtggaccgggtgcacctcgcgggctcccgggtggggcccacatgtcggcggcaaggttcacgggggaatgggttcacgcgggggtggcgctagggtttattgaagatggcgcacgggcggtgcgccggatggaccgagaggcggcgggcccacgcgcagccatagggctctccgtggaccgcgcgcaccggtcgagggagggggaggcggcaggctggtcgtgctgacccggtcgcggccgatgtggctccgacgtggcgcctacgtggcagccacgcgggccggcgggaggaggaagaaggggaggccgagatggacggcggacggcggccgagttcaccggagcttgtcacgacgattcgagagggagggagcacccggattaaagagacggaggagataaagtgcgccaccggctcggattcacggaaaggagaccggcgacgacgaaacgcggcggccctcgccggcggtgagaaaaagggcaaacggcggaggggcgacgaggattcaattcgaggcggtggaagcatctccggggttcaaggagtccgcttccggcgtcggatggggcggaagagcaccaaggagggctggcgacgagcggcggcctccgggagcgggcggcaacggcggcgaggccatgccgggcggcggcgggtctaggggcggcgtctacgcgtgttcgggagtgccaccgagctatcacgcagactagagggggggcgagggagagcgaggaagggaaacgggaggaggcactaccgagccgggcgggcagtgatgggcggtcgacggcgcggggcgagttcttcggccttgggccagggaaggggaagaagaagggtggccggagtcctcttcggctccttgcgcacacgctggcttcaccagcacgcgcgacggcgaagggagggtcggcagctgctaggcggcaacaaaggcgcggcggcggtggaagagagatgccgagagagaaagagatagggaggctcggcctgggcttttatagacgcgggggatgtcggtttggggagggaggaaaccgacctcgtgggcggtcaaggatgcaagggcggcgagctggcggtcgtcgacgcgtgcagccaaggcggcggcaggtgatgacgccggcggtgtcgggcaaaagaaaaaaaaggaagggggaaaggggcttggtcccttgccaaaacgagaaaaggaggagggagagtgaggaggaggaggagagggagggcagctgcttctcccactcttggacgggtgcggcgtggagtggcgggggccatggatgacgtcgacgatgacggcggcggtcggtttggcatggagcgggggcaaggcggcagcgcgtggcgttggcggcgaccggccggtcggccacctcgcgaggcgcgcgcgggaaagggcgaaggcggtggaggttttgggcgacgacggcgggaagcggtgtcggcgcgagagagaacagagagggagcgagaaaacgagagagaaagaagagaggcgatgcctctctctctcggcgcgtgcagcgcacgtgcggggaggaggagcagccgagaggggagaatgggccgagcaagggagaaacggcccacagccaagagggacgcaatttagaccttttccgagagaactgatttggataggattggagagatttag

SEQ ID NO: 64788 - DNA, 2453 bp, Oryza sativa
  unsure (1)..(2453): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccatggcaacatccaagaacaagacatcttattgaaaaatgaaaaatcctactagtaaacaatattattggctccaatcctatcctaaacaaaaatgcaaaaaaaattaatgtatgtgtggatccgagaagcggttacgtccaaggaagagcggtttctgcccttcggtgaaatcgaagcagagaagaaattaaaaaaattacacggtgatgagtgggttaaaaaaaaaagaatttctctggtgaaaatcacggagtccgagattcctgaatcgtgattccttcaccgggagccaagaaacgcataaagatgagagacgaactgaaagcgaacaagagcagcaaatcgccgcaaaaagggaaacaagaagatactcatactccttgccaatctatccatcaaatgaatcaaactgaatgaaccaaaaccaaaaccaagcagagcagagctgatgagagaataaggacctttgatcacgaagctcgccttggagaagcagcagcagatcgatcgagcagaggttgaaggcctctaggttaggctagggtagcacggtggtggtgatgatgagaagatcttcctcaatcgccgagctgaaaaaatcggagtacttgggtggtggtaccatctggacatttagaggaaagcagaggaaagaaggagattagagagggaagatttggcttttcagcacggccatggttgaattgttgttgcctacgcctacttggggacaactttttcagtgctccccctcaagacattcgcaaattccaccggattccttttcgatgatgctttttctaggactaaaaaatttccctttctttgttttctgaaaacgtcaatttcgagtgaactaagatgtgtttcacttgcaatattttggctgtccagttggtttctgaagcgtcaatttcgagtgaactacgatgtgtttcacttgcagtattttttggctatccatttggccttgactttgttgctttggtagatgatttgtttgtgcaccatatgcacgtatatgttatgtaactttctactgtttttagagttcgtttcatcgtagatagtgcgaagaaaacatactttattagtagcacggatagtacttgaactaactatttcttaattttctacaagagttgcagctatatattcaccaaagagctctcgaatttgacaaagctcttatgacctgccaaatagaaaagaagtgcaaagtgcacacccacatgtgacttgatgtacatggctatgtgcttgtcaacctctgcttttactttgccatccaaaaggatacactagtataaggctgtgtttagatctaaagtttggatccaaacttcagtccttttccatcacatcaacctgtaatacacatataacttttcagtcacatcatctctaatttcaaccaaaatctaaactttgcgctgaactaaacacagcctaagaagagaggaaaaaaagaataaagggtgacttgtatataattgaaggggaggtgggggtgatattgagaagaagaccatgatttcagttatcagtttgtgggctcctcctgttcttgcatgtcgttgtttgaggtgggccccactaaccgtagactatactagtagtagattactctgtccctgaagggagatagagactgattgggattcatctcctgatctcctccttccaggagacatccaggaactgtacatacatcttgtgggagtgattagagaaaggtatcaaaagattaaactgtacagtgcattaggaataattactagtcgtatgtgtaaggaaatcgaggtgaaaaagggagaatattttggactgaagaataacatgctgataagcaaaagtgcagctaaatgaaatgaagctgaaaaaaaaagagagaaaaaatttggactgggaagagtaatcttctgataaaccaaaaaaaatgcagtcaaaggaaagtaagcccaaaaatgagatttttgtgagatattcttttaggactgtgaagataatctggtgataaaaaaatgcagccaaaggaaactaaactggaaaaaaatagaatttttcttggactgtgaagaacaatcaggtgataaacaaaatgcacccaaaggaaagtaagctaaaaagagagatttttttttgggaagagacgagagacgactggaattctggaaagtccaggccaagcgcaagttttgacatattcagagcaggacgacggacttggatcatctcaccattctagcctgcagacaagaaattacagaaaaaaaattgatcaaatttgaccgaatatccgcgtacgtgccggattgaactgaacgtgttgagttatactccctccgtttcgaaatgt

SEQ ID NO: 64789 - DNA, 2695 bp, Oryza sativa
tcaaacatttcgaaacggagggagtactaacttgtactccctccatactcgtaaaggaagtcgtttaggacaatgtttaagtcaaaccttgggaatataaatcatgaataactcttaagttgttgagattgaaaatataaaaattatttgaatagatttgtcttgaaaaatactttcataaaagtatacatatatcacttttcaatgaatatttttatagaaaaaagaagttaaagttgtattttggagaccgtatcgatgttctaaatgactttctttgtgagtatggagggagtattactattaactgtacgtccgtggttaattcgccaatcaactgaaatatagtcaaccggtcaattaattatcaaattaaaggccctgcaaatctcatatgaaattccttcgtttcagaatgataacgagacgtacagagagaaatggaatgtccatagctgtgcgtgtgccatcgttgactgggccggccgctcgtgcgtgctcaagtactcaacctgaacctgattgttagttattcttcttcagacattcagacaagctaacagtagagagaatagtcttgtggtacggtggttaggctgcgagaaaaccttgctcgctagctgcagaaatagtaggttgcgtatgagatatttgaatgcatgcatgaatgaatgaaactaatatgcgtgcttctatttcatgattgtacgtatgctagcacgagggaaatgtagaacagtaggaacagtgggaaagaaaaagaaattaaaaatatacttctttgtcaccggtttcacatgaatatatatgttctttagtcacaaagtaaaaggaggcccttttatacatgactaaggaaaaaaagagtttctactgcacgtacctgactattcagtgacctggcggctatctaggtaggacttaaaatccatctagtggataattttgctatatatttgttaaggcatgccacgagagccttcggccgaacctgctaaaaccattaaatcaacaagccactgcatcaggcgaagccaaaagacgaagtcaagggggttcgccaccaagtttatcctctgggcgaagcctcaaggcggagcacgaaaggttcgccccatggaagaccggcttcgccagggagcccgccaagcagcacggcccatggtgccattcgcctattatgggccaggccaggggcctttcaaggggaatatagttgggatggacactacatgtccctctaatatccttatcataagggtataatgtaaatttctctgtacatattgaaccctagtgggtataggcatgtactaagactataaatatccccctagggttgtgtaagggggatccctaaaaaatttcataaattaatatgttatttattgttcaaatcactccaccgagggaaccacgtccttcgacgtgaagctcttgtcattttgacaacaatatttgttaataaattttgtccaagtaaatatcaaatataaatacaatataattataccgtaattgcatttgtaactggtatgtaactataatataactttcatataatttcgaatgttagatttgcttcacaaatcatgcaaactagtaagaaaaaaaaattatggccacacgcataggtgaggggatttggtcccgccaccttcacttcgcgaaaatagtgcgttatcgtgtgatttttgaacgttactctgtaactacaatacttttttctgaacgaatcgacgcttaggtgcgcccattttatatattaggatagagttgagagctacagtatatgtgttggaacactttttggctgctctttttttatatcttttaggttgctagaagtaacgaattgtactacgcttatttttaaaaatatttagatatttaaataatgaattaaaccagccactacatcctcaggtagtttgtaagtagataatgaaaaagaaatgttatactcctacataagaggatgatataaggcaggcagagcgtagccatcaacaaggccttgcccttgcccttgttgatcggtaagagcgaggtggccgccccaactcaactgcctcatcattcacatcacttattttgcttctgctatgctacgccatcgccgcggtgcatccaatgccaatgagatggagatggatactagatttcatttgatatagagagagagccgtgcatggttaggaatgcagcagcaatgcaagtgcaacacgcgcgattagcgaatgccatcgccattgcctgcctgccaccattgaccgcccgcctccacgtgttgccccccgctcgccgccactcccgccactccgcttcctctcccgccacctctcctcttcatcttcttcttctagaatccaaccccctccacacgccctcgcccaacccaccactctatatatctcctcctcctcctcccatcgctcctctgctctgccctctcttcttcttcctcctctctctcactctgcttatcttagcttcttcttcttcttcaattcaatggatatgcacgctgccgacgcgaggcggccggcgcacgaggcggcgctcagggcggtgcagaagccgccggccaagccgtggcgagcctctccgtcggcggcgccaggccccgcgccgcccaaggtgtaccgcgtcgagcccagggagttcagggacctcgtgcagaggctcacgggcg

SEQ ID NO: 64790 - DNA, 7128 bp, Oryza sativa
ttacatattacatacatataagttatcccctataactagtcagataaccatgccgtgtgggtatggggtacccataatctccacagtagcccctgagaccttcacagtcagaaagataatcttctctcgaactagattactccaaagccgagtgcttcaatcatcttcgccatgatctcccgagtactttttctaaatcagaagactgtggagggctgaaaaaataaagtcaggtgcatcgactagatgcaccgagtggtttcgataattgtagtcaaccaagcgacttaatattaatatgtagcagatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaattttcaaagtactgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgatcacaatatataatcagcctaagccataatattggtcaataaaaatgcacacttacgtggcaaaaagcaataatattgtatccaatcaattgcttaaaaacccaaacagcaccttgacttataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgaatggcgcaagtattcggttgatagcccttacggggaataataattggtccagtcgttgagcatagaaaatagactcataactatgaatccatgtggaatgtatccggaacaagtccaaattggagatataatcctcacgcttgagttgatgagcccctgagcatatagcttgtccttctatcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaatgtcacgcccggaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctcctttgcaacttgtcttcaacttgcaataatcggtcttcaattaatcttcttgaatacttccggcgcactcgcgaaccttcgcaacgacggaaacgacaaggatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcagtgatccagtcaataacgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatatctgctccgaagcaaagatgaagataatgactcctggagttgactcgttggctgattaattgattgctccatctttgacataaagcttgtcgaattttgagccatgtatttgtgtagcccccgactctttgtttagttgggaaacaactgaacatagagtcgagaattatagcttcttatcgtcgagtagtcattgcttgattgaagataaatgttgaagatgtccaagtagaaatccatgatgacaaagttgcattgccgtgatgaagtgacagaagcaaactggtagtgaagacgcgcagttgtgaagataaaagcactagtcggcggcagcataaccagtcggcgacggaagacgatgatgttcatcagtagtggtagctgtctaaaccagacgtagaggtgagggcactagtcagcagcagacgtagacagcttgtgttgaagatgatgatgcctattagcggtgacggtgatgtagccagccgtgaagaagatagcatcaattggcgtcataacaggccagccgtgcaggcggtgacaccagtcagcggcggatgcggcggccggtcggtgaagatgtagacgcccaacaacggcagcataataggccagccgtgcaggcggaaacaccagtcggcggcggtcgaggcggccggtcggtgaagacgtagacgcccaacagcggcggcataaaggccagccgtgcaggcggaagcaccagtcggcggcggacgaggcggccggtcggtgaagacgtagacgcccaacaacggcagcataataggccagccgtgcaggcagaagcaccagtcggcggcggacgaggcggccggtcggtgaagacgtagacgcccaacaacggcggcataaaggccagccgtgcaggcggaaacaccagtcggcagcggcgaaggcaagccggtcggtaaagacgtagacgcccaacaacggcggcataaaggccagccgtgcaggcggaaacaccagtcggcggcggcgaaggcaagccggtcggtgaagacgtagacgcccaacaacggcggcattaaaggccagccgtgcaggcggaaacaccagttggcggcggcgaaggcaagccggtcggtgaagacgtagacgcccaacaacggcggcataataagtcagccgtgcaggcggaagcaccagtcggcggcagacgaggcggccggttggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatattgataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactacttaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaggtggccaatgtaggaacaaagtcgtccattaataacaatgaagacaccagtcggcggcgacgaaggctgtcgacggtgaaagcgaagatgcccactaatggcggcataataggccagccctgtaggcggaggcaccaatcggcggcgacggaggcaagccggcgatgaagtcgtagacgcccaacagcggcggcataataggccagccgtgtaggcggaggcaccaatcggcggcgacggaggcaggccggcggtgaagtcgtagacgcccaacagcggcggcataatagaccagccgtgtaggcggaggcaccaatcggcggcgacggaggcaggccgacggtgaagtcgtagacgcccaacagcggcggcttaataggccagccatgcagacggaagcaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcagggaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcgacgtttacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggatggggggcaggattacgagatagaaaccttaaccaatacggtatcggtttcctaaatctactttacaatattagccaaccaggactttaggccgttccgtaatatacaaggaaacgtaacacccaagttatgatctgttacatattacatacatataagttatcccctataactagtcagataaccatgccgtgtgggtatggggtacccataatctccacacatgtgtacatacgtctgatttgcacttgagactagtagcgtgttcagttaattgatctattacagccttgtttagttttaaactttttcttcaaacttttaacttttccatcacattaaaggctctgtttagttcacaccaaactttccccaaactcccaacttttcatcacatcacatccaaaactttcctactcacataaactctcaacttttttttttcaaactaccaacttttcccaaacttcttctcaatttcagaaactaaacacagccaaaactttcctacacacataaattttcaacttttctatcacatttcacataaactctcaacttttttttttcaaactaccaacttttcccaaacttcttctcaatttcaggaactaaacacagccaaatctttcctacacacataaattttcaacttttctatcacattgaactaaacacagccaaatctttcctacacacataaattttcaacttttctatcacatcacttgtaattttgacgtgaactaaacacacccgtatgtatgcaaaagatgcagatggtgtggtgagactcagataatctcattgttctcctctcgtcttagaacagggtaaacaaaatattctgaaagttcagagaatgtgcgcagttaattgatccgactatatgtataatcatggtgggactgataataatctcattgctctccatctcgttttacaagttactagaataaggaaaatattcagaaagttgagataaacggtcttgaacattcagaacagttgggaagatagtgcttggaatagggaagtaaaaaaaataaaaaaaaatggagatgcgggggatcgaaccccgtgcctctcgcatgcaaagcgagcgctctaccatttgagctacatcccctgatcggttgctgatgcgagtttattaattataggatattatgatccaaaacatacaccttttgctattctaaggtcgcgttctaataagaggtaattgaacttaggccgtgtttagttcacactgaagtttgaaagtttggttgaaattgaaactatgtgactgaaaagttgtgtgtataaaaggtttgatgtgatggaaagttggaagtttagaaaaaaaactttggaactaaacagggccctagctacttctatatttctattaacacgtattttaaaaagctacttgtaacgctccgcttttcgtgagttgttaaaaactatttcggcaaaatcctaattgcgaaaattttcgttctttgtgtgcgagtctaagttgtgccaagatctcaattcaaatcccgttgttccctctcatcgaaatcaaaatcctccgcctcaaatctcctctcccaattcaagtctccgaaatctaaatccgaaagtcaatcccttcctttgaatcctcgccaaacacatttcc

SEQ ID NO: 64791 - DNA, 792 bp, Oryza sativa
cgacggaggcaagccggcgaatgaagtcgtagacggcccaacagcggcggcataataggccagccgtgtaggcggaggcaccaatcggcggcgacggaggcaggccggcggtgaagtcgtagacgcccaacagcggcggcataatagaccagccgtgtaggcggaggcaccactcggcggcgacggaggcaagccgacggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaagccgacggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcttaataggccagccatgcagacggaagcaccagtcggcaagagtagtgccgcggcgttacatgcaaacagcagaaaataccaagagagattaatctgacatttagagatcatctaata

SEQ ID NO: 64792 - DNA, 744 bp, Oryza sativa
ccactaaataccactaaataatgaggtagtcatattgtacaatagtaatctgaatgtgacacaacatggccatacatacatcatagaccaagaatgaactctttatactacatactagtctgatcacgcgcttgtttggtcagaaacacaagagttgcgttgaattgactgaaccaacgccaacgccaacggccggccaacatatttgactcccctccaaacatacacacagtattattcctcaccgccctaccttttcagttagcttcagcctcagcttctgcagacagtgcagagtacgccattgttcatccactcccattttgcaagtcagtgctaaccaaaaaatccaaaataaaacacccatcgtttcattcgcaagtactgctgctgtaatcagcatgcaagaatcaatgttaacaggctactgattgagttgattagcagctcgaacccttatccctttactggagaatggaagaagaggaatgaatttccatgcattcattcatatagaaccagcaggtagattaacgagatgttggcagaagagaaagaagtaacaggacacgattaagagtctcctcaagttagacatgctacagttttattcattactaatgcagaccaatatatgttcagtgttcatcataagcacaaagccacaaacactctgacagcgagtgtgttcgttgcttgctcaggcagctagaaaatcagtaaagtgttggtgcttcttcgatc

SEQ ID NO: 64793 - DNA, 5679 bp, Oryza sativa
cctgccaccctatacttgggcggcaagctgacgtggcagccggcggcagacggcgccgcattttgcatttaggtccttgcctgcaaaatgcgcagagccaacaaagcattggctagggttttttttgcatctcagtcccttacagctgagatgcaaaaaaccgagccaaaattgtattgataacactttaaaaaatatttattggtaaaaattgttaataataatttataaattgtattaaagttggttgtttcgcaatttcatattttaggtaagagttcatgttgtattccctctgtactcctaaaggaagtcatttaggataatgtttaagttaaaccttaggaatataaatcatgaataactcttaaattgttgagtttgaaaatgtaaaagttatatgaatagatttgtttaggctttatggaacgaagaacctgacaacgatcaccgcctccgcattttggacgggattcccatggagggagtgccgtagttagcacctgtcagtcgcactattattcacgacgttatcgttcgtaagctgcttttctctgcaagtattgctcagtactttcggatgagaaataccagtgtcgtttcttgtaaacaagtggttaggacgagaacgggattttctgtatggacccactcgatgtattcacaagccgtagcgcaggtctgacgaatagagtgggagggtgaaaaataaacaatcgctcgtacaaactgaataagcatatgcagataataaaatacctcacgattatagttagggcacctaaaaaagcgtcttcctcgaatgccaggattcatcaaagccattagttggcatcggtcaccacaaaggtagagaggccgctgacaccaaggtggtagtaggtatgcacaaggatcgctacgccagttcggatcctcaacaccccggcgtctagccattgccgaaaggtggtgggatttacaataaaactagtgaggacgagagtattgaatgtgacttatgaaagtttttgccgcatcgctcattacgggggcttatgtaggcacggaaatcacaatgataatcttgacatgtctacatcatggggcatggtgggtcgcactgattggcgccgaaagttagattggacgtatgcggatgtatatcctgccgccctgtatatgggcggaataaggccttccgccttttagagagcggcatggcgccgaaagtaagattgggcgtatgcagatgtgacatgtaagattggacgttttggaagaataagggcgtgagaaggcattccgcagttgtatcgcactcgaataaaggaggctgcatcaatgcgaccgaaagtactcgtgcatgcgccgaaaggtatcgtgctttcgcaaaaagtaacagcgaagtttaaggatgcgaaaactgaatagcaacaaccagagttcattgtacaaccaaatagtactacatgtaaagtaaataaacaaagagaagcctgctctactggctctgccccatgccacgaccccgcttggtcctctgggcatgcgctcgcacgtgatcctaggagtacatgaagcgattcggtggcatagcacgggtagcacgaggctctagcagcaggggggagggcgactggtcctgcgtctgcacgggcacacctcccagctatgagggaccaatgatgtccgctgtggtatcctggaagtcgaagtcgctgatgtcgaagtgcatggcggaagcccacccgtgctccggcgatgtcccggcagggtccaaggtttggtggaccctgctgtgacatgctggctgcctgtgacgaagtcccggcatcctgccagaactgcgcagagtgcgaggccgacgcagctgactaggacgctaaccgtgacgcctgcgagaagtgagcggcctatgtcgtcccgaatggagcaaagcctacacatggacgacgagacccttgtaagctaacacataaattgcatatcaattgattgtcgatatagtgttattttttttaagtacctatgtggggcccaaaaggaggcgtacctgtggaaggcggggtggtgaatggcgcacaaaaccctgaagcaatcggaacaattaattaacatgtagtacgtacctccgtagggagggggagccggcctaggaatgtgcgcagctggacgaggaccagtcggtcgaggtggctgctgtggtgttgcgtttgcctgagcgacgtcggtagcacgacaggtgagcgcacggagaaccgagtgcatcgagcgtgtacgtcgtcaggtgctcgtctacgggtaccgcaatccccgtgcctaaatgttggatcgtcgttgaagcgtcaacgacgaccctgttgcactcaacgacctgcacgattaatttgtacgtaaataaccgtaaatatttgtaacatttgaccaagagaaagggttaggaggcgatggtgcgatgaagagtactcacagcatgagcaaagtcttggtcgcggtgcctggcgtagaggtctctagtgctcgcggtgtgggcctgttgctccatgggagcgaaggtgaccctagtacgggtgcgtggctggtaccagtgtaggtaggcctggtacgcctcctcggtgtgtgccactcccacatggtccacgacctcctcggttgcgagcaaccagtcctcgacaaaaggccccaacttggcgggccagtcgccagctaactgctgacccttccgcgagtacctgcaaattaatgtatcatattagtttgaattcacatatgaagcaaaatattgtggagaggtggatgttaatgcaacaaatgaaagcgtagtgaaatctcttaccagtgaatggcagctgggacgctcgtcggaaacggtacttgaaaggactaacggaagccgaactgccgcatcacgcggtaaggtgcgtgaggctcaacacagatgtcgatggccatcggaaccgtagtcatccagtacgcctggtcccttgtgcagagtgtggacaggcccaacggcgcacgactgtgggtagccgcggcaccggaggggatgcagcagcggcagcgctggacttgtttgttttttcttttttttagaatttgtgattcattggatctgatatgagatatataatgtgtgatgtatttgatttgtgttgtatttttttttgagaatttgtgatgtgaatctatgatctgtgatgctactttgatttgtggatgatttagggatatgtagggagcaactcgatttggaaaagcaaaatgtagtgagcaaagaaacaataaaaaaagaaaaaaaatagtgaccaaccgggactgccgctatcatctttatctttagtcccagactaaagatgaatttttagtccaataatccgagactaaagatgggtatctttagtcctggttgtataaccgggactgcaggggttatgaactgtgggtaaaaaccctttctcgagtagtgtaaagaggggggtggatgggtttgcattctgtttggacgcagacagaaactaaggtcctgatagcttcatactccaaatctatgctagatttatagtttgtaagaattttacatttggtataaaataagaacagtaattcaccttgcagaaaaaaagaacaaaataattcttttaaatattgttaaaagatagtgcaaacgtagacgcacgcaatgtacgaacgctcatccatagttgcttatattattttgtacgctaattaatgaaccgtgttctaacagtagttgattaaaatttggaagcatttttatccatttttacaatgtgcttgaatgaagaaaaaccccattctcaacaactgcgccaagcaaccaaacattttctcatgatactacatccgtatacttttaaaataatattaccatttatcttaaaaaatagtataaatatactatattcatactttaaatttttttaatgataaagcaggttcacgtaaaaatagatagtaatatttatataaatattttaataaaacgaatcattaatgatcaaaagtcaaacacaccatctattttaaaaaatgtaaacggatggagtaacccgtctaggaactaaggacaacgtgagccgttggatctaaaagaaaaaatgggctggggatgcgtagtacatcaagctgggctgggccgaagatcggtagcctaccatgccctcgcggtcgcggacacgcggcggcgacggcgacggcgacggcgacggtttgccggcgggagatttgaagccgggtgtcatccggaacctgcccaccttttcccgcctgctaatcaacaaatggcctcctgtgttccgccaacgattttcttatccattcaggtaatcatcagttcatcatcctattcgcattccttctctcctttgttttctgtatcgacatttttttcccgcttcctcgtatgcaactagaaatctctgtaattaatccattaagtagaagttcgccaataccaaacctgcgatcgtacaagtgaatgtaatgcagtctgcgccactgatctatgtcggccgccaactgttcgacgaaatggcaaagccaaagagctgaaaagttcgacaatatgtctgaaaagttgatgtcagttgtttcttccctgagacggccaagatctggcgtaggataactgaaggctgttccctgaagttttctatggatgtttgttttctaccaagagatgttctttgagctgcttttagaggtgcttttgcttagtttcgttttgtctcctgttgtctgtaatcttttggggtctcaaaccttgtgttagtctgtttcgttccccagtatgggtgttgtccttaaactgtaaatgggtatcccaataacctgccgcttttggctttctataaaagccgggcccgagtgcctaagttctaaaaaacaaagccaaagagctacagtaatccttcataggtaacctcctagatgaacacaccgttggtttcttgcctcagaatgtcaatacatcaattacatcgtgatgtggtttgcgttccagattgacgcattttgcatgttatgaagtgagaataacccgtttggaaaagcaagggactgacccttctccaccaaatatttttagcacacccagaatcattgttccagtcctaaccagaaatggattgtttggatgtgctccaagcctaaaacgtgtgaggggtattctgccgaacctaatgaacatatctgctccagctactgtagcagtgtggcttggatttccctatcacctcagctggctcagcatatttaaacaaggttcgagtctttgctcttgggaacctgaactctacagtcgcatcacagggcgtgtccaccagaaactctcggtcgctgatgtgttagccaacaaccgatggatccgcgaccttcgtggctccttgggcgttcaagcaattttgcaatacctgcaggtttggtcgatggtgaggtcaatgattctctctgagggccagcctgattccttcatctggaggtgggaaaactcggggtcgtattccacccgctcggcctaactcgccctcctctcaggaaggattccatttcagcatctacctatctggcgttctctcacccctcctcgatgtcgctacctcctgtggttgatcgctcatcgccgttgctggacgattgactgcttggagaagcgaggcttaccgcaccctacctgtt

SEQ ID NO: 64794 - DNA, 731 bp, Oryza sativa
ccggatgcgcgggagtctgtagggcgagtgacagctcgtccttctctctgtcgggtcggaacgtgccctgagaagaggcttccactgcgtccattagtcgactcgcagcctcgcgtatctgatcgctgaagaccaaggagccatcaactgggttgagcgttacaccatgagcatagtaccagaacttcgatcgatcaggccatttagcggtggccggttcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttgtaagcaacgaactcgtcctagtgatcccttagcttcgggaatacgtcgaagttcggtgtctgccccttcaggatgtatttccggtacagatctcccttgaaggtctggaactgttctgccattttcttaagagtccactgtttcactatgttctccgtacccgcagggagcgtgaacgtctcgagcattgtggttcacagcatctctttctctgatttcgggacaaagctgtcattatccccgcgtgcccttgttctgcgctagtacaccttgctgacaggcacgttatccctcacaacccaaccgctgtggcgtacaaaattcttggctgcttgtgccggggcactaggtcggctgtct

SEQ ID NO: 64795 - DNA, 2025 bp, Oryza sativa
cttgggtcctaatattcaagtttggtgatataaaaaacctatgaaaataatttggtgatgatggtgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacactcggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacagttggcgcgccaggtaggggttgcgtcgagtttcctatcaacgagcgcgatggaattaacttcatgagtcgccgacttcgttttcgcttcgagagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaattggagtcgacgtggaatctgagccaatcaataggagcaattttcacgcagggaagtgcagcactcatgcatgtattgcatgtctgtcacaagctgccgatatgatctcctgtccacccattaacacatatatacggaggacactgagaaaaaagctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggagtctcagctttccggtcgatcggccgcgagtccactttgccggcttgtcttcgccaccgccattgctgataacaacaacgatttcaccgccggcctgcctccgtcgccgccgagtggtgcctccgcctacacggctggcctattatgccgccgctgttcggcgtctacgacttcaccgccggcctgcctccgtcgccgccgagtggtgcctccgcctacacggctagccttttatgccgctgctgttgggcgtctacgacttcaccgccggcctgcctccgtcgccgccgattggtgcttccgcctacacggctggcctattatgccgccgctgttgggcgtctacgacttcaccgctggcccgcctccgtcgccgccgagtggtgcctccgcctacacggctggcctattatgccgccgctgttgggcgtctacgacttcaccgccggcccgcctccgtcgccgccgagtggtgcctcgcctacacggctggcctattatgccgccgctgttaggcgtctacgacttcaccgccgacctgcctccgtcgccgccgagtggtgcctcgcctacacggctggcctattatgccgccgctgttaggcgtctacgacttcaccaccggcatgcctccgtcgccgccgagtggtgcctcgcctacacagatggcctattatgcccgccggtgggaggcgactacgacttcaccgccggcctgcctacgacgccgccgagtggtgcct

SEQ ID NO: 64796 - DNA, 1845 bp, Oryza sativa
gttgggtgtctacgacttcaccgccggcctgcctccgtcgccgccgactggtgcctccgcctacacggctggcctattatgccgccgctgttgggcgtatacgacctcaccgccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacatcactggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatgttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccgatgcttggggactatgactagtcgggcagagtgtttaaacgtaaggagtcatctgctcggggaaatcaaaattgataagaggagaaatacatatttataaatattttaaaatacttgattttttctcgagtattatatttatatcagatactactcatcctatatgtttgttctgcaggatccaaatccagatatgcataaaagggattcatggttttaagcttatctcttacgctctaggaatggatctgtcagaacatcaccgaccggcttgccttcgccgccgccgactggtgtttccgcctgcacgttggcctattatgccgccgttgttgggcatctacgtcttcaccgaccggcttgccttcgccgctgccgactggtgtttccgcctgcacggctggcctttatgccgccgttgttgggcgcctacgtcttcaccgaccggccgcctcgtccgccgccgactggtgcttccgcctgcacggctggcctttatgccgccgttgttgggcgtctacgtcttcaccgaccggccgcctcgtccgccgactggtgtttccgcctgcacggctggcctttatgccgccgttgttgggcgtctacgtcttcaccgaccggccgcctcgtccgccgccgactggtgcttccgcctgcacggctgggctttatgccgccgttgttgggcgtctacgtcttcaccgaccggccgcctcgtccgccgccggctggtgttttcgcctgcacggctggcctttatgccgccgttgttgggcgtctacgtcttcaccgaccggc

SEQ ID NO: 64797 - DNA, 1770 bp, Oryza sativa
cacggctggcctttatgccgccgttgttgggcgtctacgtcttcaccgaccggccgcctcgaccgccgctgactggtgtttccgcctgcacggctggcctattatgctgccgttgttgggcgtctacgtcttcactgactggccgcctcgtccgccgccgactggtgcttccgcctgcacggctggcctttatgtcgccgttgttgggcgtctacgtcttcaccgaccggccgcctcgactgccgccgactggtgtttccgcctgcacggctggcctttatgccgccgttgttgggcgtctacgtcttcaccgaccggccgcctcgactgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgactggccgcctcgtccgccgactgttgtttccgcctgcacggctggcctttatgccgccgttgttgggcgtctacgtcttcaccaaccggccgccgcatccgccgctgactggagtcaccgcctgcacggctggcctcttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgttgctgactagtgcccttacctctacgtctggtttatacagctaccactactgatggacatcatcatcttttgtcgccgactggttatgttgtcgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaattggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgcgttgctaatggatgactaagactttgccaacttgctattccgccttcacggttgacctactatgcaaacgctgatgagcgtcttcgtcattatcatcggctattacaccgctattgactggatcaccgacatcgtcatcttcattactgtcggttacatttgtcgtcgccgactattttcctcatc

SEQ ID NO: 64798 - DNA, 2106 bp, Oryza sativa
aaatgtataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgagtcatgtcctgaataaaattccaatgaagcataaggaagtaacaccattcgaggaatgggaaaggaagaaattaaatctctcatacctacgaacatggggctgtttggccaagataaatgtacctatagccaaaaagcggaaacttggaccaaatactgttgattgcgtgtttcttggttatgctatccacagtgtgggttatagattcttaatagtaaactctggagtacccgacatgaatgctggtacaattcttgagtccagagatgctacattctttgagaatgaatttcctatgaaacattcacctagcacttctagtaaagaaactgtcatgccccatgagcactttgcaccgacagaacacaatgatcaaacgcctgaggaaaatcctgatgaggacaacattgtagatactcgcaagagtaagagacaaagggttgcaaaatcctttggagatgactacattgtatacctcgtggatgacaccccaagaaccatagaagaggcatattcatctcctgacgctgactgctggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcactagttgctcgcttgaccacgattcgagtactacttgctctggcagcctctcatggtcttctcgtccatcagatggacgttaagacagttttcctaaacggagagctggaggaggagatctatatggatcaaccagacgggtatgtactagaaggttaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggactagccttaatgtgattgaggaggtcaaagactatctgtccaagagttttgaaatgaaggatttgggagaggctgatgttattcttaacatcaaactacaaagaggagatgagggtgggattacacttatgcaatcccactatgtggacaaggttttgagtctctttggctatagtgactgcaagccagctcctactccttatgatcccagcgtgctattaaggaaaaacagaagaatagcaagggatcaactgagatactctcaaatcattggttcattgatgcacttggctagcgcaacgagacctgacatctcatttgttgtaagcaagttgagccggtttgtctcaaatccgggagattatcattggcaggctctggaaagagtaatgcgctatctaaagggcactatgagctatggaattcactataccgggtatccaaaagtactagaagggtatagtgactcaaactggatatctgatgctaatgagataaaagccacaagtggatatgtgttcacacttggaggtggcgctatttcctagaagtcttgcaagcagaccatcttaacgaagtcaacgatggaagcagagcttacagcactagatactgcgacagttgaggccaagtggcttcgtgaactcctgatggatttgccggtggttgaaaaaccagtgccagctatcctaatgaactgtgataatcaaacagcgattattaaagtgaacagtt

SEQ ID NO: 64799 - DNA, 9842 bp, Oryza sativa
ggatggcttatgtcttaatgtgatccgagtggcttttccaagcagagatgttgacctgcagaacatctcagaaggaacacacctatatgagttcgactgctagtcacattctatgaggtttgggcgatctctagatactcatgaaaggcctagagtttgacttatatgctccaaacagaggggatgcgaacggcagcccagtaccagtcaaggttctgagtaaaacctgatcacacaaacttacaattcaaggcatagtccattgttcagttgtggtctgatgtagctcatttcctaggtggaagttcaacttaacagtctccaccaaaaccctggtatctcaaacaggcacaacattgagaacatttcttatgagccttgaaatttggtggggattgttagaataattgggctaggcccaacttataatattaaatctcaaaggcccataataagtgttgaggataataataccaccttaggatttaagcgagaaatatctcaacctaaatagggagttattggaggctccctgttgaccagttgaggtgggggccggaatgccacacgcgcgcgcgcgcgcgccgggccgggccgtgggcgtgggcgtggcgggcgtgcgtgcgtcacgtcacgtcactatccttttgcagccactaacccacgttcccacgattccctccgcaacagcgcgtccacgttctttctcctcctgatagataaggaggccgcgagtccgatccggtttaatcgcttctttcccggtgttagtttctccttctccacgcctgagttgctctcgcttcctcgcttctgatctcttgcgcgcacgagagattggaaggagcagtgcctccgaaaccacaccttcgcctgagttctgcaccgggtaggcgggtgatcaggtttttgtggagtgcctcccgcacgactgctcatcgccatgtctggagttgccgccgccgctgctggcggaggtggtgcgccgccgacaggagctggatccggagctggtgcgccaggaggtgcgtgaacgacaacaacaacagaggcaattctgcctcaccatccagcggagggctattctcggggtataatcttctcctcctgttactgttgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaattttttggattaaaacatgccgattaatgactatatttccaacacaaaagagcgtcaaataagcaattatctctttttaataaatccataggtgaaaaactatgcaaacaaggaaacaaattaagttcacttgcacgccttgatctgcaacaagttgaaaaacactagattccttgtaaaaatatctgaaagacaagttgataggcaacagtattagatagctctcaaatgtaaacatatcttttcatggatacaatattgcctgctttgttgcttaattacattgtccatagtattatccttccatggtaacataatcatcctttatttaattcatacatcactattcatactactctttctgactgttgctagagtgatcaagagtgactgacaaaatattctgccattctataacatggttccctctcaggcttgctgcttcctgttgttgcttccccatatcactaaaattgtaattccaaagcagacaccaaatcccaacccagtgaagagaaaaagtagaacatctatgggatccttcttggaagcatgtggcatgatgtttggttcagatcggtcgctacattgtttagacaatgggggtccgcagagcccaatatttccctcaaaagaggcattggaaaatgtcgagaagtgtgacgattgtggtattcttccagccaacatattataggacaaattcaatgttgcaaggaagttcaacgatgctagctcttgtggaatctcaccagaaagcttatttgaggagaggtccaacgactcaaggttgttcaaattgtcaaactgagttggaattggccctgtaagcatgttatgagacatgttgagtccatgaagcaacgcaagttccccaatgcttgaagggatgctaccatcgaattcattatttgagacatcaatgagcacaagtgatctcaagatcttggaaattgttatgtcattgcctttgtatgtgagtgcagcagtaaactggtatgtctggccatgggaatactgatgttccatgactaaagtctcgttatctgacctggtcatcatggacttgagcatcttaaacaactcttctggcaatgtgccactgaagttgtttgaggctatgtcagcaatccgcaacatggaaaattgacagttgtttccatctctggtatacaaaggatccattattttcccatggaacttgttagacttgaggaccaggacttgaagttcaggaagtttactcatccaacatgggaagtggtcactaatttgattgttgccgatgtcaaggatctccagattcctacaggcaaccaaagatcttggtagctgtccttgaatcatattgccactgaagtctaatgcacttaatgcacaaccttccttgatattatcaggtaactcgccagtaagatggttttgttttagacttaatacctgcaatgcacttgcattttgcgtcagacatgatggcattgagcctgtcaagttgttattagagagatcaagtagttgtaaactcttaattgcatcacaaatcgatgagggaatgtttccagagaggctattgtcggaggctttgagaacgactgtactcttaaggtaactggagaaattaagaggcatagatgagaaccggttggttgagtaatcaagtgtgatacttcctttttgtggtactggtattgctccatcaaaattgttgaaactgagatcaaagtattcaatgtaaaggggaagtaaaggattggatccaatactcgtaaagttattatgtgataggttcaacaagaaaaagttcatcgtccatgtctcccatgtccactgaggtattgcaccttggatctggttatatgaaaggtcaagactagtaatattagggagatgcctcaagatgttagggaagctagatatgctgcaagatgctagacgtaagaagctaatactggggtaggacactactgaagaactattttctccatcaaccacaactagtttattatttgagagattgaggacagaaagattttgcagttttgagtatgaggctagctccactgtgccaataaagttgtttgaatggagcaggagggtttgcaagcgagtcaaatttgatatcagcgcagatacctctcctgaaaagtggcaattgtacagtgccaattctctcaatttcgttaaggatccgacagaagcaggtattggtccggacaaaccacaatggaagaacttgagaacattcaaaaaagtcagatttgaaatccatgacggcatggatccttgtagctctaacccagacacctctagtatacgtaaagatttcagcttaccaatggaagatggcagcattccagagaaaccactagctccaagtgccaactccttcagatatttgaggttgctgatggaagctggaattgtgccggagaagttggtgttgctcacagatatactttgtaagtaactgtgagcagagaaattaggcagttttccggagatcccaagattattagtgaggctaatactagttaatttctgaagctggaatatgatgggaggaaacaccccttcaagcatgttatttgaaagctgaagaacagtaaggttggagagagtagccaggagctcaggaactggaccagacaaatgattgtagtgcagctctatcactgaaagtgatcgcaaggccgagagtgagtggcaaatgggaccggagagtgagcagtacggcatgctaatgacccgcagctttggggaggacctggccatggcgtcgcaccaccgtgcgccgtttctcgacatgttcaccatgcccagacgaagctcctccaggttggtgaggtttgcgagcaaggtctccaagctcggttccgagagctgtgaaattgtgtctgagtagtaatagatgacgttgttctcatcgtccagctcatcttcaaagaatgttgtggacaggtcaaggtaggccaggctcttgaggcggccgatgccaacgggtacccggccggcgaagttggtgctgcagaggtcaagatgggtgagctcggcgagcttctcaaacccagtggctgggagcttggacgcactgaagtcgttccaagagatgtcaaggtactcgagggaggttaggctgaagagtgcatcatcaagacctggggatcgtagccatcggtatcccaagtcgagggaggtgacggcacggccttgggcgccgccgcatcggatgccctcccagcggcagcagtccgtgccagcgatccatgaccggaatgcggcggagtagtcgccggctgttgcatcgaatgagttcttcaggcggagcagcgcccaagcctggcctggaaggcatggagctggctgtgccgatgccgacgagctcgtaccgtcggcaagcgtgctcctggactgaacctgtatgaggaggatgagtagcatggctaggagaggcatggaactagtgtaagcaaatgtcatagaggccaacatgtcggaggttaggtttgttttcagttatgtgagactgatacacaagaagcgaagggatatctatccgtttataatctgtctcgtctagtagcatttggacacgcattagtcaaactttcgatagtaaaaaaagaatcgaatcgtgaatggtattgatttgtatatttgtgttgaaaatatcttatgaaatactgtaattctatcaggtcagtatatatattgtacatataaattagtggctaaaactgtactcccttcgattccattttaattgacgttttgaacaatgacacggtttacaaggtacatcttaatttgatcttatttttctataataatatatataataaataaatgcatgtttacttttattatagtactttcaaagacaaatctatatatcttgttccagttcctttaaactaaatatttttaaagttattgatggtcaaactaataaaagtttgacctcaaccttgtctaaaacgtcaattaatatggaactagagggagtaccatgcatgtagacaatgccaatgtctaaaatgacttattttcctgggtccccaccaaagatggtttaagtccttgcataatttctgaaaatgctggggatcgggtgcccgatgcggtggaaaaaaaatcaggccaccctcctcctccacgcgcgcctccgcctcgcctcccacgtgtccccaccactcacgccccgttgcaacaaatcccccacatattacggaaacaccctattaagggaatccgttttattttttttccaccaataatgtttcagctagtaccctcatgatattttactatgtatggacgaaatgttgcagtgaattgaaatattcatttgcaacaaatcacccacatattatggaaaccctctattaagggaatctgtttcattttttgttccacacaaaatgttttatctagtgtactcataatgttttcttatgtagatcaaatgttgcagtgaactgaaacattctttcgctatttgttgaaacattgtttttatatagactgaaacaacgctcgattttttagaaaccgttgtttcatatgttgtaccaaaatgtttcatgagctgattttgttgtgtttcagctttttaaaagactaaaacattttcgatctttttagtgaaacatgttcgatctacttaggcgcctcaattttcttttttttttgtcgatcttttttttcgctggtttataggagccgagcgagacagcctgggtggatggcaatcaggatgggggcagtgggaggatgggtatagaattgctgtgcattgcaatgggtaaaaatgttttttctgtgatacaataactattaagagctgagcaataaattgcatgtctctctttggcctggcccataagtggagccacaggctcagctcacacacacgtcgtcttcaacctacgaaagaccgatccaccctattaaatccagccaaatccttctcgatattctaaaattggttgaggctttttatctgctcgatccccttttgctatttttttctcgaaattggaataaatccataaaactcggaataaaaacgatcagggaaggtcaccggttggccatcatcgatgactgagatttaatctggcaaattaaagttcaattgaaaggaaaatcgcaaggaaaataataagagaagtatggaatcgatttttgcaattaattgaaagagaacgtttggtgagacaaattgacgatagtgctaggttcgtaaaaaaaactgtgatgaaaaaaaacacacggaccaaaaaaatggagggacagaaaaaatatggtataaaaaaaaccaatgaaaaaacggcgatgagaaaaaccggacgaagcctgattgggaaatctgcaacaaaaacaacaaagcaccgagacaaaaaaaaacagaagctttatgtatatattaattaggtatatatagatatagattataaaaactagctaaaaccaacttagacgtggatgacgtactaaaatcccgacgaaaacatcttcaaatttttaaataatagacatagagatagagatatatgtcatcatatttcataagtcaacatgcggcatatatctaataattgttattcacagttccgatcgatttgcaaaagttttcataacattttttgatgaaatttcatataagttctgtcatgatcaaactaatctggtgcaaagtgagactttatttcaacaaatgctcatcagttgcaaactgaaaagcttgtgctagctacacacccttttagtgaaacaaggtgaacacgatacatactttggttgtgaaatcgagaattaaaagcgaatgtccttgtgtgtttttgggtgtgggcatggcccaggatgattgccgcacagaaccctgtacttgaccgcccgcagttgacctggtaagtcgtggttgctgcagcagtgcggttgaaatgggacgacatcgtaagaattactagttgcactttcgccgtggtcgtgcaggagcttcttgccatgatcagcttcttctgaaggaaagcttgacgccgctacgggcgtcgtcgccgccgccgctgccgtcgtcgtcgaccccgacgcggcggcggacgcatcgcggggcgggagcgatgcgaggaggaggtgcggtgcagacacgatgatgatgatgaggaggaggagcgacgacgctagcccaaccccgcgcaccgccgccatcgatcaccggccggcgcggcgtcgtacgttcccgaaatcacacgacacaattccggcgttagcttttgttattgctggatgaccgtgtaaggcctcctatttgtagggaagtagcttactccctccgttgaaaaaaagacaaactctgagtttccgtgttcaacgtttgactgtctgtcttatatgaaatttttttatatttagtatttttattgttgttagatgataaaacatgattaatactttgtgcgtgacttgtctttttaatttttttcataattttttttaaataagacggacggttaaaaattggatacggaaatccagagtttgtctttttttttttggacggaggaagtatgttgggaaatgaccacatggaatacaacggaaacatcttactcttggatggatgaatatctgtacggttgatcgattgcgtgaccatgaagtatatgcaactaaaccattatatgcacgcatttattacttcaccgcattttttttaaaaaaaaaacagtacaaaataattgttcacaatgcgtgcacactcatatctacgaatacgcacacacactctgtttctatgagcatttttaaaagactggaccgacatatcttaagattaacatagtcagcgacagtctagagccaacatcgctgaactactttctataatttacttgattcaaattaaaaactaatatgtgagatcaatgagttaaaattgaatagtatatgttttttgatttgtatgtgagaggctttttaccgtccttgagggaagacgataccaaatcctagccgttgatttcacgtcccacctggtacagtgttcccaacgagagcaagtacgatcagtttctgaggtgggaggatttcattgtaatttcgcatcaatgcttgtctcgatccagcgacctgatcgtggaccgcctccttcgagtgcttgtacgctgcggcctatggcctccctcttccctctcctaccgagtaccgaccactgcctcctctgttgttcgggcttgctccaacacaccgcaccagtgtcgtcggctaccatcgcctccgatcatgctctagcgcggacaccatcggtcgctccctacttcggtcacgcggtctcctccgctcctcatcccctgcaccttcactctgtctttctctaaaataaattaatccagcccaattgatctcttcctaggttcatttggatttgattttttttccgatataggtgtatatgttcaattgctcgggaaagtcatgtcatctaaatagtcataaaaaaatatgaaaaaaatgacaacatagattaatataaaaatatatcactccacaagcatgcaagtttaaattcaacttctgcaagttgtaacaaaaataacaaatatagttgtgaatgtgcgataactattttcagtttagtttgttatttttgttgtaacttatagaagttgaatttggtcttgcatgtttgtggactgatatatttcgtattaatctatgttatcaattttttttcaagttttttttagtaattatttagatgacatgcaaacaacgagggtatatcccctagagggatgaaattccacatcccaattgctctgcgttcatagtagttctcaagcggtggcagtgggttagacatggcttgcaaggtgttcctgcgtttgcgtgctcacaagaagacagagagcttgtctatggtgatggagattcccgggctgtagtttcctctcaagtatcaaccaggattgacccagtgggcagttaatcggttgctaaggtgtctgaatccagctacactgagggcagctctacgcgcggtgacgccggcttcacttgcaaagatggcagaagggcagcatcaactagttacagcgacagtacaagacggtgacagctaagacatgtgaattttaatcctacccctttcaaatcaagggttaaatggaggtggtacctggtgatacctccctaagaacggtaaaaattcttatcaattaaatatgaagaggaacatgtatgttctttcgatttgaaaggcattcaccatgggttgggacacggaccaagcatcagcgaaatgggttcttcttccaagttttttgatgaattttgactaaattttgatcaaatttcatcaaaatttcactacctagaacgtagcaagttctacttaaaaaatggtattatgcgtagagggagtggttttattttggagaaataaagaagatagacaaattaagtctatgtaggatgaagggagtacgccatacaatgttaggcgtttatgagtttcgtgcgcttgcgctgctgccgaaggaccatgcgg

SEQ ID NO: 64800 - DNA, 14726 bp, Oryza sativa
tacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatagtatatatatatatatatatatatgcgtatgtatatatgtataaatacatatattacacacatatttataatttaaagcacttaacattttatatacatatatgttaccaaaatatatattaacactaaagtaaatatacgtacatatataaatatatatatatacatgcatgtacagtacaattcatttacgcgctagctatagttacgacttcgacacctgcgttacgtcagaagaggaaggaccgacgttacgaattgtcgatccgtcgtagtggaattcaccatcgggattaaggacttcttcattgatgaaccccatcagttgttcttgaacagccgtgataaaatccttgtgtgggagtttttccctcatgtgaatacgctatcattcgaaaaatatgacatatcaatatatgaaattaataaacaacttaacaaattgatacgcaatgaaattttgaatggtttatgtatacgtacatcgagctctcgtgtggtgtatctttggtttgataggcagtgggcatactcgcatacgtagtagccgcataagttagttcccatgtcctgctttgcgcactacatgagaaacgatgagagatttaatctactctttatattaactgtaactagagattcaattcaatataattttggatcatgcatgtactcactggaaaatgaaacctctgtccaagtttttctttccaagtcccgcggaccaattgacggaaccgatcccaagccctacatgtgtagttgcaagctataattaattaaatattacctgagatcaacataatagcaacagagtcgcgcgactttggaatagatggcattatattacctgtctatcagttggaagaccttgtaaaaaaccttctcctctttattcattgagtcatacacagtgactctgcatgcatccaagtcgaaaaagaacaggacccagtggaatctggaatatgcgtgagatgagataaatatcagaatgtacatgttatatgtatgggaatgaaatttgttcgaacggcaataaaaactcactctgtgttgtacggcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattattgaacgaaacaaatcgaactccaagatacttacaaaatccatgcgcttagaagagagacgtcgagggtgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttctgtcggtagggactgcagctggtcaggcctgacaagcggtttaccgagttcaaacttgtatgccacttccgccttcgggattggtgcgcctccaaccaactgagccatgggtagaccggtgtccaaaataaaatccgttatgctaaagtcttcgcctgtcaccaacggctcgaccacttggtgtggttgttctccaagctgaggaactggtttggacttcttgtaataggctttcctaagtgttcggtcacaatccgatagctttaaggcctccttgtttgcggtggacattcccttgaagaaattcttcacgctcgggtcaataggtatcttcttttcaggactccgaggcttgagttgcctcttcacttctcctgccacataagcgtcaagctccacttgactgcaaccgtacggtggctccttgtttttggtggtgtcaactttggccttcttcgttgcccttgtgctggcaggaggtggagcttggcgagaccttgtcttgggaggtgcaggcggacacggtggaggaggaggcggaggagccagaggagatggtgccggaggagacggcggagccggaggagatgctgcacgagacgccgcttgtcgccccgggaggatgatgtaccacttgcgccatagtattgtcacgcccggaaattcactagtattttccgaacttatttgtgcataaaatcctcgtccaggaatcagccgaggtacacaaactgacaatttaatatacaaatccatcataattagctaaaacgataaatacttacttaagaggcacttagtcctcaccatgaagaaaactgcagcggaaaataaaatctagcgaagctccggctcaactcccacaggcagctcaacctgtgtataagccaaacgtcttctcctcctagatcctttttcttcaactgaggttgattgattattgcaagaatgagcatatgacatactcaacaagccacacagcaaatatgcaagtgcaccaggataccaaaggatggcataatataggctcatttgcaaaagcagcatttagcaaaacatttaagagaagtaaaacagtggagtaattaatcagaaattttaatcaacactgaacaatacacccatgttgcacaggcccaaccatcctgaacaaccatacccggctgtacagatctaactccaaaccaggagctaagcaaattattaccaggtataacatccataattattgtgagaggtgtgggactaatcacgaaaaacattgctcaacccgcccataaccgcgggcacggctattcgaatagttttactctggccagaggtgtaccactgtacctacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatatttcacaacagtagctcgcgaaccggtccttaattgtcatgagcacgactctcaaaaccatgtgctcacaacccaccattatcaagttttagttgtcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagttaagttataataacccaaggtatcaaggaataaagtaatcaatgcaaacaggccataacaaaggaatagattcacaccacccagtgacatttgaaaataaatgcacagttgaaataaatagagaatttaaatataggatcaacatgctcaaaggattgtgtttaggatccgtgtgacttgccttgcaataatcggtcttcaattaatcttcttgaatacttccggcgcactcacgaaccttcgcaacgacagaaacgacaagctaacatgcaaaacgaaaaaaaagactaataaaaaccaaataaacaatacataaaaagtaaacaaacatgtagatcatgattttagatgaattatgagacttgaacggcctcattctgacttcaaatgaatttattatgaattttacaagattaaatctaattaaagcccatttaaaaagaattaaataaatttaattctatttatggacaattttaatatgtagatctttattttatacaacttttgcaacttgaaccacattaaactgagttacaaagaattagttatgaatttttaaagattaaaccggattaaagcatttatatggattttaattgaattatgacgcaataatgaattatttttgaaaaggaaaagggaattattgcgtcagcggctagggtttgcggtggaccgggtgcacggcaacggctcacgggaacggacggccgagatcgatcctatccaaaacggacggccgagatcgaacggtccacgaccgggccacggcagacagcgatgatgacgtcagcgatgacgtcagcaccggcggcggctcggcaacgcatgctcgccggtgaatgacggcacgacgacgcaaacggagggcaccaagacgtagagcgcgacgcggcgaactcaccggtgaccaaaacaacggcggagaagaaacggacggcgccggcgacgaggaagaagcggcggcggtcttcgggtcgacggtgacggcagtgctccggcggtcttcggcggcggtgaagcggtggacggggacggcgacgacctcgcgatctcgatggtggcaacggcgaccgacgacggcggctacaacggcggcgcgacgcggctgaaccgacggcaacgacggcggcgactagggctacgcggaggcggcgctagacacgacggctggctaaggcaaaggtggcgacggatagaggagagctcgggggtgcttataaaggggctagcgagcggcgacggaggcccacggtgaccggcggcgagaaggaaaggttagggttcggaggaaagagatgaatccgattcgaggtcgaatccacaagtttccaaaccgaattaggcgagatgattccaaaagagaaaaggaagaggagatcgagatgatcatttcccctctattgatttcaccggatcgggaaaggggcgagcgaattggaaaggagacggcggcacggctcaactagggttcgggcgtcggcggcgcgaggaagacgaacctgacaggtgggacccacctgtcagcggccgagagagaggaggaaggggcgcggcggactgggcggactgggccggggagggagagagaaggttttgggccgcctttcggcccaaagccaaaagaggatttaaaaacatttttctatttaaattattcatgaaatgcaattccattgattaaaaatacttccttggctcaaataaatcccagaaaaatctaggaactatagaatcaagcaaagtatttaatgaaattttatctggccccattttatattgagatttagcaaattaaaattagatcttttcttttaggcttttaagatcatttctaataattccttttaaacaacaatttataatttaaggatttttaaacaagaaaagctcttaacaattataattagattattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccatatttaacttcacttgtaaattaaagaacatttaatataaattctaataataatttattaaataatttataaatcctgaaacaaaaatcaggatgtgacaagtataatggcgtggcttgtgtctcgtagatgcgtctcaccgtctcctcccgggtagtccaactcgatgtcctcgtacacggcttccaccagctcaactttgaccctcgagtatcctgctggaatcggcctgcagtggtaagtccctgaaatgtccgttgggatggccattcctgacgccaccttcacgtgatgagaggttatctattagtaatcaacctaagcagcaacttgcggaacgtacgaatcaaaaatcatatattacatcgagcataccttgattaataagttcttaaagggaatatgcagctcacatggtgtccgatgcgtgatctcatcaacggggcaggtggtttcgtcctgggtttgcatggcgtccatgctatgtgatactacctgccccgttgaggcgcagctgctacgattgcctgatgggctgaccattggaggatgtatgtacggctggggatcatgtgaacgatgtgctgccatgcgttcatccaccttccgggccaccttctcttgcatgctgagctcgtagctcgataccctgtactcaagatctgcaatcttcgcctcggtatctctcttgctcctcatccgactcctgtacgtgtggatgtcctccttgaatccaatcttccagggaatcacgcctttccctcgtgttcgtcctggatgctcgggagtttgtagggcgagtgacagctcgtccttctctctgtcgggtcggaacgtgccctgagaagaggcttccactgcgtccgttagtcgattcgcagcctcgcgtatctgatcgctgaagaccaaggagccatcaactgggttgagcgttccaccgtgagcatagtaccagaacttcgatcgatcaggccatttagcggtggccggttcgatacccctctcaagcaagcttgcctccatctcctcccacttcggcatcgcgacgctatagccgccttaccccaagtggtgatggtacttcttcttggcagcattttctttgtttctttccatcatcgcctacccttgttgacctgtcttgtaagcaacgaactcgtccaagtgatcccttagcttcgggaatacgtcaaagttcggtgtctgccccttcaagatgtatttccggtacagatctcccttgaaggtctggaactgttctgccattttcttaagagtccactgtttcactatgttctctgtacccgcagggagcgtgaacgtctcgagcattgtggttcacagcatctctttctctgatttcgggacaaagctgtcattacccccgcgtgcccttgttctgcgctagtacaccttgctgacaggcacgttatccctcacaacccaaccgctgtggcgtacaaaattcttggctgcttgtgccggggcactaggtcggctgtctgcgtccacctcagttatgatgtgccgaccctctatcttcttcgcggcacctcgttgtccgcgtgccctcttctgtccagcggagggatgacttccactatcctcctcctcattcccctccgcatctctctccacgtttccctccttgttcccctctgcatccctctcctcgttcaagtactggtttggatcctcgttcccctcttcttcgttccagtactggctgcttcccgatgcgattgtatcgtacagtatctgttcctcatcgcgatcagccatctgttcatagaagaaatatttgctaagcgtaatattaacactctactaatcttgtattaaaactcaaataatcatttatgctaagtctaagtatcgtgtatttgtacggtagataatcatatatgctaagtctaattaagtttgaaatattacatctctaataatcttatattaaatctctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacggtagataatcatatatgctaagtctaattaagtttcgaatattacatctctaataatcttatattaaatctctaacaatcaaatatgtttcgaatattatatctctaataatcttatattaaatatctaacactgacatatgctaagtctaattaagtttcgtatattaaacctctaagaatcttatattaaatctctaactatctctaacactcaaatatgctaagtctaataatctaataatctttaacactcacatatgctaactctaataatctaataatcttatattagaaatctaacaatcttatattatatctctaacaatcacatctttacatcacttgcctgcgtgaattccttcgagggctagctaccacttcggcttgagggacgacaacgacgacgtcttctctgcaacatgcaaaaaaaatgtattagtctaaatgcaaaggaacatataatgtatttcatgttttcaagtatatataatcatatatatatggtaagttcaacaatagtttaattatctcgttcgtacacatttcgctcgcgttcgttctcacacttttagttcaagtgcattcacgttcgttaacgtttcaatcacgttcgttcacgtttcattcacgttcgttcgtgttcgttcactaacactcacgttcattcatgtttcagtcacgttcgttcgcgttcgttcgcgttcgttcgcgttcgttaagcgttcgttcgcgttcgttcacgttcgttcgcgttcgttcgcgtttggtcacgttcgttaagcgttcgttcgcggcggcggcgtctcgcggcggtgggggcgcggtgcggcgccgtgggccggcccggcggcgtgggggcgtggcggcgtctcgcggcggcggcgtctcgcggcggcgtgggggcccgacggcgtgggggcgcggcggcgggccacggcggcggcatgggggcccggtggcgtgggggcgcggcggcggcgtgccgcggcggcggcgtaacgttgcggcccggcggcgtacgtcggtgtcggcgtcgtcggcgttcgtcggcgaaagagagagagactgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcgatcttcaattaatcatcttgaatacttccggcgcactcgcgaaccttcacaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttaaactgattttaattgaaatatgacgcaataatgaattatttttgaaaaggaaaagaaagattattgcgtcagcggctagggtttcggtggaccgggcgcacgggcggcggttcacgcgaacggacggccgagatcgatccaatccaaaacggacggccgagatcgatcggtccacgaccggctcatgacggacgaccccgatgacgtcggcgatgacgtcacctaccagcggcggcggctcggcggagcggacggctcgggcggcgcacgctcgccggcgaacgacggcgcggcggtgcaaacggagagcaccaagacgtagatcacggcgcgacgaactcaccgatgaccaaaacgacggcggaggagcaaaggacggcgccggcgacgaggaggaagcggcgaagctcttcgggtcgacgacggcgacggcgctccggcggtcttcggcggcggcgaagcggtggacggggacggcgacgacctcgcgaacccgatggtagcgacggcgaccgacgacggcggctgcaacggcggcgcgacgcggctgaaccgacggcaacgacggcggcggctagggctacgcggaggcggcgctagacgcgacggcgggctaaggcaaaggtggtggcggatagaggagagctcgggggtccttttaaaggggctagcgagcggcgacggaggcccacggcgaccggcggcgagaaggaaaggtcggggattcggaggagagaagtcgatccgattcgagatcgaatccacgagtttccaaaccgaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggccggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttgtaaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcgtgaagatactctgccacagtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaaatgatcccaccattctgatgcaggtccttgcaactgatgtgaagcgaacacgactttctcctgatccgtacactggagcagttccaacttcttctcaacagcgtgtagccaatcacctgcttctactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctgttgcttattagagaggatagaaggagaggggttacactaaagacaagaccttaaccaggttaacactgatctgatgtgtgtagaccattatattgttcaagttgattaagcaagcaacctagtatagttacacactcatcattaatcacaccaatgacgggaatgcaaccatacctacacacaagcaagcaacaagcgttctaccctactaactattctccaaggacactttggcggcataggttctaaggtaggatccaaacttcattccatcttgacatctgggcacttcagatcgaccatcaccttcttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccgcgggcacggct

SEQ ID NO: 64801 - DNA, 1697 bp, Oryza sativa
ccggttgttgttagcaaccggcagtgcagatatctttactcccggttcttctcaccaaccgggagtaaagatattttcccgctatttccaaattcttttttaaacccggttagggttaagaaccgggactaaagttaatagcactgaatattgaatttcgttgcatatatgtttctaaaatagtaaataatgcattaaaaattctaattaacatatgtaaatcccacatgcatgatttaaaacttttaaaaattctaataatcatatataattagcatatgcatgatattaaattgttaaaaattgtaacaaacatatgtaaatcccacatgcatgatttaaaacttttaaaaattctaataatcatatataattagcatatgcatgatattaaattgtcaaaaattgtaactaacatatgtaaatcccacgtgcatgatttaaaacttttaaaaattctaataatcgtatataattagtatatgcatgatattaaattgttaaaaattgtaattaatcatatataactagcatattcaatacatccaaaatagtttacaacaattacggcaatagattggcggtgacggttgtccacacgtactttctcctcactattgttccttccttgtgatcgctacatgagtaaggggtgtcttcgtttgataggaggatgctagggtcaaccgtcaccgtgaaagggggttgcccatcaaactgatcgtaatcctcgtcagtcttgtcctctactccgacgatttttcttttgcctgggagaaccacatggcgcttcggctcgtcaggccctttgcccttctttcctttgctagacatgtccttcacgtaaaaaacttgtgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatctccttgatgacaccgtaatacgtgccagttgtaccatcgtgtcccatggcatcgatacgaacagcactattctggttcgtgctcttcatgtcttgggctcttgtgtagaatgtgtacccattgatctaatatccctggaatgtcgcgatcgagccagatggacccttcgccaggaaggccagttgttggttaatcgtctcgttacccatgagatgttgtcgcagccacgcggggaaagtatcaatgtgatgccgtgtaatccatgcatcggagttaccgatgtttctggcgcgaactagagccaagtgctcctcgatgtaaggagccaccaatgaagattattgtaaaaccgtgaaatgggctttacggaataaattgttgtctaccgtcataattgctttccttccgagagtcccctttccccgtagtctcccttcatggcgtgattcaggtaccccgattgtgcgaaggtcttcaataaattctatgcaaaattcaatgacctcctctgttccataccccttggcgatgcttgcctctggacgagcatgttacgaacatacttcttcagaacgcccatgtacctctcgaaaggaaacatgttgtgtaggaacacaggcccgggaataccaatctctttcactaggtgacaaagcagatgcgtcattatattgaa

SEQ ID NO: 64802 - DNA, 1446 bp, Oryza sativa
aggtagctacacagggagaggcaggtttggaccttgcattcctacgcagccatgccccaaaccaataccatagatgccatcatcatcaccaccagtggtgagtatagtgcgggtgacactgatcacgataagcacacgtactatacgtatatacggttatatataaatacataggcacatctgcgaataaatgtactcgatcgctctccctctcctggataatactccctctatcccagaatatagcaacctaagccatcctaggttgctatattctaggacggagggagtatatccctccgttaagttgtccttccatcattgttaatggcaatattatataatattacattgtaatatgttttgactttatatgctacgcgttcgagaatctaacatgaatattactagtaaaaatgtctgtgtgttgcaacatgtgaaaaataattttcacgatcgataaaaaactatgccaatttaaacgacaaatcgaaataagacaaacaaaaaaatagcaaagcaaagtcataaatcatatgcagcattgaacccggttgcgcccacttcatgtgtcatcacacgaataatcccttatacacaccattatatagcctcaaaaatcgatcgggtgaccattccataagttgacgcatgtgcattttactatacctcataaaccaaagattgaaattttgattattcaattagttactgtatatggaaagcatttgcaaagtaacaaatttgccctatgcacaccttttaacaatgatagattccaaaggaaaatatttatgagtgaaatttggaagagagaaaggagggaaaaagagaaaagagaggaaattgcaaggagagggcgagtataaggattatcaggagaaaagaaaaggagaaaaaaacaaagaaaaggaagacaaaaaaaaaagaagccaatcgggggagaggcacacacggcgccgagtagaggcagcgacatgggtgatgggatggtgtggaacggttgagttgggttgtgatagtgatgtataatatttattctaaactcatgttgaattggatacggaggacatataaccaactcaaccacggatgacgtaccaaaatttcggtgaaaacatcttcaatttttataataatagagaagtgtcggtatgcaaaacgagaaaatcattagtgtaggattaattgaggtttaattatttcaaacttgtaaaatagatttatttgatatttttaaagaagcttctatatagaaagttttcacacggaacgcaccatttagcagtttcaaaagcatgctaacggcaaccagggtagaatttgtatcttaatcagaacagaacagggcaaactttaaaaagtttaacctagtttatagaaaaatgtagcaacatctattaattttattaaatccaccatcaaatgtatttttgtagtatattt

SEQ ID NO: 64803 - DNA, 967 bp, Oryza sativa
gcggcgccggtgacgtaggcctcgtagcccgccaggtcgtggactaccacgccggcctcgccgccgccggcggccttcatgtccggcgggtgctcaaagcactgcaagcgcggcggagcagccgcggcggcggcgccggccgccgcggcgagcgcggcgaggcagaggatcaggaggctcaacgaagcagttgccatatggttaatttgcatactgatgagtgagagatgatgcttgggcttttgtacatgcctttaaccggtagagtcagctgcacgctgcaatcctgcgccccttttttcttgtaaaaaaaacaaagtgaaactattacactttgtattacgtataatataaactattacactttatattataattggtttgattttttttaatcaaacttcttttaactttgaccgagttcgtagaaaaaaatagtaacattttcaatacaaaacaaatattgtagcaatgtacatgctgctaatttttactataaacttaatcaaatttaaagaattttaaccaagaaaaaagtcaaacaacttataatatgaaatgggggagtactccctaactatttgtcattgtcatctccaattatttgtcatgctgtcctttcgaattatttctagttgtcgtttcagcgtggtccaatttgatgtttggagcgtagtgagttgaaccacattcggatcaattctacgtgtcccaagctcaagaaatctatcaaggaggatgagaaagataacaaggacaacaacggcttatcttttgaagataaaaggaagaaccacaagtgcaaacttgtgcgtcaaaagctttcaaagcaagtcgagtttagcgatgaaggataatcggaaagcgaggatgataagaaagcacataccaaaagtaaggttttgtgagtttatgtcttatagtaaaatgcttgtgcgttacaacgggaaaatctacccactcaaaa

SEQ ID NO: 64804 - DNA, 1616 bp, Oryza sativa
ctacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcggatagattcaaatgttacacagtaaatttggtcaaaattaggtcggaattcgtcgaaaaccaaaccgtgatacgatacgacggggcttgaatggccaaccggtaaatgtataaagggtaaattggaaccatgccattataattttgtaaagtttgagatatgccatcggtatctcaatgacatgtaggacccacatgaattaatgacatgtgggtcaggatggcatatctcaaattttacaaaattataatggcacggttctaattttccatgtattgtataaacccttgccaatgccttgtaagttgtatcgccacgtttcccctctctctctctctctgaatctctcgcacacccgcaagccctcaaatcacgcacgccgcgcccgacagtagaggacagccggcgacccactacaaccacggacgagcggccagacggaaggccacctggccatcgtgagcagtccacccggatatcatcagaaaaatcagggggcggcagaaccgggagcactcccggagtcgtcaaggttttctctcgcggagttccatcccggccgtgctcccctcccccacccccctgcacgtgccgcgctcctcctgtcgtgtcgtcgtcgctccaccgcaaaaattctgtggctcctgagaggtacaatggtgccattgctcccctagtgctcgatgatatgcctttagggcgctttttttttgtggggggggaagggggggtaataatttgaggcaaaaattcagttcaccctagacaatcatgcggttgaatgagttttgatttccctacgaaacctatttgatgattgtggcaatttttaaggatgctaatttttcaatgaataattccatgtggcaaggcctgaattaagatggccatcatgtatttttggagctaatttcttaatattctgttgatttatctttgttcctttagttttttcatggattgccatcgg

SEQ ID NO: 64805 - DNA, 984 bp, Oryza sativa
aacgaattgccgcagtcctcccacaagtttgttttgaaaaaaaaaaatcgccaccaatccttccggtgataaatgtttgtattcatctatttgccacatgtcacctaacatgctcttgtttcagatttgttcctttcttacaaaaagaatcagtcagcaatgccaaaaggtttcaaaaagatgttggtaaacattccccctatctctaatttgcatgtcctatctgaatgaaactaatttatgcagcacaccagacctagccaaatattgttccactcaagtacagctaaaattactggtagtaaggtttgagcatccatgttgcatcatttttgcatctttgcaacattgctatttccttcagcagattcttaaatagcagcatatccttggacataatggagttcttaaaatgcctggttaatgcttgttgagctggctgaagcctgaaggtgcatattggtaaattaggacttgaggttgcatgataatgttcctagtagaagagcttgatgcatgacctttctatgataaacttggtgtgtgattagaagctagtccctagatcatctttttctttgtagcgaatatgcaagagatgttctaagtgcatcctacctaaaagtttgcagactttggccctgctatttgaagtttctgatggctgagaagaactaaataaaccaatgcctattgagtgttgacttaaacttcaagaacactgaggatggtgtctcggcagcaccagctcttaccagtcgaactagcaaccaaaaaaaactatcatgacttccgattggcgtcaagcttctggtcatcattagcatgcattatggcatcgtgattaattgcactctgagaaaaatggaaaaaaaatatcattttcagaaacaaaagccgagacaaattatttgtgttagggataagaaataattgcttacatgaatccctgagcatcaaaaagactcttcaaaatgtgagatt

SEQ ID NO: 64806 - DNA, 1177 bp, Oryza sativa
tctcctcatagggttggtggggtgaggtgggaaagagcgggcggcgacgggcggtgcggtggcgcggcgaaactggagaaggggtgacgtggcaatggcgagccgggagcagatggcgcccacagcggtagggccatggcaagtagagcgcaggcactgcggcggttggcgcatagtcgaataggaagccatgacattgatgatgctgccgccattgcgagagagagggtggcctcggcgagcagagcagtggcggcggagcagagcgccagcggcgacgggcgagcccgccacacggagcggagcatgcgcggtgaccgccatggtggtggggaaagttagcgctggtagcagcttctgggcgccacggcggcgtgagcttggtgagaggatgctacaacggatggagcatcgctgcgttgtcggctggctcctccgtcgccggtaccgcgttgatggcggggacgcggcggccgagcttgtcctcacggatagggtggaaggaccgaaggattggacgtggtggtggatgaggtagagagggtttggtaggctgtccttggttaccctcccacacgcgagcccccacatgtcagagctgccaaataggtgaaccttaacaaaatagtgacggaatggtgtggagagcgcagtaaagttcaacgatggcatagagggaggctcgaactttttagtggcacagagacaagcaccatctttcttaatggcatacaggtaaaaacctcctaaaatggactatggatgtagccttaattgagagacctaaaatggccgtagcctgtgttggccaagactcaaatcgtgcaggagcagaacagcccaaaaaagaatcaagaccatggcccagcttttttcgatggaccgccctgggcttcgaccgaaaaccaaaagatatttctgactcacaatacgtagtcatcatgtatgaagagtggaagacagacctcaaaaagcagtttagtaattctgtgtttaaaatgtcttttttatcacgtaaaaatatactgatcaaacacgtgaattaaacgatttgtcgatctgcaaattaaacgataaataaaaaaataacagagggagtgaaaactctcgggtaccagacataaccgacctcgcccttcactcgttaaatcccttggcaaatcatgctcatatccaa

SEQ ID NO: 64807 - DNA, 907 bp, Oryza sativa
acacatgtccgtcaaagaaaggcggaacaagtctccgctgtcataaccttttccaacaaaagtcccatatttagatacgacacatttattggactcaaacacaagtctaaaaccttctctatacaagattcttctttattgaagggacatgctgcacgttcttcagctgcacggtctttcccgaagtaaacttcagatcaaccgtaccaacaccatgaacagccgcaagcgacccgtttcccatcaacaaggaggaacctctcccgacctgataagaagaaaacagagaaatgtcagcacatacatgaatattagcaccagtgtccacccaccaatcaggtgaatgaaaaacagagagaactgtaggtaatattttaccgtaccccgatgttcctccgccctcgctaattaccatgttggcagacttcctgtctttgcgctcaggacagtccttggcccaatgcccagacttgccacacacaaagcagtctccctttgcctttcccttgcctttcttcttaaaattggttgcagccttgggtttgacatcaggcttgactttcttgttgttgtgggatgcatgagagttcttcttctgtaccatattggcactagaacctccctcaacctttttgccccggacgtcctttgccctcaccttctcctcaacacccaaagagccaatgagatcagaaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggcatcgaccatcttgtagtcatagaactgctcatgacataca

SEQ ID NO: 64808 - DNA, 12575 bp, Oryza sativa
aaacagagaacaataatcatgaagcagggaatagagaatttttcgaatgagattataatttgttggagcaaatttttaacaaaaatcctcatattttttatagggaatgatatgctgattctgtgggtgatactataggctaccgatcttcagcccagctcagtttgatgtactatgcatccacagctctaggaataagttcatctgaggtccttaacttatcaacgaatccaattttcatccttcaaccagaaaaccagatacaacaggtctctcaactatcaaaaccggtgcagaaaaggtccctcggcggttttatcaaaaccggtgcagaaaaggtccctcggcggttttgactgacgtggcgcttacgtggctagtttgactcggtcttcactacaccaatcagctattgcaagcttaatttgacaggatttagtaaatgttggatatgtagtgcaagagaagatctgctggagaaagggtttttaatccggttcgtaaccccctgtagtcctggttatgcaaccgggattacgaatacatctttagtctcggttgagataactaggactgaaaattcattttacaccaaccgagactaaatatggagccaagtccagttggtagttttttttcatcatttttaattttgaatattgatttcactacatccccaaactatccccaaatcgatcatcacaaaacaaaagggatcatctccaaatacatcacaaattctcaaaaaaattatatcacaaattcaaaaaaaacatcacatattcacatcacatacaaattaaatacatcacaaatccaaaaaaaacaaatcttccccagcccggccgccgctgcttctcccaccgcctccccagcccggccgtcaccgccgatgagcccgctgcgagagagagaggacagagagagacaacgagagaagaagtgaggtaggaaaatgcaattctgctctcgggcacatgtgtacccacactcctataccgtctgaccttgttgagattcgtgctgaagcttcatcatgactcagccgtgtgtggtgcgtagatatagcagataccacctttgaaagtcgagcagcccatgccgtatacacatggatcaacggtgcaacatggtggaatgccttcaatgcccttctctcatgcgttggaaacatccacattatttaatgcaccattggtctatggtttctttcagacttgctaatggatatgcggcgtagctcgtcctccatcttttgcgatttcgaggcatcaggggccaattttcaggtgcgcttgtgggaagccggctgcacggatcctatccgagacggtgaagaactacacggatcctaaaagttgtcagctgcatttcaagccaaacatgtacagtgcccatgaagatggtagcgaattaaatatagggtgtgtttagttcatgttaaaattaaaaatttagttaaaattaaaacgatgtgacgaaaagattaaaagtttgtgtataaaaaaattttaatgtgatgaaataattgaaaattcgaagaaaaattaagaagggcttatttgtgttggataggactgtattttttgacgcagacagcacatagcagagagtaaactgatttgactcattgcagcataggagtactggaaacagtcagacgtataattgcctttctggctatcattttgacgaagaccgattgggcacatagaattgttacatccactcagtccttggcgaccgcgtcatacggacgacagggcattgtccgtcgaatgcagcagatgcaagaactcatttttcgcgcatcttgacaccgccatcggcctatataagggcactattacactgtagaatatatatctattaactttataagttcatagaaaaaaggtccttcacattcactcctagggcaacaaaaatatatataacaaaagtagtccgtataaatctagatatatatatggactttaactattataaccttcacaatgtacttcctccgtttcacaatgtaagtcaatctagcattttccacattcaaattaatattaatgaatctaaatagatatatatgtgacggagcgtggggctcctcaccgggggaccgcgcaggcccccctttgccggttcggccgggggcgctaagtgaggttcttcaccctcaatctgtggaatgttcgcgagagaacaaatgcacaagacacgggcgatgtagacaggttcgggccgctgagaagcgtaataccctactcctgtgttttggtggatctgtgtgtgaagaagttacagagagccggagaacaagagagttcaggctctagaacccctcttcctctttctctcctctacgagttccggtattctcagtgtcgtctgagagtccccccttcttcggtgggcaaggtactccttttatatctcaaggggataccaaatgcaccacttctacctactcttcttttgggtggggacccaccctatcttgaccaaaacttggctcgcgcctttgcctggaagctaaatcacagcttgtccttgagtgaggcccagcgccgtcactcgcctgacacaggggataaccctgtcattccttcattaatgggtagagatttgcaatggccgctgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcacgccgcacgtctgcccttcttcatacaatgacttccttgccatggttgcgatgaagcctggaatgaatctggccgggactgacataccaactccaagagttagcacgccggctccggctagggacgagtgcctggaggctctcatcattccgacgggacggggcaaggcgtgtgacaggctgcctgttgccacctaacccgcgatctgaccggcctgtgaccggtcacacactgcgatcggtcacggaccggataagcacgcactgcgccgcattaaatgcggcgtgacgcgctcgtcaaaccgctataagtgcggttaggtgagcgccgctgtgctcacctaacccacacacgtggcgccaaaaccacagggggtcggggcgccccagccctcggggccgaagcgggagcggcccgacccctcggggagacagagggaggggtggccacgtcaccctcgggcccgacccccccgaggaggtcaggccacgtgggtgaccatagttacccaagcctctagtcactatacccccggccccatgttaccgacagtagcccccggcgttacgtcagggcgatcgcccccctcgagggaaacgctcggtcgtgacgccactccttaggcccggtgacaggtggggccggtccatacaggcgggcagaaacccagcggtcgcaaatcgcgcgcatcggcaagggaaaaccgactgacaataatgagcggcctcttcgagaccgctacattacttgagcagcgcgcgaatcgggacgagccggttcgtttcgcctggagacatgatgatggcgcttttctcggttggcgagcgtatttaacgagcgctcgatctgtcccatctcaaccgccacggccgcacatctgccgcgcgtgccgcaaacgggcgagtggggtcagtggaggcgcgggcgtgagaaacgagggggcgagatagtgggcgcgggaagcgaggagccgggcatagcgttggcaagggtataaagacgccgaggaagggattcgtttccttcctctcgccacacttccccttgccttcgccacttgtgctctaactcttcgtttcctgcgccctacccttgccgcactcgctcgttctcaagctcctcctccgccggcgtcatggcacggggctccgcaccgctcgacggtagcgtgctgccgccttcccgcatcgtgagcgagaggcagccgggctgccgcgccgattcatgccggaatctaccaccggccgggaggtggtcgcgctgggcgagggacgcccggcgccacactacccggggcggtccgtcttcttcctctccttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccgccgtcggtagtcggtggctgctacttccagccgcggggaccggtgctgaaccgctacattccctgcgtcctccgcaagaagtgggacgactggaagagcgactggttctacacccccctcgccgacgaagcgcgcctccgacttccgagccagcccccggcgcaggcctccagctggcgggcgacggtagatctgggagatggctacgacgccgttcttgaccgcctggcgggtctgcgatcccaggggctcacgggggccatggtgttcggcgactaccttcatcgccggatcgcgccgctccagcggcgcgcccggggcgcctgggagtacaccggatccgaggactacatgaggacccaccaggggcgcaaatgggactgggtccctgaagacttcaagatggtggtccaacgggtgctgaatctcagctccgtggaggcatccctcatcccccaaggagtcctccccctctgctgcgatccagagcgcgccaacatcctgaccatcatgcaggcggtcggggcgtcgggggagcgggccctccaaggccacgatggcgcgggcgggagccgcaggggggaacaatctaccccaggagggggtcgtgcttctgggccccacgacgggggcccggggggcagccgccctgccgacgcccgggggaagaggaagcaggagggtaccccttccccatctcctccccgagggggcggggcggtgcgtgccagcagcaggcgcccggagggtgccgtgccgacgccgcagcccgagggggagcggaagaagaaacggctccgcaagatgggggggaccgagccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcctgttgcgcccccccccccccgccattccaagtccggccggtctgaggccaaggagacggcgaccgcggaggcccggaggcgggaagctgatcggcgagaagccgcggaccgcctccgggaagccgaggaagctgcccaggaggccgtccgggttcgccaggctgaggaaaccgctcgggaggaggccagactccgccgggccgaggagtccgtccgggaggcggaggcagcgcacgcacgccaggcggcctgccaagcccccgacccgactccgcccgcggcgacgacgacttccgaggccacccacgatgaggccgcgggcgcaccgctcgggcccgacccctcgggcgacgctcgggacgagccagcttcgggggatgcccccgagtccggcacgtcgatcggcgggccgagccgcgtggcacccacaccgaggcggctctcccctctgccttccgctgccccactgagcgcggagcccctcctgcaagccttggccgccgcgaacaccacggtgctggacgggttaagtgcccagatggaggtcctgcaggcagagcgggcggagctcgacgcggcgtgggcgcgcgtcgaagaggggcggcgctcggtggaggccatggtggaggcgggccgcaaggcacaccgccggcacgcctcagagctcgaggcccgtcgtagggaccttgcggagatcgccagggaggtggaggaggagcgggagactgccctcatcgccaccgccgtgttcaacgaggcgcgggatgacctccgcctccaatacgggagccgggcggcggagctagaaaagaagctcgacgccgcccggggagtccttgacgccgcagctgcccgggaacagcgggcggcggagaacgaggcggcgtcccggcggcgcgaagaggcccttgagggtcgcgccacggcgctggaggagcgcgcccgcgccctggacgcgaaggagagggagctggcggacctcgaggccgccgtcgccacccgggaggcaacactggcggcgcacgaggccgcctgcgccgaagaggagtccacactccggagttcaccacgccccggggcacggctcggttctgggccccttttggcgattttagccggcccgggccaccgagggcaggatcgagcacgagcgtgctaattcaagccaagattcttcaaaaggaaacaatggcacatacacagtccttaggaaatcgaaaatgcttttattgaaatacggaagagaaaaaagataagtatatgcatgtggtagcccccggccaaccctgcacgcccggggggggtgcggggttggcccgagcccgagacctgacacccgacccctactaggggtagaagcgatgaaggtgttcgatgttccacgggttaggcagctctgtgccgtcgcccatggccagccgaacggagcccggccgggggacgccgatcactcgatacggaccctcccacattggtgagagcttgctcagtccagcacacgtttggacgcggcgtaggacgaggtcatcgacgcagagtgatcgggcccggacgtgacgctgatggtagcgccgcaggctctgctggtagcgcgccgctcggagggccgcgcgccgccttcgctcttccaagaagtcgaggtcgtctctttgaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaagggacccaggatatcgagcccccagacagcaaacggccacgaaagaggtatggtctgcagggcctgggccggctgatgggtttgcctggcgtggaactggcacgccctgcaccgccagaccaggtcgaccgcatcgttgagagccgttggccaatagaaaccctggcgaaaggctttgccaaccaaggtgcgtgaggcggagtgggctccgcactcgccttcatggatatcggcgagaagctcgacgccttgttcccgaggaatgcacttcaggaagactccgttagccacgcgccgatagagggtcccttccaccagcacgtagcgcttggagatgcgctggacgcgttcactcccttcgcggtcctcgggtagagtcttatctgcgaggtacgcatggatctcagcgatccaagcaaacaatctaagggagctgggagcgctcccctcgggtcccgaggcctggactccgacgggcctcgggggccgttcaggcgcgtccgtctcccctagggggtcgggtcgcgccgacggctgggcaaccctttcttcaaaggcgcccggtggggtctgggctcgcgaggaagcgagccttgagagttcatcggcgaccgcgttatcccgtctgggcacgtgccgaagctctatcccgtcgaaatggcactccatacgccgcacctggcgcacgtaagcgtccatctgcgggtcagagcaccggtactccttacagacctggttaacgactagctgggagtcgcctaacaccaggaggcggcggatccccagtccagctgccaccctgagtcctgcaaggagtccctcgtactccgccatattattggtcgcccgaaagtcgaggagaaccaggtatctgaggacgtctccgctcggtgaggtcaacgtgacccccgcaccggcgccctgaagagacagggagccgtcgaactgcatcacccagtaggcggtgtgaggcagctgcgaggggcccgagctggcctcggggacggagacggcctcaggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggctgagggggtaagacgtaaccaccgtgacccgatgcgcctggaaataatggcgcaacttcctcgaagccatcagaatagcgtaaaacatcttctgagcctgtgggtatcgggtcttggcatcccggagggcctcgctaacaaagtagatgggccgctgcacctttcggcgaggccgatcctcttcgccaggggccgcatctccagggcgctcttcgtccgagaggccgcgcggggcgccctcggcttctgcgccgataacctcggggtcagaggaagacaggcgcggccttcccgcagtggccccggggccatcctgggggtcgggggcgcctggcaccgtcggacaagcaggcggagggccagctctggccgtcgggggccttgggccaccgttcggctcgggggcctctcctccctgctctctcccgggtcgagtcgacacaaggtggggatgcgcggagtgagggttgtcctcgtcgcgctccacgaccaacgccgcgctgaccacttgcggggttgccgccaggtagagtagcaacggctcatctggctccggggcgaccaggactggggtagaactgaggtacgccttcaactgagtgaaggcccgctcagcctcctccgtccaggtaaacggcccggagcgtttgaggagcttaaataggggtagcgccgaacacgcacttgtcggggttcagctttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagtttttgcctcatcctccctagccatgcgaatctgatgataaccagagtatgcatctagaaaacacaaaaggtcgcaccccgcggtggagtcgacaatctgatctatgcgtggcagggggtaagagtccttaggacatgccttgttaaggtcggtgtagtcgatgcacatccgaagcttgccgttcgccttgggaacgacgaccgggttcgccagccactccggatggatgacctcacggatgaatccggcctctagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagatgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgcgactttgaggtcgccatggacggtgatggggccaccgaggctcggcatcttcatctggagataggcgtagtggaccgccgccatgaacttcaccaacgcgggcctcccaaggaccgcgttgtagggcagactgaggtccgccacatcgaagttcacccgctccgtgcggaagttggcggaaccaccgaaggtgaccgggaggtcgatatgacctagcggccaagtgtgccccggcgtcacaccgatgatcggttgggacagccggagcaccatccctggggccttgatggcgtcaaaggctgcgggggaaaggatgttgagggctgcacccccgtctatgaggacacgccccaacttcacattgcaaacggtgggggaaacaaccatcgcgatctgtcctccccgagcaatgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggctctgccctcacggcgctcctgcctcctctcctcctcccacttcctcgtccgctcagccaaacttttgaccgcgcggcagtccgcgaggtcgtggagggaggtgttatgcacggaacaccacttgccggtcgggcgctccctgctgggagcgccggcctccttctttttgtcgctcgcaggcctcccctttcgggtggcccgtgaagcgccctcgacggcgaggacgtgaccctcgtcgtcggaatgggccgacctcttcttcctcctcctgtcccgccgccctgaccgagcggcggacccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacggcccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatccttccaagagtggaccgacgcgggtggcaagttcattagccaaccccgcgcctgacctttcagggccatggggaagaaattcgccatgaccctgttgtcacccccggcggcctcgatcccggtcgtgtagatctggagaaactcggcggggttgacgcttccgtcgtatttttcggtgatggtgggccggaaccttgggggccaacggaggggctggcccccgtgcccggaccgaagtggcactccggacgaggaagcgccctccgttgcgtgggcagcacgacgaccattgcgccggcgctcgatgttgaggcgggcatccggccccccacgcacatcttcttgggtcggaggcgttgacgagggaatggcggacgaacggcgggtaacggccgccgctcgccgcgccctccgcctcgacgacacggagccggcggtagcagcgccagaggccttggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgctgccatcgccgtagacgaggaggcgacgctccccgtctcgccgtccttctccatcgcccgcgggcggcgaagtcgcggatctttcgaccccctcgagcgcctcctcccgcccaagacttcggcgagagggggacggtggagtactagctcgacggcgcgggttctgctccccgtcgtcaccgctagcgctcggagagaggttgtgcgccactgcctgttcagccattgggctgagcgggagaagcttggcgcacacgaaagaggacgagggcttagaaagacacacgcgccccctacctggcgcgccagatgacggcgcgtggggctcatcaccgggggaccgcgcaggcccccctttgccggttcggccgggggcgctaagtgaggttcttcaccctcgatctgtggaatgttcgcgagaaaacaaatgca

SEQ ID NO: 64809 - DNA, 7307 bp, Oryza sativa
cctaacccacacacgtggcgccaaaaccacagggggtcggggcgccccaaccctcgaggccgaagcgggagcggcccgacccctcggggagacagagggaggggtggccacgtcaccctcgggcccgacccccccgagggggtcaggccacgtgggtgaccataattacccaagcctctagtcactatacccccggccccatgttaccgacaatatgtctagattcattaacatcaatatgaatatgagacatgctagaatgacttacattatgaaacggagggagtatattgatagcaaatagtattaaaaggagaaataagaaatatagaaagcatcgactatagtccataacgcttatacaataaaacagaaggatctttaaaacagaaggcaatagtccatatacgaatagggtgtgtttagttcacactaaactttcccccaactcccaactttccatcacatcacatcacatccaaaactttcctacacacataaactcctaacttttttttttcaaactatcaactttccccaaacttctcctcaattttagaaactaaacacagctagtttaaaaaaaattagaattctgaattaaaaaattaataaaagaataaaagtagaggttagaggccttttaaaaatgcaaatttatgaatacgtaatatattttctgttgtgttgtggtccgtacaatttataaacatcctttttggaagaccgattcggcgcttagactcgtcacatccagtcaggccagatcggccgcgttaggggtaggtagcactggccctcggctagagatgcagcagctgcagaaactcttttcgcgccacgcctcaccaccgcactttcttttgcagtgaaggacttccaaacgatagacgacgaagcccttatgagcttttaatatcggatgcattgaccgcccaatgctatatactccctccgtttcaaaacaaagaaaaagtctaatttttaatatccaacgtttaatcgtccgtcttatatgaaaactttttatagagtaaattgtattggtggtatccaaacttattagctaggtacaatttagtacataaacttgtaaattggtcgttttgatacacgaacttatctaatccgtacgaactaggtccaaaatggcttggcaaggttatttccacctaacttacgttgattaggatgtggcgtgcatacgtatagttacataaaacatgctatatttataaatttgttctctgctttatcttaaatttcatatgtttctaacccttatatcattgctcggttttttatatctttctctacaatcactatatctcattctatctttttattgaacgtgtgtatgtctaagtagcaaccttctcatatatatgtttacgtatatgtttacggacggttcaacatcacatatggatttttatgactgcacttattttgaaacagagtaagtatgatactacagtgtagtgagctcttaagaaaaaaatgattttgcccggtcgaatgctctgcccgacacgctgacacgctgaatgcatggcattgtttcagttgcttttatgtcttgtgtcaccggagagctccgcgccaaatataccacgccgtgtcctatatatgagggtagggacgtcaaaacagccaggatgggtacgtaccttcatcccgtggtcacccatataaccaagtgatgtacaaatacacgtggatgcattgccactgcgtccgcagatagggtaggccaagcaggtacacgtgtcgccgcctcatctagggtacatgtgtgctcgcgtgcagattttccaactcatatatatatatatatatatatatatatatatatatatatataatctgacctaaaatttgattttcgatctcctacctacaaataagaagtgagaaaactccttccttcgaaagaaaacctaaatttaattccaaaaattaaaaatggatcattctattaaattaccaatagaaatttccattttgttccttcccacacacgtgggaacgaggagagaggcggggagcgtgcgattgcgagagaaagaggcgagatcgcactccctttatcaacagagccagaattcgggagatgggaactccaaattctgggtgagagagtaggaaatttgttggagctattttttttctgttaaaatctctcgaacatcagttttgggaatggattagagggactgttcgtgatactcttaggccacgtttaagaaggcctaaaatgaagattaagtagaagcacgccacaatgtgcgcctctccggccttcatccaactttgtaaatgaagtcgtggcccgttgatttcaattccccaatacagtactagacgttatactgtcgttaccaattttgcgggttaaccaccgccgatgctaatcgtccatttcacgctagtgttactttcatctcatgattatctctactttaacagcggagtcagacttccccactatcgtagtcagtactgaataaaagagcgctcccttaaaaaccaccccacccaaaaaaaccagcagcatttcaaagtgaaaatcaatccatagaaaaaccagatagaaaaaaaaaactgaatccaataaaaccttccgtcaatatttaccacaattctgttgcaacatacacgcatggtccaactaaaagttagtcgtgagatttacttcggtctaacgaaaagtctctcgagacgataccaaattatttttgattgttgaatctaacaatgttcatcctatctagctatagatacaacgattgaaaacgatttagtatcgtgagatattttccgttgaatcgaagcaaatctcaaaagttgcttatttctttttaagtagttgcccacttaattaattggttgctactcaccacacattctccgtgtttgacatggcaaactagcaatcagttcaacagtctgatcagattgtcccgcacggtccttcggcagcagcgcaagctagcgcacgaaactcataaacccctaacatttgtatcactactcccttcatcctacagagacttaatttgtttatcttcttcatttgtctaaaataaaagcactcccaggaggaagattatcccgttgttgactatgtgatggtatttcaagccgccaagtcgacaacggttagataagttatcccaaatattgtactggtgtgattatgatgaataagagcaacaccggctttcggccaacaggattagagctattacctgtcagatatgaggcccgaacctgtataaaaatctttgtctccatctcttttacttcaatctcacatataccctggtaccaacgatccccatactatagtcgtgacctgaaacgtcgacaacaatttaaaagtgttaactagggacaaatagtcccttatgcccttgtttatttgatcctattatactaaggaaaaagtacgaattacccccccccgaactatcgcggtcgtccgaatttcccccctgaaccacaaaccagatattcttcacccccaactatgcaaaccggacgaaaccccctcgacccaatccgcggtggtttggactacgtggcatacacgtggcagtccagtcagcattctatttattaaaaaatgtgggacccacatgtcattctctctctattctatctctcacacacactctctctctcctcccggcgacggcggaggcagcgagcgcggggaggcgaggcgagacggcggcggaggcggcgagcgcggggagacgagcgcggcggcggcgatgcgaggtgaggcggcggcagaggcagcgaacgcggggaggcgagcacggcgaacggcggcggcggccccccttctggcatgccgtcttccgtgacctgctcggcgacgacatcttcaactccgacggcgagacgtgggtcgcgcaacggaagacggcggcgctcgagttcaccacgacggcgactgcagcagcggctgcgggcgtggaccggatgctgtgctccggctgcgccgtccactgcttgctgctctcactagaacgggatcgcttatctgtgacgggctgaaagcatcatcactatcgggtaaggccaccgtcactgggcaaaggtcactgatgtgaggaaaaatctcaatcaggcaaaatcccgtcatggatggatgttatctcaatcgggccgaaaacaaagcccgtcacagatgagtatgaccagtcaaaccagcgtaataaggagcccgtcacggatgactaatctcaatcgggaacaccactaagcccgtcagggatgagtagtcatctccatcgggcatttagccagagcccgtcaccgataggtttgaccccacgtattgagtcagactagtcccagttcagacgacttatctctatcgggtgtattctaaaagcccgtcacggatgactaatctctaacgggcaggactctatagcccgtcacggatgagttatctctttcgggcattagctaaatgcccgtcagggatgagtttagaaaaaaaaaatttgtctttttggctagcctcaggcctttgctagccatgcccgctgcaaaaatgacagaagcatatatatacatagtcccattcccagcaaccccattcccagcatcaattcacatattccatcacagccatttcatatagacccattcccagcatcacatcagccaattcacattcatattccatcacagcacaaccaattcacaaaatcaaatacatatacattcacatccacaacccattcacatatatgtcattcacatccatttttctctccaaaccgccgacatgtatcaaaacctgcaaaaatatgttataaattggaacaattttatatgtaactagaaatgtaagtatatacagagacgagctacctaggattttactctaaagaatataattgtattacaaagaatatttacaaaaaccaaatgtttgtcgcatatgcattgtgaatgttctgccattacgagacgaaaaatatttcaataaaaacagccataatacttcaaccatcacaacccacatcaattcatccatcccattggaccaaaaatatcccaaaagttttgcaaagaaccaaaaacaagaacaagtgtagatggtctgttcttattgaaaaaacccaaaaatcacaagtgtatatggtctgttcttatgcattaaaaacccacatttatacctaaacaagaacaagagtgagaccggcccaaaaattcatccattttgcaaaacatcccatacttccactcccccccaaataaaatgaacaagtgtagatggtctgttcttattgaaaaaaccccaaaaatcacaagtgtatatggtctcttcttatgcattaaaaacccacatttaaacctaaacaagaacaagagtgaggccggcccaaaaatgcatccattttgcaaaacatcccatactgccactaccctccaaataaaatgaacaagtgtacatagaaaaacagccatagaaaaacagccataaaaaacataccaaaactcacatttcctccaaaataattcaaccatcacaacccacatcaattcatccatcccattggacccaaaatatcccaaaaatggtatgttcttgagcaatcatcactggccattcatccatcatagcccacaatatttcatcatcactgcccacatctaaacaattttcatcacatcccattctcccccaaattcacaaattcatccatcacagccatataaaaatttatcagtagctaacacatatagaaatgcacaagtcatcacagccatataaaaattcaccactaggtaacacatataaaaatgcacaagtcatcacagccatataaaaattcatcactagctaacacatataaaaatgcacaagtcatcactagctaacacaaaaattcatcactagcgcaagtcatcatacgtagacattagcatctaaacattgaatcaacgaataatcgcactatcacattatcgaatttaaacattatcatcgaatcatcaaatcatcacatctaacatgtacacagcaaatcatcacattatgcatcatcatcggtgaggagtacctaccttgcacggtggcgggctcggtgaggaggttgacgtgggctcaggaacggcggtcttgggcggcactgggctcggggacggcgtggagggaggcaccgggctcggggacagcagtcttgggtggcgcctggctcggggacggcgtggagggaggcggtggctgtcggggaggccggatcttgagcggccccggaggaggtagcggcgtggaggaggtcgacgcggcggctaggacaaggtcgacggccgctgggcgtagatatggagaggaggatgtgaggcggccgtggtcggtgaggccgaatcttcgagggaggaggaggcgacagcgttgaggacgaggaggcggcgacggtcggtgaaatggccgtggcgtcggtcttgaggactaggcggagaggaagccggcggtggcggtcttgggcatggaggacacggacttggagaggaggccggcggcggcggcggtcttgggcgcggaggaggcggtggatctgagagagtgagagtgtgggagagtgagaggcagcgtcggcggtggataaggacccgtggatgaggattgactaagtaaaccctagtcaatcctcatctctatcgggcagactactatgcctgatgcggatgacactcatccgtgacgggcgttagtactctgcccgatacggatgatacctatccgtgacgggcattagaactaagcccgatagagatggaataatctctatcgggcatagtactatagcccgtcacagatgacttattaaaatatttttaagttataaaaatcatttataattatcttctacccgatttaaaattgctattacatttgattatcacatataattaacaaatgtcttatttacatagtttaaaattcctattaattttttaaattcatataattgacaattgcctttctcacatatagtttaaaattcatattactttttttaaattcatataattaacaattggatatctcacatatagtttaaaataacaagtataattttttaaaaccacataattaacaaatccatttcttcaaagagttttaactggaatggcatgaaacatatgcaattcattcattaaggctccaatacaaattaaatacatcattcacagtgatatgccttccgaatggtctgaacgaacgtaagccacttcgtcttcgggatcatcgtcaaggtcgatctgaggtc

SEQ ID NO: 64810 - DNA, 1028 bp, Oryza sativa
cggcccggcagcgtacgtcggcgtcggcgtcgtcggcgttcgtcagcaaaagagagagagacagagagctacatcgagagagagaggacgggggctctcacccaagagacgcggcggcggcgtctgcggtggaggcggcgaggaccgccaggcgacggtgagagacaacggcggcgtcggcgcggggttgccctaggcagtggcggtgaaggagaagccgatgctcgatctcgatggaaaaacgtctaagtgttggtggaggagacgagggcgcaccgggaatatttatacccccggatctttactcccggttggtgagaagaaccgggagtaaagatatctttacttccggttcctaacaacaaccgggattaaagatattttcccgctatttctaaattcttttttaaacccggttagggttaagaaccgggactaaaattaatagcactgaatattgaatttcgttgcatatatgcttctaaaatagtaaataatgcattaaaaattctaattaacatatgtaaatcccacatgcatgatttaaaacttttaaaaattctaataatcatatataattagcatatgcatgatattaaattgttaaaaattgtaactaacatatgtaaatcccacatgcatgatttaaaacttttaaaaattctattaatcgtatataattagcatatgcatgatattaaattgttaaaaattgtaactaacatacgtaaatcccacgtgcatgatacatactttctgtttcatccatacagtgagtgcaagccttgtaccccttgttggactgcccggataggttgctaagtgtaggccaatcgttgatggttacgaacagcagcgctcatagattaaactcctcctgtttgtcctcgtcccacacggggacaccttccttcttccacaacagtttaagatcttcgaccagttgtcttagaaacacatcgatgtcgttaccaggttgcttggggccttgaataataatcggtatcattatgtacttcctcttcatg

SEQ ID NO: 64811 - DNA, 715 bp, Oryza sativa
cctttatgccgccgttgttgggcgtctacgtcttcaccgactggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgaccgccgctgactggtgtttccgcctgcacggctggcctattatgctgccgttgttgggcgtctacgtcttcactgactggccgcctcgtccgccgccgactggtgcttccgcctgcacggctggcctttatgtcgccgttgttgggcgtctacgtcttcaccgaccggccgcctcgactgccgccgactggtgtttccgcctgcacggctggcctttatgccgccgttgttgggcgtctacgtcttcaccgaccggccgcctcgactgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgactggccgcctcgtccgccgactgatgattccgcctgcacggctggcctttatgccg

SEQ ID NO: 64812 - DNA, 2078 bp, Oryza sativa
tgtttgagtatgaagttttgagtcttagttggaagtttcatattttgaatagaaaatcatgcaacaacaaaatacaagttaaaaacatgagcatccactaatacagaaaacatatgtgcaaggaagttcaaaacctatttacacatgcgtttttttaaccgtatgcaacttacggcccatagaaatcgaggatttacacatgcggattccacaacaaactaattttcacggaaggttgtggaatgaattaatatccagtttttcatttttgtggacgaataaaaactgaaataaatatttcatatttttaggcatctataaacacttgcaagtcgtgcgatattacgtgtgcgtgtggtatagaggattcgaacacttgacctcactctacatatatccttcttaccatctcacctatgacactcagtgattgtggggtgaatgttattcttttgacttctctaaaacttgtaacacagtctaagtgacatcaaatgaaaaagtcatcaactacaaatttgtgtagatctcatcgagctcaatactttggtaaagagaatctctatccaagctcactaaaaaactcaaacattcaaaaaaaatttcaaataatataaatgagagtttgtaacaaatatttaggctcataaatgatcttagatgaaaaaacatactcaattataaattgtagatctcgtcgacagctataatttcatataaagtttatcaccatccgactttatataaaatatctactccctaggttgttatatatccgacaaaaaatttaaaccctaaaaagttgttttatttaagaacggaggaatgtgattttttttaaattttattagtgctcatattttcacaaatggcagttttattaacagaaatgcccacaaaaatcaaactttacatgtttcccttatcagaactggccgtaaattcgccccttttttattggcagtttttcttaagaaaccgcccgcaaaaataggcctaatttggtaggcagttttcctaagaactcatctgtaaaaataaattttcgcaggtggtttatgacccttagttggccttgcttctatagtgagttttccttttgcaccacatgtgaaaaagcaagtcaagggcctacaaaaaacattttttatagtgcactgagtaggaagtttcgatgatctgagttgaaactgtaacatattgaatttttgagattttagattgagaattctaaaatcctattggaatatattaactcggatcagctcgcatttaggtgcgaaatgaagtgtctatttgtgcactaggatttcaggaaaaacaaaacgtgtggagcgggaagaataaagcacgtcaatgcggtcacccattagcttatctaaaagaataaaggttcgggggatacacactacacatagaattcagatgaattgcagtcacatgcatattcatttaccactacatgaaggttccactacaccaggatatattgcaaatggtatttcactgtcaatcaaacgccactagttcttccaagaaacgaaaatcaagcaccaaaattaccataaccttgtatacaagtcagtcaaacactactccaaaaagcaatatacacgattgtttttttccactccagagcacccaaacatggcagtggcaaattccatttggagattcagatgcatatggacggagatggccaatagcatatctccagtaacgtccgctcagtggtggccgtgaatcccctttgcagttcttttgaataaaacagttcaatgcaaatgggttgacacatatatgatcaaggtgagcactttctgtaacaaccaggtgagcaatacatttgacaattaaaaggatatttttatttatggcatactatgtcaaattttgttttatccctagaagaaaacgcttaatacacactcaaaatgaaagtagaacaaacaacaatattaccattgttgtttgcttctaagctcttgctcagttcaccggatgggtattattctcgccatttgcacctcaactcctcaagcttagaaagtaattttagatttgtgacaggtatgatc

SEQ ID NO: 64813 - DNA, 2504 bp, Oryza sativa
aacggatcaacccagccaatctccaacatgtcctcctccatgagagttgctctcctagccatgctacccatcctcctcgtggatgcccaatccatggctgcgccaattcagtgccttccaggccaggccgcggcgctgctccagctgaagcgctccttcgatgccaccgtcagcgactacttcgccgccttccggtcatgggtcgccggcacagactgctgccactgggacggcgtccgctgtggcggcgacgatggccgtgcgatcaccttcctcgacttgcgtggccatcaactgcaagctgacgttcttgacaccgcactgttcagcctgacctcgctggagtaccttgacatctcctccaacgatttcagtgcatccaagctcccagccaccggcttcgagctgctcgccgagctcacccaccttgacatctccgacgacaatttcgccggccaggtacccgccggtatcggccacctcacgaatctggtttaccttgatctttctaccagcttccttgatgaagagctagatgaagagaacagtgtattgtactacacctcatactcactttcgcagctctcagagccaagcttggacaccttgctggcaaacctcaccaacctgcaggaccttcgtctgggcatggtggacatgtccagcaatggagcacggtggtgcgacgccattgcccggttttccccaaagcttcagatcattagcatgccttattgctcactttctggtccgatttgtcggtccttctctgccttgaaatcacttgttgtgatagagctgcactacaattatttgtccggtccgattcccgaattcttggcccatctgtccaaccttagtggtcttcagctttcaaacaacaactttgaaggatggttccctccaatcgtcttccagcacaagaaattaagaggcattgatctcagtaagaattttgggatctctggaaatctgcctaatttttctgcagatagtaacttacagagtatatctgtgagcaacaccaacttctccggcacaatccaagttctatcatcaatctcaaatctctgaaggagttggcacttggagctagtggtttctccggagtactgccttcttccattggtaagctgaaatctttagatttactagaggtgtctgggttacagctattaggatccatcccatcatggatctcaaatctgacttctctcaatgttctcaagttcttccattgtggcttgtctggacccgtaccatcttccatagtgtacttaacaaaattgacagatttggcactgtacaattgtcacttttcaggagagatagctacactggtctcaaatttaactcaattagaaaccctcctgctccattcaaacaattttgtcggcaccgtggagctagcttcattctcgaaactgcaaaatatgtccgtccttaatctctcaaacaataaattagttgtgatcgatggagaaaatagttcttcggcagcatcctactccagtattagtttcttacgtctatcatcttgcagcatatctagcttccctaccatcttgaggcatctacctgagattactagtcttgacctttcatataaccagatcagaggtgcaatacctcaatgggtatggaagacctcaggctatttttccttgttgaacctatcacataataagtttacgagtactggatctgaccctttacttccacttaacattgaattcttcgacctcagtttcaacaaaattgaaggggtaatacctataccccaaaaaggaagtatcacgcttgattactccaataaccagttctcatctatgcctctcaatttctctacttacctgaaaaaaactattattttcaaagcctccaaaaataacctttctggaaacattccaccattgatctgtgacgggattaagagtttacaactcattgatctctctaacaactatttgactggcataataccatcatgtctgatggaggatgcaagtgcactacaggtactaagtctaaaagaaaataatcttaccggcgaattacctgataatatcaaggaaggctgtgcattaagtgcattagatttcagcggcaatttgattcaaggaaagttgccgagatctttggttgcttgcaggaatctggagatccttgacattggaaacaatcaaataagtgactctttcccatgttggatgagtaaacttcctcaacttcaagtcctggtcctcaaatctaacaggttcattgggcagatggatatttcttatactggagatgctaacaactgtcaatttacaaagttgcggattgcagacatagcctcaaacaacttcagtggcatgttgccagaagagtggtttaagatgctgaagtccatgatgaccagttctgataacggaacttcggtcatggaaagtcggtattaccatggacaaacctaccagtttactgctgcactcacatacaaaggcaatgacataacaatt

SEQ ID NO: 64814 - DNA, 3136 bp, Oryza sativa
  unsure (1)..(3136): unsure at all n locations
tctggtactatgctcatggtgtaacgctcaacccagtggatggctccttggtcttcagcgatcagatacgcgaggctgcgagtcgactaatggacgcagtggaagcctcttctcagggcacgttccgacccgacagagagaaggacgagctgtcactcgccctacagactcccgagcatccaggacgaacacgagggaaaggcgtgattccctggaagatgggattcaaggaggacatccacacgtataggagtcggatgaggagcaagagagataccgaggcgaagattgcagatcttgagtacagggtatcgagctacgagctcagcttgcaagaggaggtggcccggaaggtggatgaacgcatggcagcacatcgttcacacgatccccagccgtacatacatcctccaatggtcagcccatcaggcaatcgtagcagctgcgcctcaacggggcaggtagtatcacatagcatggacgccatgcaaacccaggacgaaaccacctgccccgttgatgagatcacgcatcggacaccatgtgagctgcatattccctttaagaacttattaatcaaggtatgctcgatgtaatatatgatttttggattcgtacgttccgcaagttgctgcttaggttgattactaatagataacctctcatcacgtgaaggtggcgtcgggaatggccatcccaacagacatttcagggacttaccactgcaggccgattccagcaagatactcgagggtcgaagttgagctggtgaaagccgtgtacgaggacctcgagttggactacccaggaggagacggtgagacgcatctacgagacacaagccacgccattatactatggcgcaagcggtacatcatcctccctgggcgacaagcggcgtctcgtgcaccatctcctccggctccgccgtctcctcctgcaccaactcctccggctcctccgccacctcctcctgcaccatctcctctggctcctctgccacctcctcctgcaccatctcctccgcctcctccgcctcctccgcctcctcctccaccgtgtccgcctgcacctcccaagacaaggtctcgccaagctccacctcctgccagcaaaagggcaacgaagaaggccaaagttgacaccaccaaaaacaaggagccgctgtacggttgcagtcaagaggagcttgacgcttatgtggcaggagaagtgaagaggcaactcaagcctcggagtcctgaaaagaagatacctattgacctgagcgtgaagaatttcttcaagggaatgtccaccgcaaacaaggaggccttaaagctatcggattgtgaccgaacacttaggaaagcctattacaagaagtccaaaccagttcctcagcttggagaacaaccacaccaagtggtcgagccgttggtgaccagcgaagactttggcataacggatttcatttcggacaccggtctaaccatggctcagttggttggagccgcaccaatcccgaaggcggaagtggcatacaagtttgaactcggtaaaccgcttgtcagacctgagcagctgcagtccctacgnnncaaatgtacaaattccatgaacggtacatggaaatgagcgccaatggtagagagatgttcggagcgaggatcagaaaccccgacttcttgcaaggagaagatgttctatggatccatttcaaggatgtcttcgatctgtaccatcgggacaccctcgacgtctctcttctaagcgcatggattttgtaagtatcttggagttcgatttgtttcgttcaataattagctcctggcatatatgtaagcaataataatttcctttcattgttgtagaatggagattcaaagggcccgacggcggggagtttacgatactgggttcatcgaccctcggaaaatcaacaccgaaatgctcgacaagtacgagaaagacacagaggacaatctcgtccatctcctaacgcagcagcatttcaaaacgttcatactattgccgtacaacacagagtaagtttttattgtcgttcgaacaaattttattcccatacatataacatgtacattctgatatttatctcatctcacgcatattctagattccactgggtcctgttctttttcaacttggacgcatacagagtcactgtgtacgactcaatcaataaggaggagaaggttttttacaaggtcttccaactgatagacaggtaatataatgccatctattccaaagtcgcgggactctgttgctattatgttgatctcgggtaatatttaattaatcatagcttgcaactgcccatgtagggcttgggatcggttccgtcaattggtccgcgggacttggaaagaaaaacttggacggaggtttcattttccagtgagtacatgcatgatctaaaattatattgaattgaatctctagttacagttaatataaagagtatattaaatctctcatcgtttctcatgtagtgtgcaaagcaggacaagggaactaatttatgcggctactacgtatgcgagtatgcccactgcctatcaaaccaaatatacaccacacgagagctcgatgtacgtatacttaaaccattcaaaatttcattgcgtatcgatttgttaagttgtttattaattttatatattgatatgtcattatttttcgaatgatagcgtattcacatgagggaaaaactcccacacaaggattttatcacggctgttcaagaacaactgatggggttcatcaacgaagaagtccttaatcccgatggtgaattctactacgacggatcgacaattcgtaacgtcggtccttcctcttctgacgtaacgcaggcatcgaagtcgtagctatagctagagagcaaatgaattgtactatacatgcatgtatatatatatatttatatatgtacgtatatttactttagtgttaatatatattttggtaacatatatgtacataaaatgttaagtgctttaaattataaatatatgtgtaatatatgtatttatacatatatacatacgcatatatatatatatatatatattatatatatatatatatgtattctatatacatgcataatatatatattacaatgcatata

SEQ ID NO: 64815 - DNA, 2725 bp, Oryza sativa
tatatatatatatatatatatatatatatatatatatatatatatatatatatatatatatatatatatatatatatatatatatataatcaaccatgcagcaaacatggcaatgcaaataaaaaaaatggtacatagatctttagtcccggttggtaacatggatcagccggccacgtggctgaccgatctttagtcccggttgtgttaccaactgggactaaagatcgatctttagtcccggttatttcacccgggactaaaaatcgctatttttagtcccggattcgtagtcccgattagacaaccgggactaaagaggggtgacgaaccgggactacaaacgatttctccaccagtgaatcatggcacagtagtacgcgatgggcatggatattggcctggattgcaggtcggatacggagtcggaagctgtccactttgaagcaacaccctcgcggcggaggccatcgccggcgcctccagcagcgctgccgccaagacgaacatcatcatgacgagcacctccgccagccgccggccgccggtggtcctgagcgccgccgccatcgccgatcctccgatgatctttgctatctaagctactaattaactgattttgagacagttgtttgggttaatcactgaatttttctgcacgtttaatttaactatgtctggttatataggacgagctgagcgtacctagctaggagagatgtagaaaaaacaccggtggtcatgcattggtttgaccggcagcgtagtagctagtatatagtagtatctagggtggtgtttggatctagggacttaactttagtctctgtctttagacactaatttagggtattaaatatagactacttacaaaactaattacataaatgaaaactaatttgcgagataaattttttaagcctaattaatgcacaattagagaatgtttactgtagcatcacataggctaatcatggattaattaggctcaatagattcgtctcgcgaattagtccaagattatggatggattttattaatattctacgtttaatatttataattagtatctaatctatacgggccctaggttatctgtctggaatttagttcagttttccaccagcacattaaattatgcatgactaactgatgactaattaactgaactgaaagagtacagtacaattaaacggtttgactatatatttctcgtcaaattttctctaaaaagatttgccagatacaaatccaatacaattatgatgtaatcacttttaaacttttatcgacgacatcacttgtacgtaacatttaaaaacactccaattttgcgtttgtttctccaacaagaattggatgaaattttggatactcgtggcacgttttttaaactattaaacggtgtgtttcgtacgaaaactttctatatgaaagttgctctaaaatatcatattaatccatttttcaagtttataataattaaaactcaattaatcatatattatagccacctcgtttgcgtgaaacatttaatatttatctccatcttcatcttcaggacattattcatacaccacctttgtgtgtaccatgtgtttttttttacccccaactagctattgtatatccagcttgtctgtctggagtttaatttagttttccaccagcacatgcaaattatgcaagactaactgatgagtaattaactaaactgaaagaatataatattgtgatcactatgcaatagtgtgtacctaacttatcaagacaagtcgatcggtcagtcccgatcatcttggaaatctattagtcctatataaagtttatgtggtcgtgtagaaaatatataggcttgaactaagagagaagaacaaacacaatgacttgaactgtgacaatcgcatgttttatttctatgccataatcagaggccattcggtaggaaagaaattaggagttgtttggttcatggatacactttgccacatcatacttttggtaatcacagtttgttatgtatgtgtctggttcgctattatagctgtggcttgccacacttttttaagtagcatgacccacatgtcataggcttatttttcttgtcaactttgtcacactttgtggttagaaattcatccaaaatacttttatggctgccacaacttgtctaatcttagttgtggtaatgtgtgaccggcaaccaaacacacaataaaagttgtgcacatagcacaaggagtgaggaaaaaaagataatatagaaaatttccttttgtacatatatagtatgatatatggaagagcaattaatacatagaaatataaaaaacattattgcctcattgcagcttccactggtcgtaggtcaggctgtagtacacgcagatcgaggtattacatatttgcatcgctctcaaacatcacatgcaaataaatattttatttgaaatatatcttaagttgtagagaagaaactctgtaggaacgataactatttcattatatgctgttggttgattaaaagtaaactaataaccaacggcgtacagcttataatcatggcacagtagtaggcggtgggcatgaatattggcctggattgcaggtcggatacggagtcggaagcagtccactttgaagcaacaccctcgcggcggaggccatcaccggcgcctcctgcagcgccgccgccatgacgaacagcatcaggacgagcagcgcc

SEQ ID NO: 64816 - DNA, 1261 bp, Oryza sativa
agctcaggattatacctgtatggtctcaggttgactggttgagccccttcaataagaggaatcttgtggtcacaatttctacgaggtggcaagttcttaggctctgcaagcacatcctgatagctttgaaggacttgctgaattttttcaggtatgggaaattcttcctcatgagtagtctcagctatcttcaccaagtacattatagctccagatttagccattcccaccagttgctctatagaaatgttagcataggtactactttgcttcttaatgccatggagcctaatcaactgattctgatattggaactcaacccatttttgaatccaatctatctgcataggactatgttgctgcagccaatccatgcctaaaattatatcataacttcccagaggaatcaacttgaaatcatttttgaagctatgaccttgcatacaccaattacagccaggcagaattttagagcaaatcaactgtcctccatctgctatttgtaccttcagggaatgctggaactcttccactccaatcattttcatgccaacttgctcatcaatgaaagaattagtactaccagactctgtcacatttgctgcttgttgagaaattgccatgactattaaatcctccttctgtgtcgcagtttcagcagacaatatttcttcagtgtcctcttgcagaatatccaggagctcatgtactacatgcaactgtacagaaggagagcatttgtgatcttttccccatctttctccacatgtaaagcataaccccgtagatcttctataagatttcaatgttgcaagtctgtcctcttttgtcttggcagattcagctccctttttctcctccccttgagtaacctagttgttccttgttggagtggtttgtaaattcacttggaaattcaccttgtgcataggtctcagataattggtacagtcactcctcctgaataccccgattttaaccccttccaacgcttcctcctgcaagagagccactaagctggcagtatccatgtcctatggtctatgaataatcactaccctcctcacttcatccttaagtccatcaataaatttctgaacaaaatacacttgaggaactgactgttcataagccaacagcagatgcattagggaatcgaacttctccacatactcagctactgtattagtttgtctaatgtggaaccattgcctcaccaaagcttcctgcctgtccctagtaaagcgagcacatactcttt

SEQ ID NO: 64817 - DNA, 2423 bp, Oryza sativa
gaactatctcacgatccgacaggatcggagccgccgccgtcgtcgtcgccaccaggttccagtcgatagattcgttttgaactcctactcgttagatatacaggttctccctctcaccaactctcttacataggcttaatcacacggcccagttacacaaccctctccgaagacatatatttagtgttagccttgcgcttgcgcttctccttctggaagacggcttccgccttcccaccttcgctctgttgttcacccagctcattgccgccatgctccttctcctccaggcgttccagcggtactctgacaccactcctccaagaaccccgccacacgtccaggatgcagatggagcagcgcgtggaagggcaccacagccgctaccgcgaacgaagggtgacggacagcgcgcgaatggagaccgccgccgctgcatacgaaggcagatgagtcacgggcggatgggcactgccaccgcttccacaggtcaagggtcacgcgcggacaagcgccgctgccatagacaaagggcgacaggacgtggcggcaaactgcaattggtggctcgcagctaccaccgccagctagtggaggaggttagttgggggaggcggaaggtggaggtggaatagggaggggattgcggacggagaggaggaggagaaagaaggagcgtcatgtgagacggagatgaggatgtgagtaggcacggatatggtttgctcggtcggctctcatagcggttttttatttttttttagagtaaagtgtacgggcggtctttaaaacttgtaggggtatgtcttttaggtccctaaattctcaaaatgcatatctaagtcccaggacttgtcatagtgtgtcatctaggtcccaaatcgttacaacccattcaggatcctacatggcgttgatgtggcatgctacacagacatgacgtggcatcattttgaatgacaaatggtacccatttaaaatttttcagttttcatttttcttctctttttttccctttcttctcctttatctgtgaccagagcagaagaaaggaaaaaaagaagaatgagaagaaaacgaaaaagaaaaaacaaaagaagaaaaaaaaagaaaagaacatgtcatgtccatgtggcgtcatgtaggatcctagaggagatgtgtcgatttgggacctagatgatacactttgataagttctgagacctagatatgcattttgatattttagtaacttgtatgacataaccctacaagtttatggaccgccaatgcactttacttttttttatataggttttggtttttatctagaacttgcactataatataagtataggtgtcgatttttatttagcggctactacaatttattaaaggttttggttttttaataaacggcacctaaagtattgtgctagtttttctctatcaccggtacctatagtagattgaaggtgtcggttctataattttccatcctgtggagatacagaaaggtctatatgtatcggttttaggatttatggcaccaatagagctgtttcttttgtgcgtttctatagtagtgagtggctgggcctagggaagtgtggtcgaagcacgcccaccctatgtgcgtctttcacgacatgctcttgccttcggtttcttcctctggtcttctagcggtgtctgttccggtcatctgcaacatactctcatggcctttttttatgacaaaacctatctgaaatcgtcccccaggataaagactttatcgaccctcgagggatcgacgtaaatatattcgctagctataaaaggactcgaaaacctgagttaagtcaggcaagaaggcaagcaaaatcaagaatttcacttcaaattccggtcctcaacatccggctgaagacctcaacatcctgctgctcatggtatttcactatcagtattgaaaatgaaagctaagaagtcatcgaaactcataactagagagggtcccttatgaagaaaaccaaacttgttcatttcaaaacagctcggaaacggacaaaaaccacctctaccatttcttttttcatacctttcttttggaaccggaatcggaattgaaaacctcggatacaaaaatagaatcgaatatgaaaacgaagcaaacacgaattggagcgaatacggtaatagatatttatcggaataggaaaaccctcaaactgaacttctcatatcaacgcagagatatacctcattatttttctaaaacaacaaatccacatttcttatttttatcaataatataaatagttgtgcacttcaaatagcttttaggagaacaagaactatattcatctatagttgagtatggcatgacctattaaaataataaaaaagtcactaggcaagagaaagatagatctaatgccccggattggaaaaaaaaa

SEQ ID NO: 64818 - DNA, 1568 bp, Oryza sativa
agcttgggcaccaattcgtgtatatcctatatctttcgattggcgctaatactctttattggtctatctggctttatcacaatgatattgctttcaaaaaagaagatactccattcgttttttaatatatgacaccattgactattttagatacgtttgaccatttatcttattaaaaaattagtaattattatttattttattataatttaatttatcatcagatgttctttaagcatgagttaatatattttttatatttgaataacaattttaaataatacgaatggtcaaacgtttgtcaaatagttaatagcgtcatatattaaacaacagagatattatttctaatctaatgcacgttacatattttaccaattgactccaaatctgtatgatgcatgcttttaaaataggagcgcactaggcctgaggcccgacaacccggcccaagcacggcatgggttgtgccggcacggcccgacctttgggttgtgcctgggcctcttcctcggcacgatgggccagcccggtccaatgatgaaggagtcaaatagatgagggagacaaaatggacttattccatccatataacacctggtccaaagatatgagggatgataaatagactttattagccatagtagagatggcccatagaaatgagggagccaaaatggactttttcctaggagccgcataatagactttcgtgccttcagactggcccggcacggttgagtcctattgggccattcctatgccatttggacgggcacgagccggacgattcatttggccatctataggtgtcaccggggtctcttttcgtattatgatttgcgtaataatagtaggctaatatggattagaattttattgtttctgttactctcagaattaccaaagcaactttttccttttcatatatttcagagatatatagcctgttttggagagctattagctgttgtagtttcgtttagaattagaagcttctttaaacaatccagcttttgatctaaattctgagaaactgtaattataaaatctagcaaataaactagaagtcagaagttagaaattaagcttttttagattcttataagctgactatcaatcagttgcttatcagaatcttaaactcgttatgctttttattttataacaatcggctatgtacacctaaatcattacccgatacagaggccaaaaaatataagacttttaattatctcaaaagtgctgaaggcctggcctgtcgaattcacttaattaactctgtgttccattcgacataaaactgggacaaaagtaatagaattttctgaccacagaaaccaagacagataaaattctactagatattaatcagtgaaacttaccagcggcccaaatgagtgactgcaaccaaattctgacaggcccgtaattaatttgcttttagaggaaaggccgggaggccttgctttgccaaaaaaaaaaatggtgatatctgtttgcaaaaatgagcaaagttcaggaatgtggcactggtggagaaatcgtttgtagtcccggttcgtaac

SEQ ID NO: 64819 - DNA, 748 bp, Oryza sativa
tgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgattatttgtgtacgatttttttttcatttcatgtagatggatcggcaatggatgtacgctgactggcgatccaaagagtttactgacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaagaggttgaaatggaagaagatgaagtggaagacgacaatattccagactttgctcagtacgctagatttgaaggaaatcaaacgggcgaggaggacatagatgctgattataacgacgttgcggatgatcttggtcagatgttgcaggatgccaaggaggactgcgaaagtgaaaaaggggcccataaattggacaagatgttagaggatcacagaacgtcgttgtacccag

SEQ ID NO: 64820 - DNA, 1180 bp, Oryza sativa
aacgaacgcgaacgaacgcgaacgaaacgttaaagaaacgtgaacgaaacatgaatgaacgtgagcgaacgcgaacgaacgtgactgaaacgtgaacgaacgtgagtgttagtgaatgaacgcgaacgtaggtgaacgaacgcgatcgaacgctcaacgaacgcgaacgaatgtgaacgaacgcgaacgaaacgttaaagaaacgtgaacgaacgcgaacgaaacgtgaacgaacgtgaacgaacgcgaacgaacgtgactgaaacgtgaacgaacgtgagtgttagtgaacgaacatgaatgaacgtgaaagaaacgcaaacgaacgtgattgaaacgttaacgaacgtgaatgcacttgacaagtgtgagaacgaacgcgagcgaaatgtgtacgaacgagataattaaactattgttgaacttagcatatatatatgattatatatacttgaaaacgtgaaatacattatatgttcctttgtatttagactaatacattttttttgcatgttgcagagaagacgtcgtcgtcgtcgtccctcaagccgaagtggtagctagccctcgaacgaattcgcacaggcaagtgatgtagagatgtgattattagagatataatataagattgttagatttctaatataagattattagattattagagttagcatatgtgagtgttagagattattagattattagacctagcatatttgagtgttagagatagttagacatttaatataagattattagaggtttaatatacgaaacttaattagacttagcatatgtgagtgttagagatttaatataagattattagagatgtagtattcgaaacatatttgattgttaaagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatctatgattatc

SEQ ID NO: 64821 - DNA, 828 bp, Oryza sativa
gacgcccaacacggcggcataaggccagccgtgcaggcggaaacaccagtcagcggcggtcgaggcggccggtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcagtcgaggcggccggtcggtgaagacgtagacgcccaacaacggcggcataaaggccagccgtgcaggcggaagcaccagtcggcggcagacgaggcggccggtcggtgaagacgtagacgcccaacaacggcggcataaaggccagccgtgcaggcggaagcaccagtcggcggcggacgaggcggccggtcggtgaagacgtagacgcccaacaacggcgacataaaggccagccgcgcaggcggaaacaccagtcggcggcagacgaggcggccggtcggtgaagacgtagacgcccaacaacggcgacataaaggccagccgtgcaggcagaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtaggcgcccaacaacggcggcataatgggccagccgtgcaggcgaggacaccagtcggcggcgacgaaggcaagccggtcggtgaagacgtagacgcccaacaacggcggcataaaggccagccgtg

SEQ ID NO: 64822 - DNA, 3749 bp, Oryza sativa
  unsure (1)..(3749): unsure at all n locations
gctaacgaagaagagaattcctgctaaggtgatgtggtatttccctataataccacggctaaggcgtttgttcaggaaaaaggggaatgctagaatgatgcgttggcacgctgaagaacgtcaacaggaccagatgctgagacaccccgcagatggttcgcagtggcgaaacatcgacagaaaatttaaagactttggaaaggacgcacgaaacatacggtttggtttaagtacggatggcatgaatccttttggagagatgagcaacggccatagcacttggcccgttacgatgtgtatctacaaccttcccccttggctatgcatgaagaggaagtacataatgataccgattattattcaaggccccaagcaacctggtaacgacatcgatgtgtttctaagacaactggtcaaagatcttaaactgttgtggaagaaggaaggtgtccccgtgtgggacgaggacaaacaggaggagtttaacctatgagcgctgctgttcgtaaccatcaacgattggcctacacttagcaacctatccgggcagtccaacaaggggtacaaggcttgcactcgctgtatggatgaaacagaaagtatgtatcttaagcactgtaggaaggttgtgtacataggtcatcgtcgattccttacagcaaaccactcggtacggaagaaaggcaagcactttgaacatacagcggaccaccgtacaaagcctaaacatcgcagcgggaaaacagtgtttgctatggttaaagatcttaaagtagtgtttggaaagggacctagcagccagcctatagagagcgaagatggtcacgcggcgatgtggaaaaaaaactccatattttgggagttaccctattgggaattcttggacgtacgccacgcaatcgacgtgatgcacctcactaagaacctttgcgtaaaccttcttggcttcctaagtgtatacggaaagtcgaaagatacactggaagcacgtaatgatctgaagcatatggaacaacacggcgaccttcacccggaaccaagggggnnagagccattacttgagtccagccaactacactcttagcaaggcagagaaggaaagtatgtttgaatgcttggagagcataaaggtaccgtctggatactccacgaatatcaagcgaataataagcacaaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcaccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccaatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgctacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttcttccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgattacaaggagggaacaatagtgaggagaaagtacgtgccgtaattatgctaattataattgactagaggatttttaaaagtttttaacatttaatttactagcattcctatgctaattataattgactagaggatttttaaaagttttaaatcacgcaagtggcaatttcatatgttaattagagtttttaacatttaatttactatcattcatatgctaattataattgactggagaattttaaaaagtattaaatttaatatattcttaaaactatcattcatatattagagtttttcacaatttaatttactatctttcatatgctacttatatatgactactcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattataagtcatatatttgcttattacgatttatccacttaatttcttacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccgggagtaaagattcgggggtatatatattcccggtgcgccctcgtcttcttcaccaacacttagacgttttcggccgatcgatctctctcggcctctctcctttgccgccactgcctagggcaaatccccgcaccgacgccgccgtatctcgccgtcgtctcgagctcgtcgtcctcgccgccgcctccgcctcctccgctgccgccgcatctctggggtgagagccgcagccgccagatctcccttcctgcatctcgatctctccgatctcgatctctctccgtcgcgccgcccgccacgagacgccgtgccacgacgacgacgcgccacgactacgacgcgccatgccgccgccttggccgccgcgcaacgccgccgccgcctgccaacgccacgcc

SEQ ID NO: 64823 - DNA, 2823 bp, Oryza sativa
gcatttatgcgttatacatctttttgtatcttggagaaaaaacggtgttgtcggagtagtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagtacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgctgagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaaaaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtgctatgctcacggtggaacgctcaacccagctgatggctcactggtcttgcgatcagatacgagaggctgcgcgacgactaacagatgcagtggaagcctcctctcaaggcacgttccgaccagacagagatagggacgagctgacactcgccctgcagactccagagcatccaggacgaacacgagggaaaggggtgattccttggaagattggtttcaaggaggacatccacacatacaggagtcggatgaggagcaagagagataccgaggcgaagattgcagacctagagttccgggtatcgagctacgagtcaacatgcaagaggaggtggcaaggaaggttgatgaacgcatggccgcacatcggtcccatgatccccagctgaccattcctcctgcaatggtgagcccgtcaggaaacagtagcagctgcgcctcaacggggcaggtaggatcacagagcatggacgccatgcaaacacaggacaaatcgcctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagtaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctctggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccaactccaccgcctgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccattaagctatcggactatgagcgaacgctgaagaaagcatcttctggaaagtcca

SEQ ID NO: 64824 - DNA, 1169 bp, Oryza sativa
  unsure (1)..(1169): unsure at all n locations
attttgaaggcgcacatcaacaagattttctgccagcattgttgaatatctagaaaaagtttgcacaaaacaacagagagtgagcatgcagcgatgaacttactaaaaagtaagatagttccaaaacaaaaccaactgataatagatggtagtacctttcagtctgtcctaagaggaaatcaagttgcttgtctagggccttttttttcctttcctcaagctccagttggttcttataaaaaacctgcatcaaacccaaatataaatagcataaggtttagtatattggaaaatgtggtgttctaaatatacactgagccacaatgaacttgccagcttctctattttggtccagaacttcttcacgtccttagaaatatttagggcaacttttctcaggcgaacttcttcctcctatgaaaatcgcagccaacattaagataaaacccatgaatactgatttgctatccacataatctacggtcattgagtatgtcgctcaatgtgctggttatatatttacttgcagttgaaagaacaaattaggggaaggaacactgcttggttctcaacttatcttcatcaaagttcaattcaatgtgctgttataaataatgtcttatgtactaatgaaatatatttcctagactgaccatagtttatgccaaaacatgcagtacttgtgaatttaacctattctaggctttatttgtcaacctgatcttattgatcaaagtctccaccaaatttaggtttagcaagcagttaagcaatcagttagctatggttcttcattctttattctcggcaggttaaagtcagatcatggtaataaataaagggtactcagttaaggtccctgtgtactgcagtgaggataaactaagatgcacatcactcagttcagcaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64825 - DNA, 6092 bp, Oryza sativa
  unsure (1)..(6092): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctttgccttgctgggaacccagcctcgcactaatttgtgataactcacccctcttgaccattgcattaggccatctttcccaccccaagttgctactggggtgggaacatgttgacacattcagttgtacagcgtgatggcaattttcggagatgtaaacctcttgtgataactcacccctcttgaccattgcattatgccatcgttctctccccaaattactactgggaacatcattcatatgttgacacattcagttctacagtgtgttggcaatttttggagtaaccttttcgtgatgtaatgtattcttttgtatggagctgcttgtaccaatccattcttcatgggttggtctttttcttcttctgataattctggaacgtgctctgctgattgtacgatgaccatggagatgcttactgtctttcttttccatttttctggaatgcaataaggtatccattggcctccctgattttactactggtgttgcatcatacttgaacatcacttgttgaaaacacattccaatcacgatgtatcaccgaaatttgttgcttgctgtttgatggaccctgtggtcggagttatctaccataccacaagtgcattcggtgtgataaaagaagttattcttttgttctcttaagaggctacagcccgagttgcagagtcccgttgcaattgaaccggacacgtaagcaactggattaaaagagagagagagagagagagcactggattagatgcaaaataaaaaccgagaaagtttaaaacagtagatgcaaataaaaaccaaaaagtagaaagtttaaaacagtagatgcaaagtaaaaaccgagaaagcttaaaatagtagatgcaagattaaaacagtagatgcaagataaaaaccaaaaagcagaaagtttaaaattgtagatgcaaaataaaaaccaaatagatgcaaaaataaaaaccgaaaaagtctaaataaaaacggaagcaaaaccaaaaaggataaagtttaaaacagtagatgcaaaataaaaaccaaatagatgcaaaaataaaaaccgaaaaagtttaaacaaaaacggaagcaaaaccaaaaaggataaagtttaaaacagtagatgcaaaacaaaaaccgagaaagattaaaacagtagatgcaagataaaaaccaaaaagcagaaagaaaaccgagaaagtttaaagaaaaacagctcaactaaattatcagagccaggtttcgatcctgggacctgtgggttatgggcccaccacgcttccgctgcgccactctgatgttgttggtatgattctttcacaaacttattagatgtcgaaaatattaatgggccttgaccaggacggcccaaaaactaagaaactactcatacagccacgcaggtagaataacaacgacaaataattctcagtattcagtaagacttaacacgatacactctgacagtctacaagttaatctcttggttgcagcatcaaacagcattctcgtacaagcctcgatcaagcttggtgtccacggcacaaaagaaaaaacgagaaggaaaaggcaaagcgaaacgaaacgtcggctccttttggccccaaaccttgcgtaacgtcgatcacctgtgtcacttgctgctaatattttttactttccagttgtcagaactcagaagaaaaaaaacttataaagaactcaaatttcctctttctgctttcgatcggattacgatatactatgcatgttcttggtgaacagcaagttgcagacaagtttgactccttttttgcctttagttagcgatggttttcacaaaatttagtccctctcacaaaattataagtccctccaacttataattttgtgagagggactaaagtttagctcaactatagcccctccaacccaacaccacctaactggcatggaccaaccacatgtaacaccgcaaggtatagtcaaccatggtcccttaattttccatgtcgatccaaacgtatgaaagctcttgtatgagctagctgtgatgtcatggaatggaagggaggtaggtcacatgagacatcacccggatttgtatctacccttctacggaacctgtactagctcaattcagatggagatttctgattacgactgtatttattttcaatttgagaaaggtaatatcacgtgtgattatgtgtttgctaatgagtgtaattttggttatgtacttatgtgtcaggttattgcctaagccgcgttggccgggtgcacctcagcaaattaatcaccatccatgaagctgttaccatgtcagcttaggataaaattctgtgcttatgggtcaagaatcggataatctaatggaaagacttctgggtttacactgaacctaacccggatttgattatcggaatgccatgtaaacacgttctgacgttcctgtctgtcaacgtttcaggttgattgagttagaataaccacgacgaagcagggtggatcattctgcagaatgaaagactactactattggattcggtttcagacacttttatagtcttcttccctcattggataggagaaaggagaaaggcgataaccagagcagtgatctttttgttcgagtatcatatggatcgttgattcttcttgtcaattctcatcatgacatcatagtcttgatgagatagaggaatcaaaaggcgacagagcaaagaaggcggcaaggcagcttgctcctcacgctcatcatggcaatatggcatcagggatgagcaaatgagaagagggacaaggcgatctcatgagtcatgactaggcatggtaggtgcagccgaacaagaagagctcatcagtttcagcaccaaatcactgcctgcttgcctgaatctgaatgcctgcacaagaactgcagccttaagattgggcatgcaccaggaatccacatggcatatgttgcaacttgcatgcagggattgtgctttacttgcattggctccatatcaaagtggtaaacagttccatcttcttgcagttttgctatccaagtgtaaagggtagaactgaactgttgaatgacagtggttcagccaggtcccgtgtaaatattggaaaagaacacttttgcagtggggtaatcaggtgatgctacttgctaacaccttccctagtcccacctcagatggttgcacataagaaatcacacaagagaacaaactttaaactgaagtacttggtccagaactaacaaaaaatttaccccctgaataacaggcagccaactgataatcaaatcaaatgacacttcaggagtttctggattaggctagaaaatacaatatagtatagctagtaatcaagtgacatgttcagttccaaatttgtgttttttccattgatattttaggccaacaggcagccagggtgcatgatctctgcttgcttttttcaaagcctgtctccatggagtatatctcattatctctgactatttattactactaccagcgagcggctagttttgctgccatcgatagcaacaattttttaccgttaatagctcctataaaacaattggctactctcgatcatgcaacaaatgaaggtgtttcgtatcacctctatcctcaatccctaggacactttgcaagcaacatgagaagaaattaaagaaacaccaagtctcctagcccatgtatatatttttaagtacctatataggagaagaacctgcagctacaatattcctgaactcctcccggttccattgccccatggcattgatggattaaactagaccaagtcacaattaatctattcttgtttgttcttgtgcttgagacaaatagctgtgatttgatggctgctactagtcattgcttactttggacggccggtctccacgggattggtaggagaaagaacaaggctgtagtgtgtctcaaggcatctcagcttctcaagaaccgtaacttatgtaattaacctgcatatagatccaccctaaaccccagggatctgagacaaagtagacttgatttttctgcacaaatggcaaggttggtggtacaaaagtgatagagacgaaacacggtccctgggacacacatcacatgcgtataaatttactttcagtagacctaagctgacccaacgtactactctaaaaaccaaataataatgtgcgtgtaacatcagagagagctagttacatgtgtagtgtttctttaattatgttgcatcattaggtcacagtacgtccttcaaaaacacatatttagaccgcggaacaagcgggttggtagtgccgccacgactcgtgcaagcaacgatgaaacagcgggccggagatatggaagcagccatgcatgcataagcatcagcatggaccagaccgatgcaaactgggaaagcggctggtggtgtggggtgagagttctggtgcatgactctacctagaatttaaatcatgttgagtaattatgaataattatgcatattacagtttaataaaattttggtgagatcatcgcatgcatgtctttaagtgtatatatattaggagagacactacccttaaaaaaagtcttagttaagagcatcgcaaacaatatggctatctcattcccaagctaaaatttaacaattatgaaaaaaaaaatgaactctaacagccttgtcaaccgaatggcttggccaaacttacaccacttctctcctccagccgagctaaaggcccagctaggcacacgtcccaaccgagccgagccggcctagccaacccatggccaagccgcctcattcctccttcttgtgggcggctagccaaaactgatttaccaatcgtggaccccatgcccgccaattttgtttcaattccctccttctctctttgtccccacacactctccgtcactgcacccagattgagtacatgttgcgatcatcattgtcgtcgttagggtcaccattcgctctggccacaccatcgtcgccttcatcgtctagagttccgccattcactgcggacgtctccgttgtcgtctcgagtccctccgctgtgaccgccatccattgttgcacgccatcgccgttgtctggagggtcgtctcctgttctcgacgccgatttccaccaccagtgctacccaaaaagggggagagaaagaggagatgcatgatctcgtcagtggcactgtaggggagcacacaacgttggggttgatgggaggagtcagggaagtttgggaggcggagcgtggttgcccacattgaggtgtgtcaccagccctttccaccggccactagcagtagtgcacttggcccgatctattgtctgcttgcccgccccttattgattcccgccacccacaacaccacggcgcttcatctcgcctcggccacctcgttgccgtcggccacgccgcatgctgttatgtcgaggggagtggaaagatgagggagaaagaagtaaacagagagtgacatgtaggacccaatatcatattggagagtgtaataggcatattgttggagtgaaagatagatttggctctctaattttttgacaagctggccaaatagtgtaatctttaatgtggatagaagactagctattgcctctgatgcagatcaagcaagaaatatcggtgataaaggggtaaatatgtggtggaaactcaatttaggtgaaaatttgtgtaaacactaataaaaaagtagtctaaatccattcaaaataatcacataaatggatgagatgatgtaacacaattatgtaaaattcgtgtccgaacttaactttgtgtctgagatatattactacttttatatctcacaaatgaagtcaagtttggacaaaattatttacgtcattgtaacatcaccttattatctatatg

SEQ ID NO: 64826 - DNA, 8116 bp, Oryza sativa
caccacaccacaccacactactctcctgatgactcctcgtgacctcctcggccctgaatgcgatggtcgtctcgcttgtacttactccgtcccaaaataaatacagccatagatattcatgtttagcgttttgaccatccgtctcattcaaaaaaaattttaaaaaataatcacacataaaatactattcatgttttatcatataataataataaaaatattaatcatattatttttttaaataagataaacggttaaacattagatgtgaacagtgctaaaactgcacttattttaggacggagagagtagctagctctgcgcgcgcgtccggtgctccttgattcgcacaacgccatgaggacccaacccgatcggatttgccgttcttgacattgtggcgtaatattgtgcttcgttttgctgtaaaagctagctgtcgggagattgggtcgaatgacgtccgtgcaggcggcgagccggttaatgccagggcgccgttaaatcctcgtggccccgtgcgtgcagtgtgaccgtgccagtacatgcagccgttgcaccaacttccactgttactactagctaaggagtagtagagagtactgtagtaaaggttttctgcgagaattcgttgacaaattaaattccatcatcaacttctacatgaagcacgcactgtacatagcggtggaactagtggagtgcatgtacgagagacatcatgggcaactaatctcgcgcgctaaaacattttgtatagatcggatggttgttaatgcgagtgacacatgtgattgctcaaccagacatgcaaattaaatccactgttccaatcacaaatcatcaatacagaacacagtgaaatccgccgacacgctccgctcgatccgagctcgatatggtcgatcaacaacacatctgcgttgcattcatccatgtttgcatcgtcttcttcttttttgttttttgaaagattattcatgcatccatgcttgctcgttcccggaatcatggcatcgtcgtgcatgtgagccagttaatcaacctgctggtgtgacgaagctcgaatccacatttgctcctgaagggcaaagtatagtgatagacgtacgtgaggcttgcttgctcgtatatgctataataaatttattattaatggtcagcgtggtacctgtaattattgtcagctgcacgatactcctacccccaacgccaacgacctctctatgcatgtgcaaggggaatttgcgagtgagtttactaatccaaagtcaaaattcctcatgtctccaaatcatcattccttaattaacaacgcaatccgatcatttcgtgtataatgagacgaaaaaaaaaattcccgtattagattaaggccttatctagttggggaaaaattttagatttggttgtcacatcggatatacggacacacatttaaagtattaaacgtaatctaataacaaaacaaattacagattccgccagaaaaccgcgagacgaatttattaagcctaattaatccatcattagcaaatgtttactgtagcaccacattgtcaaatcatggcacaattatgtttaaaagattcattttgcaatttatacacaaactatttagttgatttttttccacatttaatactccatgcgtgtgtcaaacattcgatgtgatgggtaaaaagtttatgttatgggaactaaacaagacctaaattcccccgaaattcttgtgttacgaaaggaggctctgaactccgattcatgcaccatccaaagctgtggctaatcaaccgttcaacaaattaaatccaacagttcttaaaaaaaatccgacatgagacattttaagtggagtgtagttttggagtttttttttctcccattggatacaccataaagtgtagtggatcaaggggccgacatggttgatgcgtgtctgatgaagttcataaattctcggagatgagatattgaaggcgcgtacagcatgcgtacaggaagcccattacgctggccacggtacctttgctctctctgacaacgatccacgccgttttatctagttggtaagaatacccaatgcatggattaaaatgaaagcaactttcaatgatctgtataaatttccatggacactatggccttggcatgcatgcgtgtagaaacagaggtacatacacgtacatgtatatatgtaccaatgatttttaatgtgtgtccatgtattcatgtctagctgaattgaatgggctctcaacgaattctctgtcggtgcggttactgtacagttcgatcattcgatatgttttcagaaagctctgcagtaaattaaatcaacctcgtgatttttttttttgttgatgtgacgctcatgttagcttgagcttcatccggaagaactatgaggctggctctcttttagagttgaaagctactacttgagcaagccccacagattgttcgaccaacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacagatggtaacctgacggctacattgcacggtgacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtttagcagttaaaaaaagtgttaataaaaattgagatgtactccaatttgtatgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctgatcgcgtcgctgccgctgttcaccatggcgtcggcgctggcggcgctgcccaagagctcccccgactgcgccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatagaactagccccctgtaattacaggacctcacgaggttttttttgtcaatttccttccacattttttttactaggactattttgtaaagagaaaaaaaattccagccccagatgagcttaacgtctctgaactctgaaccttccatcgatttggacaacatcgtcgccattctctcttcccattctcctcctgtcctcgcatcaatcctcgcaaattttggcggtattcaagctcagattgtaaccactggagactggtcattcgttcgttttctggagaggcaattttctggagggggaaaccgggcgaatcgcacacggcaggatgccacgccgtgctgtttgctcctttttccttgtggtttatagctgatctggtcgcggctactctgaagcctggtggtgcgcctgcagcctgtgcagatgtgtggattctgaatcacttgtgttgggtggaatggatccatggccgtggcttagtgccctagtgcgtcgtaggcttgcagtcaaaaacgtgtccaatcccctgcgaactgaggacacaccacttcaggtttgttcgttgtggtgatcctttcttgtgcccagttgaagagtgtaacaaaaaaaaagtttaggacattactgagagaatggattagtgatcctagttggatctagtatgtagacagttttagtttttttttccctttgtttgttgctaccgtagcatgctcctggcttgtctctgtcatggagtcgaggatcttgctaagttgggtagcctgcccggtggtccttgttatcattggatatggttggtgggctggaggcttggtgcaatggtgccaaattgccaatccctcctagtagcatatactgaattcagatttttttctttcccggggaatatgaattcaggttttatcatgtatactccctcacttcctaaatacaactattttttggtacgcggatttcagtgcacgggaatcaaaacattttcaaccaaacaagtgacgagaatcaagcgatttaaaattcgaaattcgatcaacaaaatgactgaaaagaaatcttccctcctatctttaatctctgctatacagtgtaaaaagtgcttatacttaggaattaagggagtatgtgagtctctgagatctccgatctcgttagcgttggtggctcctcggatgtggacctggtgaccaatcatcggattaagtacttgcatcgcgatacctgaacaaatgccaaaaccaattcgatcgtctcgccatgctctcggcttcttctcgcacagccagactgatcgtgttagctcgtcgccaccagcccactaccatcattttctagcctgctactactaacgctaaatctgctactaccactgctaatctgctgctactgctgctgctaccaccaaacacaaccgactggtggtgactgccacccaaggaagaggcaccgtcgcgtagcattgaattggattgacgggtttgagcagtgatcgcagcgttgctgtgccgtcgtcggttttaaccacgcaggcaggggcggcgaccagctgcacccaaccgcgcacttcaccttgaatgctctcatttactccgccttcctaccgaaatcgtccgctcgccgctcgtctcgtgcccttcggttcgtagggaagagtcgcctcccctcgcgtggtgccgtgccgtgcagtgaaaaaaaaaactctctcatcttttcgcttatacttatatctattatattattaaaggaatagaaaaaggagcctccacgttcgctctcatggcctagaaattctcacattaatcggagaaaaagaaaaggcagagtccatatagaaatacaatttagaaatagctaaaattcgaaattaaaaaataaggaatattagaagaggagagtagagtccatatagaaatacaatttagaaatagttgaaattcggaattaaaaaataaggtatattagaagaggagattagagtccatatagaaatacaattaggaaataattaaaattaggaattaaatgtaaggaatattagaagtagagtataaagtctatatagaaatacaattaagaaataactgaaattcggaattaaaaataaggaatattagaagtagagtatagagtccatatagaaatacaattaggaaataactgaaattcggaattaaaaataaggaatattagaagtagagtatagagtccatatagaaatacaattaagaataaaatagaaattcggaattaaaaaataaggaatattagaagtagagtgtagagtccatataggaatttaaaactaactaaaatttggaataaacataataaaattaaaagtagagtttagagtccgtataaaaatacaatttacaaataacaaaaattcgaaattaagaaaaacatgggaagaagagtttaaagtcaatataggaatacaatttagaagtaactgaaattcaaaattaaaaattaaagaatattgaaagatgagtttagagtacacatagaaatacaattagaaataataaaaaattataaataaaaagtaaataatattataagaagagcatagagtctatatagatatacaatttacagaaaattcggaattaaaaaaaataaatattaaaagacgagtctagagtccatataggaatatatatgatttacaaataactaaaatttgatattaaaaataattaataactaacacgtatataaaatacaatatgaatattacatattagtagttttgtaaagttgttgcaaaatttaaaactatgttgtcattttaatatatttgaataacataatgagagaacatatatgttattatatgagagaaaatataatgatgctagccgcgcaatctgcgcgggccaccgtgctagtttatatttatatcaactaaaatttaaatttttgatcttaaatttaaagttaattttaaaatttttttcatcatagtttatttttcaacttacttttacaaatgtataaaagttttagtcatgaattattttttatttatagatatatcgtttctttttttttctcaaatcagccaaaacgatgggcctggcggatcgatcggcagatggtgcgtgccgcgtgcgtaccaatgtgtcgtctctcgttgccatgtcgagttgtggtagcgcctgcgtatcggtggcgccgagtatttatggcacgttgaagtgagccggtttgaccgtacgcccatcaccggtgtgtgtacgcttgcacgctggacacttttgcattgcacgggaagcagggctttctctccacgtccacggaccgcctgcctccctgcagccactgagacacgtagttgcagcaacagcagcgaggtcggactcggacgctacggctgagcgggaccaagcgtgcagaggcattgaatcatccatgaccagcttggaaggaaaaccaaggccc

SEQ ID NO: 64827 - DNA, 3805 bp, Oryza sativa
gccgggagagaaaaactgcttgaatgggatcgttttgtccagcgcatgattgttcctctcccggaacttacgaagggactgggattctgaatcaagctactgtgactagggatgaaaacggagcggatagtttccgtcggctccggacaaaaacggatacggatacctttcggatcggataattcttggatagttcggatacgaatacgaatgttttctcccggatatgaatacgaatatggtaccaggtttccgtcggatacggataataattcggatatccgcaggacccatgagacataccccatatctttctaactctataaccttcaatatacctttataaaatatacctttatagattttaatagtagtttatctcttaacactagtccatactattaatattatttaaattttaaaaaatatttataaattataccttattttatataaaatgagctaattatatatgttgatatttgtttctattagaagttgagttggttttcgtgttccgagaaaaaattgtttccgtatttgtgtccgatcatattcgattcttattcgtattcgagataatctgtatttgtttccgtattcgagctatccgtattcgttttcgtatccggtaaaaaatatgaaaacgaatatggtatgagcattatccgtccgtatccactccgttttcatccctaactgtgacaaaacagttgctaacttggtattaaagtcgataaacgccgaaacgacgacgaagacgatgaccatatgcaccagtcttcttccacttgcagatgaaagtggatcactggaagcggaagcgtgagtgacactgacaccatggacgacggccattagcagccgagttagtttggccaccaacttctctcgtctcgctagagcaatcttttacactttaataagcgtcctagcatctcaaacggacgtaagtaaaatacgagccgtgtaacaacgcaaggactgacataacacaagcatggcttttcgcaactaacagaaactgcttggagaggatggcacttgggcagccaacaagcttgctagcagctagcccaattccgtatataagtgaagcgttggtggttagcgatatcgcttatgctgactaaaacagtacctgcagcaactacacagattttgttggtgtgaccatgaatgaagctcagtacacttattattagcacggtagtggtatcgatggacctgggacccccgaggccccaataatgaatatatctctgtaaaggaattaaagggtaaaaagccctgcagagcagacaaatgttagtaataaatatataaactgcaacatctgaataactgagaccttggatttaccaggatgggaaaaaagaacgaaccaaagtacttgtactatttcatttagcaaccgaaaacaaaggtaccagtccatgccatgttaatttgtcttgacctgacaaactgatggtacaaatgtaatgtaccaatcaccaatctcaccacgccagatcaaaagggcacagttcgagggggaaacctggtgtctttctagtagtctactgggttacatgatttgtggtccatattttacaaacacgggcggtacaaataacaatcgtaacaatacatatactacaaaaataataaactacatatactccaaactctgcccaaaaaaacacgcttgtatccgggagaacaagcaaaaacactaaagcgtcagagttgttgaacttagagagaatgaaatcaagctgtaacaagtaatcttagcttcctgtcatgctttatcattgaacttacactctctacaaccaacacggtctgcaaaaaagtggcaaaaacaatttagattcaagtttagaaaggaaaatgcatagtaggacttaggataaacgttttatcatcttacgataacattcagcactaatcattctagagaagttgtaaaacgcaagagtgcttagctaagtactggccatggcaagcatagcacaacaaataatgcggaacatattggttacctgaaggcaagtgtaagccaaaccagtggcaaagtagaaatttgcattgccagtcccctgaaattattgtcatgttagtatcagtggcacacaatactaagagaggggaaggatgggagagggagataccctccagatccacaggttgtgcatgacagggctaaggagagagactccgatatatccaaaaaacaagaagaaagtgaattgcatctctacaaaatgtaaagagaaaccattagtgttgtagtgtaaaactaaaccattagttttctagaggactaggagtcattcaaaatatgttaaaagaaatgttaagcacctgctaattcattagcaaataggcccaaaagaccaagataaagagctgaatctccgaccttcaagataaatcataatatggtatcaatgaacttgtgggaaaaaaatcaggacaacacaacaaaaacagtttgatgaaattttacacaaccgagggactaaatttataggtattatcatgtaatgtgtacttaccgatggatacgatttcaatattgcgacaattgctgtgtaaatgaaggcaaggaagcatggacgatgcttcagacggattgccaatggtaataccataaaaacaatgttcatattgaagactataaggaagaagcttctgaaaaagtcaaagacttcagcaaagaagtacctgcacaacccctttaatgagacaaatggaatatcattgagttagttacataatttgatcaaaactcaccataatacaccaatatttggcgataggtccttaacggtaaggataaaaccatatgtcctgcagaaacacagcacaagtcaataggtaatggcaaataaaaccaattgatttcaaatgaaaagaactaagtatgaactaaggcacaacaaagttgacatgttggagtggatagagcaacatggtgttactagcataagatcaaacatgctaataccagaaacagtactccttaagaaaatctgtcctcgttcctcctttcaaaacttatctttagtgagggaaagtaacataaactagcacagtccccccatctcactcaaacacaaattttcatgagtaccaaagaagcatatatattctactaacaaagagttgagtatcttacttttcaaacatctcctgaagaccacccactttatttagaactatgctgctcaatagcaacacataaaatgtccagaaaagcatccacaatatgaagtggaaaactggtttccacaagaattgttgaacatctcttgagctagaacttttatcattgtctgatacgtcagttttactggcacttgagctttttatacgaaatacttttgttggaggagcatctggaccatatcccaataaaagaatgatctggaaaaagaactttgttctcaatagctgactatacaggtaatggaaggcattatcaaatagatgaatataagagtacaaacaaagcttgtgacacaaaccggtacaatgagaattgcaggataaagagagagatgtgtagccataacatatccaaaggcagcaagaggagcaagacctaaaaattagagacattccaagttttaaacagcatgagaacttgttagacttctatgtcactcaaaagatagatactgtcttcatgaaattgttgctactgatgctttgccaaatgaaggccctttttacataacaaaaatgattctactgaaaatttaaaaatagcagaacatgttgaagagaaacacgaatttgagtgcacttacgt

SEQ ID NO: 64828 - DNA, 36837 bp, Oryza sativa
agcaatatctcctgcacttacgttaactgcaggaacagtatcaataagaacaataagtagctgcataacaaacattaagtaatcacaagatgaaagcatcagactatcattagtaaatgaagaatcactaattttgattcaagtataacgtttcaattttacaccttataagttgctagaatcacagtcatctttaaaaaaaaatcattccgaaatgatgtattaatctgaaaataagttgtttcatagcaattccgtgcatctctattatgaaagactagattggctctacaataaagaatgacaattcaatgagtcaatgaaatatttgaagctttgataatataattctgcaagaagctctgtatgctactccattggtaaaaacaagtagataactagtgtcaacaaactaagaacaactaggtcagtatccaataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatcatgatgtccaacagacctgtaataccatgaaatacaaggatgtgagtatttcaaacattgatctgatattgtgataaaataaaccaatcctgtcaaagcatatagctgcagtagtgcaaccaattgcgatcagagaagcatcatagacaaggaattgatcaccttttgttagtcaatggaccaagaaccaatagaagcaaaggggaaccatgatacattgaacctgaaagacaaaacattcaccgtgctgaataatcacttccagttcatgctacaagaaaaacacattgcaaagagaccctactaaaacatcatggataaacctataacaatgacaaatacctgcacaattatttgctaagtaaaaggtatggcaattttgcgcttattttttttaacacaccccattagtgcgggcttgcagcagttcatgcttaatggagcttactagaagaagtagcacccaatcaatttactttacttttaaaagtgctctcatgtagctagtaattccatccctatactgagctcaacaattcacgacttcagttgtcccccccaaaaaaaagtaatcaagcaagattaagatgtgtggaacgaaccggagtagggcgacatggaagcctgcttcagccagtacccttccgccactgcaaaacacacaggaaaacaagctattagtccaattacggcgacaacacagcacagctcaagtctgggacgaggaggcaggggagcaagggagcgcttacggcggcggatggaggtgaggggggtggagacctcggggcgggaggcgaggtggaggtccccgccgaagagcacgagaacgagccggaacccgacggccgccgcggccatcgaccagaagttccggatcgccatcgccgccgccgctgccgcaactccgatctgcgcacagccaccgcttcgtcgtcacggctgtaaccggagccgcggcctggcgattgggccttctacgccaagtcgtcatggatgtcgcctttgcgtaattgagttgggcttcagcagccagcaccggttggatggcccaaatcatctgcaattcgggagtacctatacatctttcgaaagatttttataatcgtatcatacagatttttaatctttgtattaaaatctgatagatataataaaaagcaaaaaacaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattctttagtgttaaggcccacattagaaaactttggaagcccgacctggaaaaataccagcacaatgttttagagtggttttcaccaacaggcacaaaggttgaaacgggaaaatatgtggtgcaaaccatatatagtggaaacttagaaactaccgttggatcgagaaacgacgtcagagtttcgtccacgtcaccatgagttaaaatttaactcgcagattcactcatgagttaaaatttcactgggagttaaaatttaactcatggtgacgtggacgaatctcgaacatccatttctcgatccaacgatagttttcaagtttccactatatatatggtttgcactacatattttcccaggttgaaactgtgatcccaagttccaacttccaagcaaagtacacgtgtagttccatattgtattactacattctcataaaatatatactagtaatctaaaatcggattagatataacataatactataatctgaacatgtagaatatggataggaagcacatatcctaattggctagtagtatggatttagacagacaacacatattatatattatagtagactagtattacgggtctagacataagtttattatctatatccatagtacgtttaatccggtttgctaaaatcttctacttcaataataacccatatatgtaaacagatactttttttttaagataacatttgtgtcccaaaaaaaggaagcacagatcataaaaaggtagacaagatcgaatcaaacttctcaaaataccataatgtcttgacgatgacaagtagggtctggtacaacattattttattttagcaaacttataaattattaagacaactattatggtattatcaaatcttgcccgcgtattaaaatgcccaggtctcgcacgctagcttctgatcgaaaccgtctacacgcagtcgacgtctacgcgacaagccgcgagaacgtacgccgccgccacaacacaatcccaagctcccaacctacgcaagctcaccatcgccggccgtcgacccaatcccagcgaccatgaggcgtctgctcgtcccggtgctcctcctcatgctcggattgtctacctgcgagtcctccgtgttgcaggacacatgcaagtccgtcgccgccggccacaagtacgtcacctacaacgactgcatcaaggccttccaggccgacagcgccagcgccaccgcggccgacgcgcgcggcctcgccgccatcgcggccaggatcgcggagaaggccgccaacgccacgtccgcgcgcatcgccgcgctgagagccgcggagaaggacgcgaggaggaaggaccgcctcggcgtgtgcgcggaggtgtactcggacgccgtggaccagctcggggagaccgccgaggacatcgccaggggcggggacgaggccacccaggacgcggtgacgcagctcagcgcggcgctggacgcgccagggacgtgcgaggacgcgttcggcgaggccgacgacgcgtcgccgctggccccggaggacgccgagttcgcgaagctggcgaccatcgccctcgccgtcgctgcgtccctctcgccgccgccatcgacaccggcaaccatggattgatactgtctattaatcatcgtgattcgcgcataattagaaatttagcatcgtggactacattcagctataataaaagatttttcgatgatatgttaaattttttatgctttacttggaaggattttgtccagtgccttgcatgttacgcatgcaacgtggtttagtgggcgagtagccagcttggaatctcatctcgcgctttttttatactccgtacgtggtatgtctttgaacgtgggtgctagctgttttctggaagtgggagcgttgagtggaagcaaggcgtgctgccttctgaacagcacttttgcctttcgccttcgctcccttcttttctatgtggcttgttggcatatattgctacaaaattgtactggtaaatatacagatatatattgatctgctgcgaaattatgatttgtgtatcgttctggattatttggagttttaagtagtaccacgtaaaggccattcggtaattgagcagagcagcgctagatgttgatctcaagaaagatatatgcatcagaagccaatgagagtaatagtgccattgatcatggattcatgtcttgacgttcaccggtagccagaaactgaaagatctaagccagctttcttaccgcatcttgcacgattcatgctcttgatggcatcgtctatcgtcttattgtttgggtgcgtcgaacgtaactgaggtggcagcactatataatacccagattagagcctagctcattggttagatttggggcagggggagataatcagagaaaaaccctcacgcgtcgctctcccaggggcggctcaggaggcaacgacccggccgcccctctcccccacccccacccccttctccgcctcgccgtcgcccgagcggccgccggcgaagccgcgcagccacaaggacggcggcggcggggcgctcctcgtctcctcgcgctcgggcggcctggggagccgcccggagtggcgacggcggtgtccgccagatccgcgccgttccggccggatctgacgggatgggctggcggcggggacgggcgacggtggcggtcgaggtgagttgcgcggggtggtgttgtgggtgatggcggcggggatggtgacggcgttggggtggcaatggtggaggccgcggatccggcggtggcgcacccggatccggcggcggccggtggtggccagagcacgcaggcaccccgcggctgccactggcgtcctccggcgcccctctaggcgtcggccggcgttggtggagaggaagacagccggatctggctccttgcccagatccggcgcgtcctcgggtgggaacggggtggttggagtccggtcgtcgtgcaggtggtgtgaatatcgcaggtatcctcggtgtgcaggtgacatttggtggctcctgtcgtggatgctatggttgatgggtgctccaaggcgaaagtcttgctccgctctcggtgctagcaacggcgacacccttggacgccgttcaccttcttgaaggcgttgctactggagccctcgttcaactccacttcaagagttttctccgggtgaaaacctagattcgttaggatcggacgatgtcgtcgttgtcggcgtaaccttcttaaaggcttcgttttaggagtttatctcttgttggacggctgtacttaggttcggtttgtcaatgtcggggtttttgctggttttcctttaattaaccgtgttgttgtaaggtttttgggtccggtttcccttataaactggatcaactctcttcttctatagtgaattgcaggagctccctgtctgtcccctcgaaaaaaaaagatttgggacaggggaccataagcttagagggggctcagagaaggtgagggatcgacaggcttgcagcattgcagagtgcaaagagagcccgtaattagcagttttatgaaaacgcaaacccccaaatgaaaggcaattccaactaatctgaaaattctgatgaacctgaggatactcgtctcagtgtgtctgtgtgcgctctaatcttttctcctttttattttcaaaaaaaatcttttcctacatctgggccggcccgtcctcaggacgtacacgttctgccgtttgcgatcggtgtctgccgtttgcacgaatgaagcaggcctaacattcttcttccgagagacgtggaattatgaaggaataagttcatctgaagtctcttaacttgtcaacgaatccgattttcgtcctccaaccgaaaaatcagatacaacaagtccctcaactgtcaaaaccagtgcagataaggttcctcagcggttttagctgacgtgacgcctacgtggctaatctgactcggtctccatttgatgtgacactgacgtggcgtttacgtggcaatttgatctaagaaaaacaataaacctcgtgggacccacatgtcagtttcacacataaattaataaaaatggtggggcccatgtgggccccaggtgtcattctcacccatcctcttcttcctcctctttccctatctcccctctcttcctgtctctcctctctctctctcaggcgtgacggagagggagcggcgcgcgccggcgccgacgggagaggatgccgtcgccgcccatggcgaggatgccgtcgaggtcggagggcggcgtggaggacggtggaaacgggggcgggggccgcgatggtgagggcacgacggattcgggccaccacgcctgtcccctccggccaccacggcggcggcacgcccttctcaagcagaaagcggcgctgcggcgggtcgcagtgctgcatgagcgccgagagcaacgaacccagcgtggtgtcctgcagctcgtgcaggaagtgcggccctgccggcgcggcgccgccgacgttgccgtcgcaccccggcacggcattgtcgccaacaaattgtcagcctggtacttgacgatggcggccgggccgttgcggtcgaagcggaccttctccttccaccaggagcggaggttgtcggaggcgctgctcaccggcttgcccttctccgggatgatgccgtacacgaacccctgcgcgttgcacacctccatcatcttgagcatgtacttgaggatcccgtcttgctcctacgactgctgctgctgctcatgcaagctccgccggcgggaggtgaagagaggggagatggggagaggagaggggagagagatgaagagaggggagaggggaggaggaagaagaggagggatgagcaccacggcgatgttgagcaccacgagtccacgacgaggacccccatgaagaagccgaagctgagcacggcggacctcgacacgcggagtatctgcttgactgcttgccggaggcatctagtagccctgcaaattaattaatcagcagacgaagataattaatactcctagctaggtacgtacgttgtcgacgaagaccgttccgaagttgccgacgatgttgatgatgccgaagacgagtccccccgagctgagcatggcgaggtaggagcccttgaagttgccggcgacggggccacacgcctggccgttgcgcgagaggtcggcggagcagtcgcgagcggcgctagctggcgacggccatgaggcggtcatacaccacacgcgggctggcgagtgtgtagacgacgacgccgagcgggatgaggaagctggcggcttagatgtctactccggtgaggccgttgacgacggcggagccgccgaggaggagcatggcggcgtggcgcagaggagagggggagagaggaggggtaagaatgacatcccgcgtgggccccacatttattaaactaatgtgtgttaaactgacaggtgggtcccacgaggtttattgccccgtaagcgccacgtcaatgccacatcagatggagaccgagtcaaattagccacgtaggcaccacgtcagccaaaaccgccatccaaaccgtcgagggatctcatctgcactggtttttgatagttgagggatggattgtatgttgttttacggttgaaggacgaaaatcagattcattgacaagttaagggatctcagatgaacttattctaattatgaacacaagtccaaatgggcttatattactggattgttttgttcagggagagaaaagcccaaatcgagagtgcgtagcgcagcgaggaacgtgttacgtggtcgggacaccggagaacccaatgcagccagccaggcagatcgacgaaaatctcgaccatggacgggcgtcgtttccggcggatcggtgtccggttctcagcatcccattccattcgatgtgtgtcctaactcgatcgtgatctctttgctacagcaacacaatccaaaaaaggccctaggatgacgctgatgcttcgtacgcgatggaactacactagagtagtccactcgtgtcggagcacttcccgggtggatagcatacgatcgatgttccattacgtactattgtgcggcacagctaatgattgtacatgtatgaagtactttcttagcaaaatttgttcatagatactttcaaaaattttggtgttggctaggggacaccgttaaagcaaaaaaaaacttggctctttctttttactatataattcctccgtctttaaatataagggattttttcttccagattcgttatattatgatatgtcacatccaaccaaaagtccaaaatcccttatatttagagacgaagggagtagttcaaaacttatccatgttcgctacgtctatcacttcatctaagccacatagttcaacacgtcatctgtcaccccatgtgaacaaatcatcgagcagctgccgtcctcgcaccacggctcgactaactgccaccgccaccgcccaaggcagaatcttgcaagctcgacaacgccatcgcccatgtcttctcccactccactcggtgccactgctgcttcacttgggccgcactgcctttgctccgctcagtgtctcaacttcatccgccagtggggaaaggtagagagaagagagaggggagatgaaaagtgagaggagaactacactgtggagcatgtatcctttcaggggcttaggactaaccaacaaccaatactcggcaagtgcggtatctacactgctatcatcctaacagggtaaattcgaggtggcgaccggtgagcctcaccaataaaagcttatgcgtgggcagcccgagtatttttgtcatgcattaccattagcacgtgtcaatgggagcaaattaaattgggagtaaggtgagaaaattattagaaagatgtgagaagtaaaaaggatcatacattctaagggttttcacaaatagcttaagttgatttttttttcaaactattttcaaatcgtcaagccaagctttagcttacaattagcattgctatgataccaactgctgtgggcaccacacgtaatatattgtccagtgcttatcgtgactaacacatgtatttggatctacgtgtgttggtcatgttggacacactggacgatatattacttgggatgcccacattacgtctttgctgcgatcccctcttaaggttgtgttctttagggcctgtttggtacaactccaactcctaaatttaactctaggagttaggtctggagtggagttgtggagctgtctaaacccagctctacaactttcattttgtgagagagctccacccagctccactcctagttttgatggagctgaaactgtttggctgagctctagctccagaaggggtggagctggagctatgacaaacaggcccttagttacccctgctgcagcgccggtgcaagctattggattcatccgctatgctgactcaagcgggctagcatccccttgcagcccgtgctgcccagcgttgttttgtatcccatcatcatcgtaagctcagtcagggactcaggccctgtttctttcagcttaagattattataatctatattattgagtcatattactataagctagattgttataatctgtagtagaataagcggttagttgtttcttttctaaattattagagcctagattattgggtttgcaagtctaaaaagggagtggggtggcatggtgggtaatttttcacccaataatctggaaaaagctcacctaaatgagcttatcggattataataagctggactccagattataataagctacttcaataagttgtttgtttctttcagcttactcctaataatctggattataataattctaagctgaaagaaacagggcctcagggtcatgacgccatccatactctgagctatagatgaaccgagtggtactgaggtcatttgataatgtttctgtgtccaaaatagcaggaaataatataacaacgtgtgccataatcgatggcaaataatcagaattttggagcgtttacgaacaaaataagttttgcgaaattctcaaatatcgtttagcttttttttccctttttttgcgtgctttctgtggtcaaatttggagtgccaactatacatcagttgggctgatcctcactctacctgaaaatcattggtccacccagaacgaatcttggctgcaaagttggaaaaaagacgtttgaggctcgttagctactcgagcttggtcgttacatgctttgattcgctcgagcctgctctgaagcttgcgagctctgaccagccaagctcgagctgttcgccaatagcccctctcatctaggctcttttattgtccgttggctttgattcttcatgttaggtttagtcccatatcaataattgataatgataaaatataacttaaaagatgaaaataattgtcacctatcaaattagtattttagcctgtctaaagttatgaatccggttaattctacaataaaaaatatccaatatgttctgagtggtccatggtacactccactttcctcatgttcacatgttgttggatggtctgatagctaggactagctcctccaacccactcggtgcaccatttcttgttatttttgtaaaaagaaaaaaaaacactagttacactagttgttaacaaaatagaccttcggtagcatatttatggcttattcgtatggccacttcatccggctcaaagcggttcgaataaatgtatggtctttgaagaaaatcgattagggtatattttaaaatttcattctacttttgagctttggtgcttcacgcttcacggtgctgatcgattagggtaaatccaattcatgcccgaaaaggaaaagaaatgtctaggctcggctcgatgctgtgtcaagctcgagctcaggcatgtggtcttagggctggacaaaaaactcgttactcgttacctcgctcgctcggtttggctcgactatgctcgttgtattttttaaaagagccaagccacgtataacgagctagctcgatcgagcttgcgagctgctcatgagcttaatgagctagataggagagacattaacaaaacatggcccataagtataactcaacttgctggcccagaaagagaaaaatcagtccatcccgtgctaggcccaaagaaaatgtgcaataggaatgtccaaaaccctagtagacttggtcaatcagtccccttcccctcattctcgatagatccagattcggcatcggcaacagccgcccgtgcgccgcctgagccgtctgcgccgcctccgcacatcccacgccgctccctccatcctgagccgcctgcgcactccctccatcctgcttcgccgtcgcccgtccagcgtccagtggccgacgctcgctgcttgccggttcatgcccaggaaccagatggccggtccccaactgcggagctacccacgccgtgatgctcactggtcgctgtcggcctctcgatgagcaacccatgccgagtgtccctgtgcatcacggaggaggaagacgaggtgcagccgtgtaggtgtaacgtactaacatcctcctgtgatttgttcaactgatgattcatttgttgaacacttgactctgtgattcgttgcctcattactttgatacttagatacagttgcatacttggatttgaacgctggtttgataatctgaatttttattgcaaactttttggttttgttgtattggctcgcgagctgaacgagctagctcaagctagccgagctgatccagtcttctagctcgttagaataacgagctggcttggcttgttatcctagcaagccagaccgagccgagccggctcgatatccacccctatgtgggcttggtcgagatcggctcgttttagcccctgacgatagtaaaacaagggatcggtcggcggctcgcgaagcgaaagaaggaggaggcagttttcaattttcacacgactgcagcgccccaccctttcctactctttttatttccccacttgtcttcccccgtgcggcgccacacctcttctcatcttctcctcctatcaactccctctctctccaccgctccgcttgcctcggatcgcgctcgcgctcgcgcggagcagcgcccccaacgacgggcatggccggtgacagcggcaacagcgacggcggtagcaaccgggatgaggaggtccagatacagatcgcaggtcaatcaaatctttcccccccttcctctgtcgaaagcctcactgtttagctatgtccgattttcttcgttgagggagtgggggtgaggaggttagagtcgtcttgcgatgggcggcggtaaacgcagatgaaatgaactcgttcgttctctcgggcttatttggtgttcgatggtgtggggaagtaagcccgcgaggtgttcgatgaattgccttctcgtgcgtggcgtgttggatatggccatatgcccatatgggatttgttttttgtttatagaccatattaacttttcagactatcgtgacatcatcgagtggcagagtaggcatgtgagtttaattggcaaacccctgttgttcgcgtacatgagctggataagtggttgatgatagcaccagctatagtaatgcactgcatttaacaaaagtaaaatctttatattagtttttttatattagtgcaggatttccctgagattccaagtaactcgctttcatttgatagtttcaccaatggacaatactgtaaggatggagctatagtcttgtgttgctcgactttctctcaataaatttagagcttttggggtttatatggccaattgttggggggaaaaaaaggagaggagggtttcacttcactatgggaactttggtagtctattttgaataggaaaagaaagtttcagttggccgtgctatgcttaacacatgaagtttgggctaacctgttgatactgcctaccttctgtaacttgcagattcatccaaagctgcaacttcgtcaactcatgaagtacctatacagaactctcctgtcaagagttggcaatggtggctgatggtgggagttaacatgttcttcctcattgccggtcagaccgcatctacacttcttgggaggttctactacaatcaaggcggcaatagcaagtggatgtccacattcgtccaaactgctggctttccgattttgttcattgccctatttcttttccattcaaagacatcttctacacaaacagtcactagtagtcctgcccctacaatttctatccccaaaattactctgatatatgttgtcctgggcctcatcattgctgcagacgacttgatgtattcctatggcctactatatcttccggtctcaacatattcgctcatctgtgctagtcagcttgccttcaatgctgtcttctcatatttcctcaatgctcaaaaattcacccctctgattttcaattccgtagtcctccttacgttttctgcttcactccttggagttgatgaagattctcagggaactactagtatatcacatgggaagtacattttgggtttcctgttgacactaggggcatcagctacatactcgctcattctctccctgatgcaagtcacatttgagaaggttattaagagggagaccttctcagttgtgttgaacatgcagatatatacagctctcgtggcaacattggcttctcttgttgggttatttgcaagtggtgaatggatgactttacaaggagagatgcatgcattccagtctgggaagctgtcatatgtaatgacactgctgtggacggctatatcttggcaggtagcatcagttggagtggtgggattgatctttgtggtgtcatcgctgttttcaaatgtgataagcaccctagctctacccatcattcctgtttttgctgtgattttctttcatgacaagatggatggagtaaagattatagctatgctgatggccatttggggatttatgtcatatggccaccaattatatgttgatggcaagaaaggtagaaagactacagtcagtgtagaggaaacttcctaatcatcacaatgttgcctagaatgccgctcttaccaatttaagttgttggttctgagtaaggtactgtagttattaggaacctcatcaaagaaattccatttttgcaccatttggtatataactatacatattgtcttgattactctgatgtaaggatgtatcaagcaagagaataaattttatgtcacccccaattttccttgtcctgtggagtagtcaagtcgatattgtggttgtgatttttggcacgcttggcaagttgatactgtgccattattgggtttgattcaagtgtatacagtcgaatgcaggttcaaatatatgttatcagtgtctatgtgtatgtcaaacatccagattggatggttatcacaatgacttacttggtgatgaaatccaatcataagagggcgacgacgctcgatctgctgatagctctggccggctcataaaaatattaggagaattgaaattgagcaggcgaaagcaatgggacaagaatcagccaaagacgccgccatactgtaacgccaccaggagttagctcgccaaccaacagcttcaccgcatctccttgattttttttctcgcgtctaatttgtgaacaaaactcggaacgggacggccacgacggtgacggacgcccaaacgggcaacctatgatgaccaattttgctatatatttgtcgacaaattttctcttaaaaatttaacactataacttatatgtaattacactataactataatataacttataatataacttgtatgtaactttcaaaaatctctccataacatattattttggtaaaataaaggttgtgggaacaattttttttcagatatgtgtgtactgtgatttttttttcttcctcaccaaaacaaatctttataatagatctaataatttaaaattacgtgaaacttacatgcaagttacagtgtaattacatacaaattacagtgtaattacactacgattgtactgtaattacatctgtcaaatttttagaagaaaatttgtcgacaaatgtataggtggtcccatgatgactgctgaggtagagtgggccatatacgggtcgaatcttcttcgttgcttttgcacgagcgatcacattcggcccattgagccagtcagccagaggaataagttcaccggagatccctcaacttaacaacgagattttttgagatcccttaaccacaaaaccagaaatctctacccctaaactatacaaaaccgttcactcaaggtccctaggcagtatatatgggtggtttcactgacgtggcatactagtcagaaaaaaaaaattatacgtgagggccacatgtcagctgcacattccttcccttctcttatccttctcctcttttctctcttctctcttctcttcttcttcagtgagggatctaggccggcggccggtgggcggagcggcagcgggccggcggtggacgagcgcgccggggcggcgaggagaatggcggagaaggcgagtgaggcgggcggcgaccttgctcccgttcgcgtgcgtggagttcttccgaccttgctctcgtccggcggtgcgtccagggcgcgcccggcgccgtggagttcctcttgtccgtcgtcaaggggcagcacgccaccaccgtggacaagacgacgtccacaccgctggttcgttctttctaggaagagacgacgtgcggcgtgcaggattcggcgaaggtgagctcgccggaggaggcggctttgagcatcctgcatgcttcagctctcctccttcgcctgcttccgcgccgaccccactgacgacgacttcatcacgccattcccatacgcgtcccacccgccgccctcgtctcctcagccattgccgccgctggagcttgagctggtcgtagtagagcgcggtcagcacctcctaaccacaaaaccgttagtggtgtgcatgcatagcttagttagctgattagttagagttagtcaatacatgcatgtgttgcatgagttgtgtggcagttagcttcgtgtatgcggctagctagtggctgccaaattaagtggatcgcgtgctgcgtgcgcgtacgatgtggccgaagtttgtgttcttagctataaaagtcatgtaatctcggcttccggcttccggctccggccgttcacgccgcccgaagatgatgcggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccaccgctccacccgccacccgctgaccgctccccgccgccggcctccctcaccgaagaagagaagagagaagagagaaaagagaagagaagaggaataacagagaagaaaaaaatatgtacggctgacatgtggaccccacgtattcttttaattgtttttgctgactatgatgccacgtcaacaaaatcacccatatatactgcctagggaccttgagtgaacttattcctcagccagactgctcccaaaaaccagaattcccacgcggccactctgaaagaggactcgcaggaaaattgggaaaaagtatattgaatgtccctcatcttgtcatcagattacaaaattgtccattaaccgcaaaaccgggtcactcggggtgtttaggcagttttgacaccggtttcatctgacgtggcaattaagccagcgtagcacctacgtgggccccatatgtcaatgaaacatcccttctttttctttccccctctcccgtctcttccccatcctcgcgtccgcactccagagtggcgcaacgggcagcggcgagcggccgctaacccacggaccccgacgacggcgtggacgatgggcggcggcgacaagctccattcctcgctcccctcctctagctccctcttcctcggcgtccccggccccttcccttctctccaaacgatcttgaggaggagcagcggcggcaacctccccgctgccatggaccctgacgatggggcgagcggcggctgacgagctccatgtgcacccctcctccacctcctcccatagtgcccccgccccttctctcccgtcgatcttgaggaggagcgcgtggtgacggacctgggactctctgcgtttgtccacagttacgccgcctaccttgacgaccggctcgagatccgcctcctcctcccaccaccgcgctcgactctggccccgcgccgcgccgttcctcgtcatcgacagcctctcccgcatccacggcatcggggagacgctgctcatcgtcaaccacgacagcgccgccgcggtttgtccgggacaggcgcgccgcgacggtggcgttggagtagacgggcagctggccctccctatgctcccccttcgccttcccccatgctcccgccgtcgccaccgccggctgtcgcgcctcctctcctgcctcgccccgccggcctcctccccaccaggcgcccccctgcccaaacgagaagaatagtgagagagaggaggaggtgagaaaagaggggaaagagagaggtgatgacgtggatagtctaacaggatgggttcatgtggtcccacgctgattcagatactacgtcggacgaaaccggggtcaaaaccgcttaaggattcagagttagccggttttgtaagataaggtatgttatatatctgttgtttttgcggttaagggatgattttgttatccgatgactaagttgagggaccttcggtgtactttttcctaggaaaagccactcttgagctttactgtgcggctgaacggcccatttggcagaaggcccaagtggctcgtgtgttctacgcaatagttaggcccttgtacaaaactagagaaaattctgaatttctgacgaatatatgtgcgtgtagagcagttaaccatgaagttggtattccctgatgagtttgcacgacccgtcaagaacagatatcgatcacaactcacaagcttttccggcccgtccaagaaatattgcagtctttccgttaagaataagaagaagaagaagaagaagaagaagaagaagaagaaatgttgcagtactgcagaaatcaccaagcacagcgtaaggattctgtctcaccgaactgtccgtccattttgcagtacaagactacatagtttgcagaaacggagaaaccaactggaccgctgccaccgaaaatggagaatctatgacataaatactctcaacagccagtttcgtagatcgtgcttgggtcatcgccatgcgctggcgcgtcagcaagaaggttaagtgcaactccatttgtggtacttatcatggatggtcctaatacagttctccatttaagggcttgttttgttgtgaacgcatcaattagcgacgcatgtgcttgaaatactttgctcatctattgcgttcatacgtacatcatcaacttaacaactgtaaccagacgcatttatcctcgaggttggtggaatggcgaccatcaccgtacctgtccctggagatgaagtactccgtacatcaaacgccagaagattcttctactccacggaagcttcaatcggcctcacacagtgctggatcagtagccttgccgtgcatgcaaccaggctagctttcacggttccatgagcaattgagcacgcaaaattagcccacgatgctgccatgcttaggatctcaattaccaggtcgcaagaaaaaaatcattctgagtaggcggtttcatgttgtcctggaagtacaaaaacaaaaacagaagagcaaaacgtgtttttcattctccaggagagcaacgatcgatcgagccacggtgtagacaatgtcccaaattaaaagagagttgcgtgacgtcctacgatttttccctggctcccaacaaacgcttgatccgtcattcaatcaattgcgtaatcacgctcgctcgggacctgaagtttgttgcgcgttggcgacgaggcacttgaccagcagcaggccacagcccacaggggcaagtccatgtccatccttcgccgcaaagcagagcaaaaggggagcagcagcagcagccagacagccagccagccaacagacaccgggaccggagagatcgaccgatcgatcgaccaggtcaggcgtggtgtgccccggccgacaagaggctctggctcggttcaccgctcggcaaacgcaagcccgggggcacgggccgccaccggcgcagtcagccaaaacgcacgcagaaacgcgatccaaccaccgcccgatcgaggcgcgcagaaaaggcggagcggatggcgaaacgagagggttacgcactagtacgcgcggctgcgtcctggagcgcgggtcaaccgtacgtgacgccgcactagctagcgagtgctcggctcatcatcacacgcgcccccaccagccaccacccaccacaccgccggtgaatgcgtgtgccacccatcgatcgggcgcgccgtctgccgttcacatccaccgcaccgcgagggccgcggctgacctgagcttaacgcctctcggggtgaggattatgcgcattaggcaagcttgttcccgaagcgacaggcaggtagcggacggcagcgtcctgggcgggccagtggtgccgaaatgcaagccatgattgcacacttcttgcgggtttctattgctttctggtgtgtgctggaaatgtatgcatgctgatttttatttttcgttgccaatgctaggctgcctcctttttatcgataaaggaagagagtttatttctagaaaaaaaaggggacttaagcatattccctcggcaataggtgatctataagcttccatgttctggacttctgaccaggcaccaaaatctgtgatcttcgttttatctttgctactatcacaataggatttataagttaaaagagtcgggcatttcgcacttttcaaatttactagctcaccatttggatcaacgagtgaagcgggctctttgaagctcaagtgtctgtgcaagggacactctcctcttatccaccatgctcattactctctgtgttttatattacaagacgtttaacttttttctagttaattttttctttaaatttaatcaagtttatagaaatgtatagtaatattttcaaaacaaagcaaaaatattatcaaaatatatttaatgctagatttaatgaagctaatttgatattttaaattttattgattttttctactaacttagttaaacttaataaaatttgaatatgaaaaaaattcaaacgacatataatattatgacagagggagtatgtcccgttgatctattcttaggtttactagcgcccacatcgctatcatcctccaaattctctgggagaaccgagtctcttccattctcatcctccaaaacagttgggagaagaagaagaaaagccttgattgtttgatcgtggttttatgagctgtgaaaaagctaacctacgcaataatgataatttatatacaaaattatattttaagcaaagaaagccaatgcagaaaaaataaatgaaagaaatcaacttaaatttaagttatacggggtaaaagtctaacttttgctgcaactgataatacgacaagcagatttccatgggaggcgtcattaaaaggacttactgctagcattttacataatcaaattgcgctccctccttccaaataaattactatgagaataggcttatttcatattttggttttttcaaataagttggccatatttgtagtttccatgtacttaagatttaaatgaaaagataaattaaatgtttaatcaaaacatgagaaatcatcttaatattcattggttgcatgcgtatatatgctatttaatttttgttatatgaaagatagattatttttttccttaatcctcagtataaaaataatatgtctaacccttttgatggggggagtactttgcaagtacggttgtggagagaacatatgcaggttgactttttacatattgcttgcacgaagagggttgacttggcaactgcccagtggcatggctcttttgctcttttgacatcatgattattagtactagtagtattcatagaacatactccttccgttctaaaaaagataaatctttggtttccgtgtccaacgtttaactgtcagtcttatatgaaatttttttataattagtattttcattgttgttagatgataaaacataattaatactttatgcgtgacttatctttttaattttttttataattttttttaaataagacatacggttaaacgttgtatacgaaaacccaggttttgattaatactttatacgtgacttatctttttatttttttatttttttttgatggagggagtagagtccgatagaaaaggcgaaatacgttgaaaacaaggagccgaaggcgaatcaaaactctgcctgcactgccgctacaattccagtgatgatgcaaagctcacgttagattagcaggagtaacattcaaaaaattatatatttttctaccggctccactggataatactactatatgatccagggctaattcaaacagagagaaaaatattagcacagcaattgaaaagtccaaccttctattttaattaacagaaagtgtaacgggtgatcttaacaagagtgagccacatctcccaaataatatatttgcttagtgaagtaggagtactagctactggtttgatgttgtttattagcagcaactcctgtactttggtatgttgatggtaccatgagcaaaaacaaaaggatgaatcctaccaaagagctggaagattggagtatataaagttaaacaaacaaataacttgttgcaccaggagaaagtaagaaaataatgcatgcaactaaagagctggagagagtgggacagcatgtaaagcacaaaatgtagcatcggagtgaatttctattcacaactttgcagttgcatgttataatttgtaccgaaaccttaagaggaatctatcaaaacacaaaatgttgcagtattaagctagctaggagaatccaaacactaaacagtgcatgttaacagttaacacgtcataatcagccaccagtcacaacactgcccacacgaatacaacatcatcatcatcacatatgcacatcgtgggcagcccacaagtcgccagcaagacctgaaatgacctgaaatgaatacaaagaatcataccaaatcatctaaatcgatatcaactttcgtataatcgaaggaaattatgctcgctaataacaggacgtactcataacgaatactatgtttgtttgtgtacatcttccaccgtgccatcaagaaaacgaatactacaatctcatgatgtttgtctattgtcacggtagtcaaggcctcaaatcagaatgtagttatcgcaatgattccactctctaacactgattaattgatttgaaagggatgaattaaagtggttgcatcgtgtcatgctagtagaggaatgcatgttctttcccccccccatcaagtttttctaagatttagcagcgtatttttggcctgtgcgcaccgtgttgcacagagcgcttcaaatatgttgttttttccccatctgtacgtggtaactgtgcaaaaaatggaatgagcagatactattaacttcggtatgcacaaagaggttgagaccatttaattagtatggtttggtgcaccagaaaagggagtaatggaggcagaggcagccatcgcccataaatacgctgcctgcctccatgtgaaagctctgaccaaatgaattgaattgatgctatttcatggagtattcatagaccattggatcagattcagaattcatttcagacacaaaacaatcaagaaccttcttttaatccctgtgcacaaagccacatacactcctatccccctctactcagatccctctcactcataaatccagcatttaatcctgtgtacaaacgacctgtaccgtgcagtccatgcacatcaacaagtccactcattcttaaacccaagcatcaaagaaaaaaaaaagaaactaaggttaattaacaattttgcaaatcaagattagacaactagctgtacaaacaaacaagcagctcttacagtaatggtcggctgacgagcagtagtaacctatatgtcaacgaagtggtttggagttgggagtataaaatcttatagagacttttcatggatggacaaaatgcgagtaagaaaggagaagaaaaatctaaaaaggatggtaattgggattaggtggtgataagcggtgaagagaagatgaaaaaggtgaaaaagaaaacgtgaaaagatcaccggaagcgtccgccgtcggcgagcttcctggagcggcaccgagtaatggaggcggcggaggagaggttgtggagcggcgatggccgtagctcgcaggagaaggtgcctgggtcgggcggatgggcgtggcggtggcggcgcccggggctgggccgcacgagagggctgaggcagacggcgaagcccgatggcatggtgctggtttggcgccgccggcatggggtcctccgcatcggtgaaggagatggctgccatgggggatcagtcggcgagctgctctcctcgtcgctgccgtcgcagtcccgctccggcgagagcccacggttgctgaccacgcggcaggagcgcctaggcgggggcgacgaggcggctgcggctgcggctggcgctggcggctgcttcttgcggcggcgcggcatgaacccggcgagccaagaacggtttctgctctccctgttgtcgcctcccttgtccttctcctccgatctgtgatggtggtggtggtggccgaagagcgtggcgatgacggagaacttccccgcgcgccgcttctcgtacccgatgtccccctcctcgagcccgccgctgctgccgtaggcggggccgacctgcggcgtccggaagaagaggaggctgggatgatgcttaagcgcgccgccgcccgaggagaatccgacttcctgcgggacacgtacggcgacaccgacctcgggaacgccggcgccgccgcggccggtggcgcagccggaggaggaggcgacgacgacgccccgttctgcgcggcggcgagcgcgagcaggcggtcgttgaggcacgtggcgcagacgccgccgcccgcctggtacgggtgcttcttgcacctcatccccatctcatcgactcatctcgccgccgtcgccgccgccgccgccgcgcgctccggccacgaggaaggagcaatctacaacggcgcacgcgcacctgccttccttcttccccttcccttcccttgaaatttgggcgagttttttaaaacggagattggtgcgcgttttggcgaggggatttttttttcctcttttttttcggtccgcgacgctgcgtccgcgggcttaaataagcttcggcgaaacgaagggcttaccaagtgcaggggggacggagtaaatggtggccttgactacgcttttgggcgaattttggtttgattgcggttgcttttctattcgtgtttgtgagacttgcgagtagagtagaatagtagtagatgcagatgtatagtagtagtactagttgagatagatttggcacgggaccatgcttggatttggttgcggtggtgcggcggctgagcacacatgcacaccgttgagagcgagacatacatgttcgtttttatcggctaatctttgaaaagtgtattttgggtttggcctatctacacgagtcatcttaaagggattccttatcttaattaatccagggagatgctctactgttattgaacaaatgctgccactccactagctagcatcccacaaattgttgcttggccattcggcctacttttcaggttcttcctctctgaagcctataaacccaagccgtggacttcccagacctctcgattctcagccttgcttacggcccttttttccttgtcatgatctggtgtaggtgatttggtttatggttcaaccaaaagcgaagaattgtctcgttaaaccatacgctccagtgtgtcgctgaggtctagacacgtcggtatttatacaccatataatttacagttaattgcacagtgggccacttatgtttaccaaggttgcaacttggactagggagaagaaaatattttcactttgatttagataagtttgcaaaatgattcactttgtaccacttccctctccagctctctcatcactttcttctctacaatctaggaaacttggtgagctcgtgaaggcagcagcacgcggctcaaattcttaatgcatcagatcagcatgagcatgattcaactactaccaatacaggatctgctagctaggtgctcgcttcttgcgttgattatgggaactgggagcctgggagatccttgagcttcacgtcaggtagagggcacggcccggaggagatgctccttggcgatgagcagtaggcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcactctataatttatcctcaagtgattacgttgctgactgtgatctctcaggtaaaaaaaaaaaggcccgaccaaaatccattcggagggcgtgaaatcgatagcaaattagcaagtactcgtactatacgtacttaataacgccttgcacgaaccgcatgcaccacacgtataaaccagctcgtcactttctcgggtaatatataatcgcgttccagaagacgtttgcgctcatcctgagccgtactatccattcatccactctcagctttggcacggatgcagtgcaccaaaagttatggaaaagagcaactttcaccgcacttaattagcacagtagaagcttcccgtttacactgatgcttagtcattagtcactcgagaaaggacccggtaaaacagaaagatctcaagacgtacgagcgcgactttgccggtgtcgatcggttttaatttggtcgctgatcgatcacgccgagatggcctctcgccgcgccatgacggagtgggacggagatggactgttcgttcgtctagagaaagagcacagggcgtagctactggtcggttgattgatcgcgcgatcgatggagaccgactcgagagaccgggccggcgcgcgagcgaggaggcaagcgaagcgcgcgcggatgcagccatcgatcggcgaccgcgcgcgcgcgcgtacgcgtcacgtcgcgctcgtggagaagctggcgctgctggcgatggcgctgtccgggtttcttgtgctcgcgccgcgcgggttcgtggaatcacggtgggattgcggcgtcacgagggaaaatatagtgaaaaacgcgcggttgattttgtcgcgggggggaactgtgcaagtgggtagaaagatcagaacggcgacaattctatcgtcttctggagggagaagtgtaaggatacgtccgtttctaacctgttcatggaagtggtcattgtcgagatggattgggattagtccatcctgcttaataataatgtaaaagaagctaacctacttgccattcagcaagcaaccaagtatcacacgcctcggatatattgctagtggtttcattagggtctatatgtttgattttattttttctgatctaaagcatttggctgcgtttgtccaactcacgtcgcaaaggaagctgacgagatagtggaagcgtcatcatcattgcacttaaactactcgtgtctggtttacttgtacactcacgatgaaaattaaggaaagataccgtcaggttcatcgttttcatctcatcgatatatatatatatatatgagatttcggcaatgctgtcgtacgtgtcgtgccgacgccacgcgtcgcagtcgcatctaattcacacagggctgattaacgattgaccaggtagcttcttgctgatcaaataccagaagcgacaggaagggcaacattatcttcttctgcttaatactcttagcttaaacgtcacgactcagcccgatcatctgtagcactatttctgctagtaattaacttttgctttctagtactattaaccatcatgatccgcgcccctttcgcggggtcaagcctgaaagctccacgtacgcgccgccaccgtgtgctagcttttttctctcccactcttccatatgcacctatatatccatttcccccttcacaagggcgccgtgaaaccgatgaatatacgaggacttgtcgtgccatcctgccaaatcgacgtccgccgcgggctcgcgccgcgcgcgggacggacgggacatcgcctcgcgcccgttcgccgcgttgcgcttgcgctttgctcgtgaaacggccgtgcggcagggtgggggcgcgcaggtgcaaagcggcccgtgggcggtgggctctctcgcatcggcaaaaaacgggtggcggctacgtcccttgtcccaggtggcccaactgaacggggagctagttttggacgagaaattgttcgagaggcttgggctcgcgataagatgggccgagacaccagtgctgcaagccggccacagccaggggccaatagcccactactgcggggaccgctaatgcgcgggtccacacccctctcccctatacgtctctctcctcccccttcctcctccccttatccaaattcatttgcacttaataaataccagcttctgccatagtggaacggaggcgcgtcgccatatatatacctcttgtaagccgccgtgcggcgttgtaacctcaccccagatatagtgaagatattttgctggctagcgtccgtggtttttctctcctactttgggagggttttccacgttaaaatctcgtgtcttctgtgattaatctattattctttatcttttgtttgcctatcatttcctaacaccttcttctcttccctactatagtacaccacaaaattattttgaaaaaacaaaagttagaaaaatttatgtaaagaaatattatatataaatatttgaatttaaatttaaatttgaatcaggtatgtaaacttttgacttataaactttggatctataaactttaggtgtataaactttagatgtatagaaatactatatattagaaaacatttgaattcaaattcaaaattaaatcagatataattcaaatttaaatttgaaacgggtatataaactttaggtttataaactttagatgtatagaaatactatatataaaaaatatttgaattcaaattcaaatttgaatcggatatataaacttttgacttataaatttttgctctctacactttagatgtgtaaacttgaggtgtataaactttatatgcataaatttactaaaatagaaaagtaatgtggtgaaaaaaaaagaaaccaggtgaagaaagatggaactgatcgcaaccagttggtcctgtcgatcgatcgcgaatcagcctttccgcactactactagcaatttgcagtttgatggcgctcggcaggcacacgcacaacaggaggactgaacaagtggtggctctctctacttctctagatgaaacgaaaagtttccagctcagtttgtagtgcccatcgtgtcgattggagttcctgccactgtgaagctttttattcgatcgcaactaggacgagtgtcaagctctgattgattgcagcaactaggagtataggacgagtgtcgatatttgattcgattgcaactaggaagtgccagtaacgtgccagcctctgaaccacacgaagctcagttgaatcagtcccaactccagtttcccatgacttggctctagatggttaccgaaaggtcgccagacaaaacttgattattacacactgatgctgtaagtacgtaccttgagagcaaaaaaaagttgcaactactcctgattcctgaaggatacgtaagtggtgacaacttgtgctcaaaccatgggtcaaatggatccaaaactgcttcgttaatagcacttggttgaagaaacatgcttatatactccatggtccccttcaataatggtaaaatgaggtccccacatcctcggatatgtatcaccatcgtcgataaagaattgaggctcaagatcatatgcctatgataatggcacattccatcaatcccgaaagcaaggagggcccctgttcattagtatgctacaaactgactgactagccaaataaatacaaattatcttttcagtcttaaaaatgtgcaatgggcaatgggacattgtagttgatctaagaacattttgataagagttatggatgtatgtactagtcattggttattggttagttcttacacaagtgatatggtataccctctaatattcaggaattcaagatttcaagtcccagtgccgacgtatactttcaacatcatcttctaaggaagaaaaaaagtatgacgagtactaatttaagtcaataatagcttccttagtcaatagagtagttgttaagtccgatgaagttatattgctggataatcaggtgacagtactagcagatcatgcaataatataatccaaagtgaaaaccattcgtatgtaccacctcatctcggttcttttaataacaacttccacatttagaacgtatataagggcataagaactgatcagcagcaaacagaacccaccatatcacaaccacgacttccctttcgagtaagcatactacctgcttatcatttatatgtcaggctcatttgaaaacatttcatttccttgatatagtttgttttaaattttgatgcatttcagttaatcttggaaagtatgcttttcttctatgttatgaaacacacaccgtcttgtggagtttgtgtgactacttgttttctgaaagaatatgctcagactggcatctagcagcatacatgtgttttctgactattttatgttcaaccatatgatacaaatgggaaaaggttcaaggctcaaatgataaaagctttaattactccatcctttgtattgtgagcatctctttaaatacgtagtgcattggatgcatagaatatactctacagataactctcaggaactagttattcttactgtctactctctccgtcctataatataagggattttaagattttgcttgcaacgtttgaccactcgtcttattcaaatttttttaaaattattatttattttatctgtgacttactttattatctacagtactttaagtgtgactttttgttttttatatttgcaaaaaaaatttaaataagacgagtggtcaaacgttgcaaataaaaactcaaaatcccttatattatgggacggagggagtaattatttgaatttgtgccgctcacagatttgaaccctcaaaagataattcaagccgtcagcaaatggggcaaacggtaaaatttggaagagttcctttcaaggttggcttctcacattcacagtcccgcccaaaggtgagcctttttgttcttttcaatgtcacgataaactcattcaaacagaaatacaattacagagacatcataatcaaaattcctggaatagttactgcttttaattagttcattggtcgatgataagagagatttaaagaaatataagcacgtaaggtagataatttactaatttaatgtaaatgattgatcatgcttcacagcaggaccgatggcaaggaaaatcgagcgagcaaagaagcatcgaatcatacaacaaaattccagaatttccaaattgtcacaagctagaggaaccagaggacaatcaacaaacagcactgcttctatctggatcccagaacctgtcttcccccgatatttttcagctgctatctgtggatgtatgtataccaacacaacttaattactctactatgcatttaacttttcaagaatcatttaacttaaagtacaggccatagtcatcctaactatttgtttgggatcattcatgctgatttagaccgattcagaaactgaataaatttttgacatatatttcatccattagatataatatacactccataataccagtgtactttaattaacagaacattatgcactaaagtactaatgatgtgcattatactgtacacatttcagtttgtatcatacctttaaaaatacatattgctgaaacatgtgcgtttcatttatttcaaaagtaactagctgggtggcctgcgcaattgcgcggctagcacccaaacaaaatcatatatttttcagtatgattttacttaagatttattaaatagctatacttgtatttctaattatatagtttttaaaagtcacaccagctgctaccctttacttctgtcatatccttcttttgtttcctcggtctaccactatttctattcattctccttgaaacctctaaaaattggatcttatagttttttgagtttattatctcgttgggtttcgtttttataatttctagaagtcccgtcaaacgctgccattatactcatctacgacccgtccattgtcttttctctttattgtcattgggattttacaaatcgaacataataatcgttcgggttcatttttttactttctataagtcccgccaaaccgtcagtggctttgccattgtactcctttatggttcgcccgctgcctcccttctttattgtcattgagattttaaaatgtatcatgattatcattgttttatttttactttttagaagttccgaaactttaaaaattggaccttgtagtttttagagtttattgtcttgttgggtttcattttttataatttttagaagtcccgtcaaacgatgccactatacacctctacagcccatcccccgcctattctttattttcattgggattctaaaatcgaatataactatcgttggaatttattttttattttctaaaagtcccgccaaccgtcggcggctctgcaactatactcctatacaccccgcgcacgctgcttctcctttttattctcattgagattttaaaaatcgaatgtgtttatcaatgttttttttttactttctagaagtcccggcaaccgtcttgcccgtccctccttttaatcatcattaggattctatttgatgttttactaacagtttttatatatcgtatcaactgccaccactattcctaattaaaatctttttttctttttctaatttatttttttaattaataccgtatagtgtttttttaatatttttattttttatcttttgaatttcagttgaactctcttttattttttattctgaattttaattaatctcatattggtttcttatatggattcttctttcactattgcttatttttaattccgaatttcagttgattttaagttgtattcctactttaacttttcttttctttttgctaatttcaatttttttatttttattccgaatattaactaatctcatattgggttcttatatgtactcttctctcaatattctttatttttaattccgaatttcagctatttttaaattgtattcttacttggactctccttttattttataatttcggattttattttatttttattttgaatttgtattaatctcgtattgggttgttatatggaaacttctttcaatatagcttatttttaattccgaatttcagctatttttagattgtatttctacttaaactctccttttctttttttctttttctccgattaatgtgggaatttctagccccccacagcgaacgtggtgtctccttttaaagctgttttaataataaaatagatatatcaaaatagcactattaatgcactatcacactaataataaaaagaaggaccgaacagagtctgactggaatagaattaattcattagatgtgatgtacatccttcatccatacgatctgtccatgggaaaagttgcacaaagtgagctatccatgtgggtttctgtagagtacaactgcatgcttcgggaatggtgcattcgatcagggcaaggatgcccaagggaaacatgaggagaacagcgtacacaatgtcaatcaagagatcaaacaaaccatggatggaatcagggtaaaacaaatacagtgcttacatgtagattatatgaatacagaattgatctaactggaaattctttccctactgcatgattttaatttcaagactctgctctccagtgaaaaggttcctcacacaacatatcagaaaatcaagactaggcacaaaacctgcgtaagaaaatggaatactctacaacattaaaccaagtttttcatgtgtagatgactgtggggggcgtggcagaattcttgaaaagtaaattagcaaacatggtacagaggggatgtggaaggaagagagaggacataagactccaaacagctcagatgcatgcagctctctcagttgcaagactagctacagcagttgcacgaatggttggtaattgccaatctgagtctaccaatgcaaacaacactatcatgactgccatagggaaagatgaacatagaaaaatgcatgttgcaattgcatctgccgcagcactggtggcagcctcatgctctgaggctgcaaagttaactggagctagcagagaacagatttcgacagtcattcacatgggcatggaaactaggtcgctaggggatttgctcatgctgactaccagcgcggcgacctgtaagaccaagaatagaaccagctcatatttctctatatattgtatactaagttacttgcatgaaacttggttcttttgctgcaggcttaaaaggagctaatgcctttaagatgcggaacagggcaataagcaattatgcctttgagaatctcatgagtaaccagaaagatgtccgacttcctattcgaacacctgatggtataatgcccaattaactcatcaatgacatgccacattcaattagattacttcattttccagggatacaagatgaatgcgaaaaaaaaaacactttcatttgtgtattcatgcagggaagatccatatcaggatggtttctgtgcactgcaagcatgacaagataatattgaacttaggaaaggagcatagtttgagaaccagtaaagaatgtgagcctcattttactatcctctttcttaagtgcaggaccattcaccataggcagtgcaaatctgaggtcttacctttgcttttaatatgtagctgtgctaaattgatttatccaattgtttaatcacccactttcttccagacataatttttgatgaacatggtgggacaacagacttcagctacccaacagatgaacatagctaccatgcaataaacctcgcaacatctggtggaaacatacagttattatttgaagaacatgaacaatacagcgcttggaagtcattcatcagatacctgataatcaacaagagatcaaggctatcctactgatacatgatgtacgaaaattcgacaatcagtagggactcatgctctacattccttacaaacccacacatttcttacgtgaacaataccaatgatcaacatcatgttatgggaagcaccatttgtgtggtggtggaacacatgactccatccacaaatatgattgtgtgtatccttagttggtgcagatcccggaagttatacttcctttgtccaaataaataaataataataatgtaatagaacttagtaatagttattccaccaaaatgcagtttattactaagatgtttggttgaatgatgagatccatcccctgaattatcatctcaacgtatttatgtatattttaagatcacagctagctggcaaaattcaactcagtaaacctgaactgagatgatcagacgggttccaaggccctacccctgccattctcacatattccattagcattaacatcacagcagtctttttacacatttgacaggacaattttggtgtgtttccaacttcagaactaaaaaaggcatgaattatttttgaaaggaagagtttctgtatttatttgaaacataagtatatttttgaaataagtatgtctgatttctatactttttagtggaagcaatagataaaacaattgcattcgctgtaaaccaccaacccatgagcaaaatcgtaagaaaaacaagcaattctacaagcagaataacatcacaagaccgacattaagaaggcaatagcacaaaaaaaaatcctacttacattttaatcaacgttgtaagctgaacttgcctaaacaaatataatgccgtgctccttaatggtgtcgatgacgatgccaagcttcccctcgatcctctcgttcttcttgggctcgtaggacatggcgaagacgtcggcgtccatggacctctcggcgatgaggcggccgatggtcctgcaggcgttgtcgtcgacgagggagggcagcgtggtcctgaggtccttggcgttggtgctggcgacggagatgaccttgctggtgcccctgtgcacgaccttggcgtggacgaagcgcttggagaagaagacgttgagcaggaacggccgcatgtacatgtccgtgcgctgcttccacgacttgcggttgggcctctcctccgcctccttccgcgaccgccgcgtccacgccgcgcgcaccaccagggacgcgcggttgctgggcacgggcggcggcgagagcgcgaggtgggcgatggaggcggaccacgagagcggcggcgacggccggagagagggcggaggtgcgcggcgcggggggagagtggcggcggtggggtacgcggcggcggcggccatgggagcgtgggggtttagacgaggtcgccttatcctgtacttacaccaattcttttaagagtaaatggcatatagggccacttctttttaccaatgtggtaagagtaaaagactaggaagtaggaacagccgagcagcccaacactttaaatttgaacccaaaaagattacatataagttttactttgggcaatttgcttcttccctatctttccctctcttccttgctctctgtcttcttgagc

SEQ ID NO: 64829 - DNA, 1520 bp, Oryza sativa
cgaacagacaattgttgttggaccaagttttctgaatggtattggggtggggaagaaaggattttattggcaacttactgccgatcccttagttttgttgcatactccaactaatgtttgcaaataagttaataaataggattggaccttgctacccgtattaaatggaatattttaacttctctagtctctcctgtagcttcaagagaaaaggaaaatgcagagtggggggacgttgcattatgacttgatttctcttgagactacattacccaataaaatggatggaaatatagttatatgggggtgaattagccaaactggcaatttttgtcaagtacaaagctttttagggaaatgaagtttgttaaagttgacgtggattagaattttcaaacaaattcctgtgattcctgttatagttttctttggattctgactgccaagtaaaaaagcttttctcccctcctatttgttatctgagcaacatgtggtaacactctaatgtagacaactgttatgtacctaccattttcaggacgacgaagattatgttgctaatgatgaaggaaaggtaccatgaacatcttcatctgtttttcccactgccttcatatttcccatatattctgcatcctatgactgtgtggcggtccttcaaaactagaaacatccattcatggattagttatcatttgcatcgatttagtctatctcactctttttgcggttttttcttatacagctataaactcatcttttttgacaggatgatgaagctactttgtctgaagaggaagagttggcgaagaaagaagactgtgatcctctagatgaggtgaatataagcattgaacatcattattattcaaaatttcacactgtgaagtttagccactctagttcctgatttgttgccagtagaataaacttgtcaataaaatacaatcgatttattatctgtgctatcacaactacttaaggttaatattttaatacgaaatatcttggtataacaactagatagtaattttgtggattccgatttaaactataccactttttgtgatacaataaacttgctctaggatggcaacacattcaaagtatccagttgaatattcgagtgtatacaacctaatttggcctagattgatgcaaaactattttcttgtctaaactaggactgatacaaaagacatactactatggtgtactagaggcacccttgtgcaatacatatttcttgtgacagttctggatcattggtattattattttttaatctgtaggttaagttactgcagaaagagagtgagatcccacttgaagaacttcttgcaagataccaaaaggtatctgctgaatttctatttctttcttcagttatgctttactgtggtccatttgtaatgccttttttatgtttaggatggctatgcagatgatgacacaacagaattggaaaattcacctgcactatcagttgaggatgtcaatgccaacatgcctgtggatga

SEQ ID NO: 64830 - DNA, 1430 bp, Oryza sativa
aaacagttgccacagaagcatgagcatgtcatatattgccgactttccagaaggcaaaggaacttgtatgaagatttcattgcagctcagagacacaggcaacattggcaagtggaaattattttggcatgattagcatcattatgcagcttagaaaggtttgtaaccatccagatctttttgaaggccgtccaattatcagctcttttgacatggcagggatcaacatgcaaatcagctcttctgttggcatggtccttgataaaggcccattttctcaggttgacctgtcagatatgaattttgtatttactcaaaatgaatataatatgacttcttgggaggaagatgaggttgctgccattttttctccaagcataaccctcaggggttctggcatttctcgctctactaatgatggtcagagaagcaatgggacaaatatttttgaagagattcacaattctttgtgggaggagagaataaaagaagctaatgaaagagcagcttccattgcatggtggaatagggtaagatgccagaagaggcctgtttatggcacaaatattcgggaggttttgaccataaagcatcctgtgtctgatattctcgagaagaagaagaaccctttatgccacatggaattttcatcaagcctagcaaatcttgttctatcatcggtggatcgcttcaagacaatgcttgattttattgagtcatttacttttgcaattcctgctgcacgagcgcctgcaccattattctggtgcaacaaagggaaatctcctgttcttattgaaccagcatacagagagaaatgcatgaatgagttttctcctgttttctctcctataaggcctgcgattgttcgccgtcaagtgtactttcctgacaggcgtttgatccagtttgactgtggaaagttgcaggaacttgctattttgttgaggcgtttgaagtcagaaggacacagggccttgatatttactcagatgactaagatgcttgatatactggaggagttcattaatctatatgggtatacgtatttgcggttagatggatcaacccagccagaagagaggcagacactgatgcagaggtttaatactaacccaaagttttttctttttatcttatccactcgtagtggtggtgtgggaatcaacctagtaggtgcagacactgtcattttctatgatagtgactggaatcctgcaatggaccaacaggcccaagacagatgccacaggataggtcaaactcgtgaagttcacatctatagactgatcagggagagcactatagaggagaatatactcaagaaagccaatcagaagcgagctcttgatgatctagtgatacaacgcggtagctacaatacagagttcttcaagaagcttgatcctatggaatcttttctgggcact

SEQ ID NO: 64831 - DNA, 977 bp, Oryza sativa
aaaaaagtcaaaaaagacaagaagaaggcagcgaagttcaaatctttgaagaaaggacgtttatcatctgagtcagaggttatggttgaggaaacatcagtagatactatgagcattgatgacaatgcaccctcaccagagctaatgagcgatgaatcagcacaccatcattctaacaagcataagaggataatgtcaaccaatgaggaagagaacagcaatagcagaagcctgaagaagctcaagaaagcccctaaatcgagtttcagttccgaggccttatcacctaagcattttcttgaaggcaagcagcttaagttgaaagatgaacttaatgattctgatcccaaatcgggggcaagaattaagagtgatggccgaatttctgtcccatgcatgccagtaaagcgtgtcatggtaatcaagcctgagagattgaagaagaagagcctatggtctcgcgattgtgcttcagactcgtggacaactgaggaagatgctgttctttgtgcaactgtaaatgagtacggccctctttgggaactggctagtgattctcttcattctgtaccaggtggtgcattttatagaggaagataccgtcaccctgtgcattgctgtgagagattccgggaattagtctgcaagcacatcttatcagcaacagacaattcaaacagtgagaaggttccttctgggactgggaaggctatcttgaaagtatctgaggtcagtttactcatgtcatctactccctccatccctaaataagtctagtttttagcataagaattcgtccctaaaagagtgtagttttagagtggtccactagcattagacctttttaataccacctacatccttttcttctcatttttagtcatcgaaccaatagtactccctcatcctactcactttctctccatataagagggcttagtagtctttgaccccttacctgtctttgactagctaaa

SEQ ID NO: 64832 - DNA, 8677 bp, Oryza sativa
  unsure (1)..(8677): unsure at all n locations
gttggatactataaataatattaataagcttcactatgggatattatggtcgcgtaaatgcaagacttaataagctagtaaaaagatgagcacacgtgcaggtacggttggatagtacaatttgattggtataccttgtaaacgaaaccgaaccctccnnnnnnnnnnnnnnnnnnnnnnnnnnnnnnnnnnnnnnnnnnngcgaaggagggttcggtatcgtttacaaggtataccaatcaaattgtactatccaaccgtacctgcacgtgtgctcatctttttactagcttattaagtcatgcatttacgcgaccataatatcccttagtgaagcatattaatattatttatagtaaccaactaaaataagtgtttgtagaacatactttgcaagaaacgtagttataacaataacatgtatattctgatttgtaatgtggccggttcacgtgtccgattataaactatgtactttatctgtccacaaatataattgatcctatgtacttcatctatccactttaacattgaggtggaattatttggtgttccaaaatcacacctatcgtttggaaattccatatttttgtagactgactgcgtagatgagaagtacaattttccaaatgacatccatgaatagagatgtgtacgtaaaatttagtggtgtccaattactttccattgataaagtataagtttcttgttattcgtacttgatgcagagatctaggattttttttattaactagctgggtggcccgcgcaattgcgcggctagcacctaaacaaaatcatatatttttttagtatgattttacttaaaatttattaaatagctatctcattgttttaagactttgaaagaccaaaccttatcatcctcatgtttataattatatagtttttaaaagtcacaccagttactacccctcatgtcttctccttctttattttcttgcttgatataccactatttctattcattcttcttggaacctttaaaaattggattttatagtttttagagtttattgtcacgttgggtttcatttttataatttctagatgtcccgtcaaacgttgccattatactcctctacggcccgtccactgtctcttctctttattgtcattgagattttaaaaatcgaacataattatcgtttgggttcatttttactttctagaagtcctgctaaaccatcagcggctttgccactgtactcctctacggctcgcccgctgcctcccttctttattgtcattgagatttgagattttaaaatcgaacatgattatcattggttttttttactttttagaagttccgaacctttaaaaattggagttgtaattttattttttataatttttagaagtcccatcaaacgatgccactatgcccctctacagcccgtatgctgcctactctttattgtcattatgattctaaaaatcaaacataactattattggaattcatttttttattttctagaagtcctgtcaaccgtcggcggctctgcaactatactcttatacaccctgcccgctgcttctcctttttattgtcactgagattttaaaaatcgaatatgatgatcaatgtgttttttttttactttatagaagtctcgacaaccgccttactcgtttgattcacggcctacctgatgttcctccttttaatcgtcattaggattctatttggtgttttattaacaatttttatatgtcgtatcaaccgcctccactctacttctttataggcatgttacttaatttatctcgtcacgtgttttagatagtcttttatttcaataatctttatttttatcacaaattttagttatttataaattgcattcctaattaaaatctttttttttctaatttcagaattttttaaaaaaaatttagttaataccgtattgtgttctttcgatgtttttattttttattttcaatttcagttgtttgaaaattatatttctacttgaactctcttttagttttctagttttggatattattttatttttttattctaaattttaattaatctcgtattgggtttttatatggattcttctttcaatattgcttatttttaattccgaatttcagctaattttaaattatatttcttcttgaactcttcttttattttcttttgctaatttcggatttatttatatttattccgaattttaattaatctcgtattgggttcttatatggactcttctttttaatattccttatttttaatttcgaatttcagctatttttaaattgtactcctacttggactcttatttccttttctaaatttggattttattttattttatttttatttcgaattttgattaatctcgtattggcttctttcaatattgcttatttttaattccgaattttagctatttttaaattgtatttttacttggactttcctttccttttcttattttggattttattttatttttatttcgaattttgattaatctcatattgggttcttatatggaaacttttttcaatattgcttatttttaattccgaatttcagctatttttaaattgtacttctacttggactctccttttctttttttctttttctctgattaatgtgggaatttctagctcccacagcgaacgtggtgcctcctttcaaagctattttaacaatataatagatagatgttgggatgtttaatatccccttttcacaagggatcaattagtgctattttatctttcaaaagaaaaccatataagaaataaatctcatatacatttatggaccataaaaaacaaatctcatataaattttacacccgtcagtcagtcagctaactcaattaactgggcataggcccaagctcggtgctgtagcatgtggttcaacttttttttctctttttctttatttctttgctctctagtgtctactattcctatctctttgctacattgaaggagcgtcggaaaattctaaaataccctctttcatctaaggctatcatttattttatctattttgtcactttgtgaatctgacggctaatattaatcagatgaatgtggctcatactagttgcattctgaggttcgcttttcactaatagagatttcatgatgaatacatatccataattccattattaatactacatatacatccacttgcacagggagttcttcccgaaggtcgagaaatagctgtaaaaaggctctcacaaagctccagacaggggatagaagagctgaaaactgagctagttttagttgctaaacttcggcacaagaaccttgtgagccttgttggtgtttgcttggaagaaggcgagaaactactggtgtacgagtacctgccaaataagagcctcgacaccattcttttcggtacagttcagttctctcactgccctaacagtttgcgaaaatggaacatttttttttccattacatgaaaaatctgcacgcacaactacactatagattcgaatgctgatttctttgtttgaatggaagattatgagaaaagcaaagatcttgactgggggaagaggctcaatattgtaagcggagtcgctcgaggcttgcaatatctccacgaagactctcaactgagggtagttcatcgagacctcaaagcaagcaacgtgctgctggacttcgatcacaacccaaagatttcagactttgggttagcgaaactgtttgagtgggatcagacgcaagacgtcaccagtcacatcgctggaacatagtaagtactaagtggacctgcaattccatcgcacggtagtatgaaagtataattaacgatcatctccttatttttcagtggatacatggcaccggaatacgccatgcgtgggcagtattcagtcaagtcggacgcgttcagttttggtgttctgatcatagagattgtcacgggaaggagaaacagcagcttctccaactcggagcaatccattgacctcttgagtcttgtgagcatcattaatctctgctcctcatcatcatcaccatgacctgatcaatcacgaaaaccatcttcttaatcgagacatcatcctgaagaatttatcctgattacgcatgtaggtatgggagcactggacaacggggacgatcgaggagctgctggatccggcgataggcagccgtgcagtgaacgttctgctgaagctgatcaacatcgggctgctctgcgtccaggacaacccggcggacaggccggcgatgtcggcggtgaacgtgatgctcagcagcgacacggtctccctccaggccccgtcgaggccaacgttctccattcaggagatggacggcgccgccgacacggatctctacgagtcgggagcgtacccccggagcgcgttccagcccaccggcgacggcaacacgagagcagcggcggcggcgtcgccgaatgagttgtcgctctcggagctggaaccaagatgagcgtttcgaatttggagcgatttgtgcggatgaccgcagggtttttcttcaataacgaaagaatcaacacgtgtggcctctgcacttgtttgtcgataataataaataaatgccctcgttgatggttggttggagctctgcatatagttgcaagattgttttttttaggcgggtcacggggggtaaaatgtccttctgaatatattacgtcaaacgattttacacaagacaaagcttcaaactacgcaagcgcagaaaccctggagaataagagaaaaaaacataggaaagacaaggaagagaaacacgacaggaacacaaccacccccgagggcacttgagccaccctaacaggactaagagagagagggggtgcatgatgtttttcactaacaagatcacaaaaccaaactcctaatctgagctaaagccaattcctaacttgacaacatctactctacactgcccgaaaaaaaaatctactctacacgcaaccttcaagcaccaggaattgagaattgccggaaggccattctcatctatagataaattactccatccatctcgtaatatggcattaacaatagtgcacttgacatattactaaacctatcttgatcctacgacactatctcacgtggctcgatcttttagtgaaggcataactaccccatacaattgctacacagtgttgtctttaagaatctggggcctgggctaaatataaagtgagaccttatatataatgtcgacgatgtgctagagctatgctaaaaatactcacctaactacttgaggtgacgacctggccaaatataagaaaaattttatgcacttattaggaatccttactgcttggaacacacattcacaatgttgttactttaaagagcatctttacggttcagcggtcgataccaaaatcctggccgttggatctggcccgatccaaaagctggtagagtttggtaccgcgaggtaccaattctgtccttggtgcagtacctcgtggagaacagaggtggaagggaaaaaaatgtaatttcgcgtgcaatgaatgggaggaatggacgggaaccctagaattcctcttccgcgtcgccgcctttctcttccgatcagctgccaccatgtcccttttccacgccgccaccgtgttcctcttccgccctgccgctgtcgtgtttctccttcagtgttgcaagatcggcctccgcaccatcagcgacagtggaggcagaggcggatgagccggcgacggagtatgtggttgcggcgaccgagaagccgctccggtggcggcagagtagaggaggactagctggtgccggagtaggccacgggtgaggcgcgatgaaggaggcggcggtgcacacgcgcgtggggaacaaagactgtggcgcgtgtggaaggatagtcatcgaccgagcgcaccctagcttattttctctcccgatcctacccttcccagattcaatggttggatgaatttccgtaccgaccgataccagtaccactcggtacattctgctggacgataaaaaatctctattttaaaagtagagtgaagagattttaaatatgccataacacattagcatagagtgaaacatacgggttttttgaaggccctaatatctagggtccaaacggtcgtttatcttgcacgtctcgagggacgggtcatatacacgtattcggtacaatctctaacatgcggcattccatatacaggtgtaattattctgattgctgtaatcgacatggacggtgtaactataataatatacaggtgggaacaatctttgcagagttacaaccagtatcaaactgagttacattctgcataaccactatgacacttccttttatctattctttattatagacaaacgagtgcagaggccatgacccatgagttgattctttagttattgagaagaagatcatgcagtcatctactcatctgcacaaatcgctccaacaaacactcatcttggctccagctcggtgagcgacacctcattcggcgacgccactgctctcgtcttgctgtcgccggtggaccgaagcgcgctcgagtagagatccgtgtcggcggcgctgtccgtctcctggatgcagaacgttggcctcgacggggcctggatggagaacgtctcgctgctgagcatcacgctcaccgccgacatcgtcggcctgtccgccgggttgtcctggacgcagagcagcccgatgttgatcagcttcagcagatcgtcagctgaacggccgcgcatcgccggatccagcagctcctcgatcgtccccgttgtccagtgctcccagacctgcatgcataatcaggataaatttgtcaggatgattttcaattaagaagatggttttcgtatcatgtttgattgatcaggtctcatggtaatgaggaggagcagagattaatgatgctcacaagactcaagaggtcaatggattgctccgagttggagaagctgctgtttctccttcccgtgacaatctctaggatcataactccgaaactgaacgcgtccgacttgactgaatactgcccacgcatggcgtactccggcgccatgtatccgctgaaaataataggagatgatcttgtaatgaacctgtacctactttcataataccgtgccatggaattgcaggggatatatatatacttactatgttccagcaatgtgactggtgacgtcttgcgtttgatcccactcaaacagtttcgctaacccaaagtccgagatctttgggttgtgatcgaagtccagcagcacgttgcttgctttgaggtcccgatgaactaccctcagttgagaatcttcgtggagatattgcaagcctcgagcgactccgcttacaatcttgagcctcttcccccaatcaagatctttgcttttctcataatcttccattcaaacacaaaggaaatcagcatcaagtcctatagtgtaatggtatgtatgcatgtatctctttcatgtatgaaaaagaggaacgcttcgatttcgcaaaggcagtgaggggattgtaccgaaaagaatggtgtcgaggctcttattcggcatgtattcgtacacaagtagtttctcatctccttccaagcaaacaccaacaaggctcacaaggttcttgtgccgaagttttgcgactaaaactagctcagttttcagttcttctatcccttgtcttgaactttgtgagagccttttcactgctatttcttgaccttcagaaagaactccctgtgtacagatgaatatatgggaaactattctaatccctcgaggggattttcctcgtttgctcaaaaaccatctaaacggttatgaaaaattctggaaaaatttgataacattcatacaacatatatatacaacttcacaaaatcttatccaaactcaactcacacgtcgagatataaaaaagacaaattcagcgtatgaatagtagtgcactgtttatatctaaatttgtctttttgtttctcgatgtgtagattgaatttgaacatgaattttggtggactagtaggtatcattatactctacattgtcaatttttttcagaatttttcacaactatttgcatcgaatttgaaagaaaaaggtatacgaggggatatccccttgagggattataatccactcccatgaatatatagataaacttgttaataatgaacacgaatgtattcactttctaataaaaagatgaacaagggttacatatggtttgatttgtaccttgtaaacggcaccaaaccctccttcgccaagcttatttctgtcagcgaagttgtctgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64833 - DNA, 4168 bp, Oryza sativa
  unsure (1)..(4168): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaaatagacttgagtagttaggtttgtacttgattcgtcctgattatatgattttgtaagagactactaagtacttccaaacatatggttacacaatctttaaatgcatcaaacaagatataaaggttcccaagacttctagcgggttctttattgggccccttttccctgatagggacaaatgggctttgagttaagcatgggttaatgttctacttcgtaagcaacataaccttgtcacaaatggttttattatgcttcatgtggtattgatgcattctttatgtagttaggtgcctggatgaagtgcaattgtaatttgtggattaacaaactaaggataatgttacgcaagtagtggcatttggacataatatttaaattgtaaatgaatgtagcacttaactgtcatgtaatatcttgttcttttattgctgtgtcgaggagcgatttgctcgctgaagttataagtgattctcaaattaataaattaatagctatctgacatggttctggagttttgcttcaaaggcttatgcctcaattttgttcctagatagttatattccagaatagcacactgcatatagaaagaaccaccattaacatctgttaccccctcagttttgcatggttaacttgaatgttttgatagtgctgatctctatagctctgttgaatgtttttgacttgcagttttccagaggatagaatgtaacatatagattttttttcagaatcctgtggtatctcattgttaaggaagttaattcttatgtaacaggtcacatgtttgatttccactttggtggcttgagagcatactctagttgtctgaatcaagttctctgaaagagagaccggagatgagagaggagggaggaattgcttctccggtacaatcattaaatctcttactttttctgtagactatttaaaatttgaaattatttgtaagtgcttgcggaaaatactctcattttttctgtgtctggcaaaaccagggcgaaaagcctattccgaatggtgcttccccaaatcatagccaatcacctaaaatttgctcaagaattacagataatgagactcaaggaactgcaacagcaaaatctttaaatgaaaagctagtgttggaaactgtgtcagatgattcttccacacagcattgtcagtcaccacagccagatgtcttcacaaatgtcaaagatgaagatatgcaagattctgtgaagagtttgagtgagaagcttgcttcagcccttttgactatcaatgctaaagatgacttggtgaagcagcatacaaaggttgcagaagaggctgttgcaggtaatctttcttttcactatgattttagacattttgcattattgtgatcccatgcatttattgagtctgtggcttcccttcattattcaaaattaattttatatgtgaggacatcaatagaactaagaaagaggaaactcattcaaatagttctttggcaaagttaaaatagtagtatcaaccaataattctgtttgtctgcacatgcgtgttagtgtgtgtggagtgagtgtgtcgtctgtctcctcagttgtaccttctcaagaaaatcatagttttatttattccaatatggaaccaaattcatattgaactttatttttgacttacttgtaggttgggaacaagctgaagctgaagttagtaccctgaagaggttactcgaagcttcaactcagaagaatgcctctttggatgatcaagtgaaccacctagatgatgctctcaaagaatgtgtcaggcagcttcgccaagctagggaagaacaagaggagaaaattcgtgatgcagttgctaagaagactcaagaattggattctcacaagtctgagctccagaaccatatttatgagctaaagcagcagctggaagccgctaaattagaagctgccactgtggctgtccagcatgatctgcaggataaacttcaggctgcagagaaggaaaacaagggcctgaagatcgagctgctcacgctagccaaggacttgaagagactgtcactggaaagagatctgagcaatgaagcagcagagacagcaagtaaacaacatttggaaagtgtgaaaaagattgcaagggttgaggcagaatgccgtaagctgcgccatctgacacgaagaacttccttggccaatgattctaggcctgcgcctaacaatgcttgcatggaatctctcactgatagccagtctgacagtggggagcgtatgctgactgttgacagtgaaatgagaaattctgattcatgggcctcggctctgatagccgaacttgatcagttcaagaacagtagtgccagctcaagagatgttgtaaacaatcatgttgagattgacctgatggatgatttccttgagatggaaaagctggctgcattgtctgaagtagaacgtgtaagctctagctttggaacagaaactgattctgaccaggctgtggctatagataaagcttcaaaagtcgaaactgaaacactaaagagccaggtcacagatttgcaggcaaaggttgaaaagcttgagactgagaaaagggatcttgaaatggcccttgcagaggctagagtccagcttgacgcgtcgtgtgatgccctgatggcagccaacaacaagttggcagaattacaaatgcagttcaacttggcaaatgagtctaaaattgctgctttgggacaagctgatcagttagatgctgagagaggatctttggcattgcagcttgagtcgaagtcaatagaagttgagaaacttcaggcagttgtggcttcgttggaagaaagtacagataagaaagagctggagtcacagttagagtcaacttctgtagagttagcggatctttgcaagacagtggcatccttgcaagagcagattgatgccgagagaactctgtctttgcagcacaaagcatatgcagacatggcagatgcagataaaaagtcactagaggcacaactgcagtccgcacatgcggatatcgggaaactgaggggatctattgaaacactggagagcgagttgcaaaaagagaaaaccatgtatgaagaacttgtggtccaaatggagtcaatgaagattgaatcagagaaaaaacttggcgtggaatctgccaaagaagcattggaggcacggctcctggtagtgaactcagaaattgcgaaactgcatggaacagtgaacgatctggagtgcgatgcagcaaaggagaaggcattttcttcggaactgaagatgcaactagaggcagtggaaggcatccgaaagatgttggagtctgagcttgagagttcacaccaggaaaccatgaagctccaggagaagatctcattgttggaagtaagacttaaggaccagactgcattgttggtagaattcactgccaaggccgaggatgcagcggtgggaaggaaggcaatggaaggccaacttgaaggagctaaactggaaatcacaaaacttacaaatagggtaagcttgctgcaaggtaagattgagcaggagaagctgctgtcagaggagtacgaagcaaaatgccgcaagttagaggctcagctgtcaagagacagtcgggaggcaaggctttggcgactggccaacacaaatggtgacctgaaggtcaagcaggtagtctttttatgctctctctgctgcatataaactggaaatttaaccacctcactgttataacactatagggcttaagagttgcaaacatcaggccaaaagtacaaggattctatctcctatggtccaatctacttgctagttgcttcgcttgaggttgtttggacatccaaatggccatttcttttgctaagtgtatgttataaaaattgctaaaatattgaacttgtaaactcttccaggg

SEQ ID NO: 64834 - DNA, 14158 bp, Oryza sativa
ggtcaatgatctaagcacacccaaaggatttacatacctgtattttagtttgtgcctaaggtccaatcagacctgtcagttgagaagtttctattaacaattcatcttctgtaacaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctcccaaggtgtacaagccggcgtcggaggtcatctcggcgccgacagcaacgagttctacatcagccccaacgtcaaaggttacaagctcttgctgaattttctgtccattttcatgtcaaagagcttttgcattcagaattcagaatttcagttcttggaagtgatttgtatgcttatgtctgatcatttttgttttattgctttcttcagctccacgggttgctgggcttctggtgaagatattcgcatgggttcttgaggcgccgatcatcggctcaatcgtgctctacatcctcaagagagacaatcttgtcaacaaggtagatgatcatcacttcttctgcttggcacagtaaaaaaacacaagttgaaatgttagctgaaacgctgtagattataatggcacttgaactgtgatcagattgtttggatgctgattagttgctgaaaatttcactgtagcttgtctcggatgccgaaatcccggagccaccactgttcactgcagctcacacctggcaaggtctgtcttctgttccttaccttttgggatttcggccctaccatttcgagccgtttttgtacttttgttcacagtagaattcacatttgaaaatcaaatttagattcagctagaacctgaaaatactgctgctcctgctgctgttgcttcattgcagacatccctgagcagaatgtgagcctgacgaagccagacatgtcgccggcagagcgcgttcaggaggccgtcgtctgcctcccggctcgcctcgaatcggtgctcgctgacccgccatcgccggggttcaggcgctggacaatccgggacttcaccagtgcctacatctcaggagagatcactcctgtcatggtaaaacatttagtacagttttactgacagtaatatgttcgtgtttaatggtttttgtatcagtagttcagtacaatgcaatgcattatgacaatgtgtagtgcattgggggtgtgaattactcactgaattttagtaggttagaggtattcttgttcatgaatgctacccaattagcttgtactgcattgctggcaggttgcgaggagatttctcgctgcagtgaaggagtgttcaggccctgatctgaacatggccttgttcatcagctgcaatcctcaggacgtcatcagacaggccgaggcatccaccctcagataccagcaaggtaaacaaaattaactacattttcagtgtacattatgccaaagaaccgtatcaacaaatcaaaatcaatgaatcattcgagcattaaacagtaattatatcatactagcagtactcagcaagtgcctcagtgtctagccttcatcaccattgacatttaggttcagagaatctgcagaaattaaactgtcataaccaccatgtttacttctgtatgctactaccaacttgcatgcttccggccatgagtttttacttgtagtactggtgaagaagtactactattactgccattgcagtctggaactgaccagctggatgaacagtatcagcagatgctttacaggaaggcattgtcagagcctgccaatgcacggactggtctctgaaagagatgtttccacaatgaaacaacacgcagcttgcagcagattcagggctcggactaatctgacatggagcaaaatgttcagacttcgaacagaaggggctttctgatgaaagattccatagaaatggcatcggcatcatcccctaatgatcatgcattgactagactagctctttgcttgcttgatcgaatctgaaagcattgcatggtcctgatccagcattgatagctcatagggacggttagttgccactgcatgtggttgcacgcagaggccaatactacattccttgcagggcctggcctgctgatctgttgcaattgaaggcatctcgttgtgctgatgcatctgttgttgcagtatctcatcgtttactctttgcattcatgcagcttttacctgatcgattgcatgcaccatttcatttcttggcttctgttaactgttaattgttcttggattatgtcaagtgtttgactgttcttgatgctaattaactgcaggagctcctctctctgccatggatggcgtcctggtggccgtcaaagacgagatcgactgcctgccatacccaacaacaggtaagaacatcacaagatcaggtatcatcaacggtgctaaggttgtcgaatcatatataagaacaggaggtaaaaagcaatcggaatcaggatttaatcagctgcaggacggtaggtagagctgctgccgccatggagaggaggccccggtacggtcggatgattctgatgacactgttcatcgccgtacacactgtccgtcgatcgtttgcttcttgcaaaatgagtgctgacaattggcatgtgtgttttggattgatactgttcatcaacagaagacgtgatccgatttgttgcaaaaagagagaaatcggtgcttttattttttaaattagctacagtaggctgtactaactcgtttttttgtaggggacaaaataaattattgcattggccatgctatgaaatactgtttgcaaattaaaaacattttttctgaagaaagagagtgtatgaatctgaagattctaactaatgtcaggaccaaatctatgtcgacatagcaaacatgataaataaagaccagttcagattactgtcaaaatgaatatttccaaaatttggcaataccaaaatttgataggttggcaacattgccgagttttggtatgataggctaaatgtgctgtcaattttttacacattaccaatatttgataacagactaaattcatccacatgtctgtcaattttaccccaaaatggtatggtttaaagtgagaccaatacgatactagggtaggccctaaatcatatatactagttttatatttaggggtggaaatgttatgtctgattggttgtactgtaccctgaaactgatcaaagacgcatatgaacaggaggaacgagatggctgcagaggatgcggccgtgcgtgcaggacgcggcggtggtggcgcagctgcgggcgtgcggcgcggtgctcgccggcaagaccaacatgcacgagctcggcgccggcaccagcggcatcaacccgcaccatgggtacgcatcacttgtcgtcgtcctgttcatcatccgcgcggtctccaaatcacaatttttttacccttttaccaatgggtttcttacctggtttgatggtttcagatcgacgaggaatccgtacaacaccggcaaggtggccggcggctcgtcgggcgggtccgccgccgtcgtctgcgccggcctctgccccgtcgcacttggagccgacggaggcggtaaacctactcaactcgtacatgcaaattgggaatttttctgaaccctaaaaacatcctgctctgacaatacaaaacattgtgttgctctggcttctgttatctgatcggatcatcagtacacgcaaaatgggtttttttttttaatctgaacaatgaaactgaaaatgtcttgctctgacaaacaaaacattgctgaactagcttgtgtgatacaaaacattcagaacataatgggaaagtgatttcatccgtcgaggggatatctcctcgtttcgtttatgtcacctaaatagttataattttttttaaaaaaaaattgtcaagatagattaatatgaaatataggagtatcactctacaaacatgcaagataaaattcaacttctatagattgtaacaaaaataataaatataaatacgaatgtatgataactattttcagtttaatttgttctttttgttgcaacttataggagtcgaatttggtcttgtatgtttgtggagtgatatatttcatattaatctatgttgtcaatttttttaaatttttttataactatttagatgtcatgcaaacaacgacggaagatgaaaatctatatccgaacataatgaatgatgtttggattgaattctgccaaatgtacgacaagaatatctgcatgcagtattgagttattgttttctttgtgcattttaatcaggatctgttcgcatgccagccgcgctctgcggtgtggtgggcttgaagccgacggcagggcgtttctccaaggatgggttcgtcatgctccacatatatgtacttttcattctacaagatcaatcactagccaaagtagccatagctgcaatggatgtgcattgttcagacacacctgacctgggctatttctgatctcaggcttcttcctcttaactggaccgtcgggatgccagggatcttagccgcgacagtggaggatgcgcttatcgcgttagtaatctctcttgtttcagaaactaatttagctctcagtgatcttgttacacttgattgtgtatatatgttgtaatgtactaaaagttttgtgttgctgtttatcattcagctatgcagctattgctgatcagtcccaaccaagccacttgcaggcaaatgctcgaactttgtattttctcttacacgtttggatgttcagtgagactgaatttgcagaagatttgatattttttgtttgtttgcagcctgaactgaatcttcccctgctgaaagctgcaagctcgatgcctaccatcagactagcaagatatgcaaaggtgagtgcttcaacactgtaataaaatcgtgtcatctgaaactgaacattgtactgatattcgccacaaaaacagtggttcaatgactgttctgaagacatcagaagttgctgctacaaagctgtccatacgctgcggactcgatacggttgggaggtagtaagaacaactctacgcttcatctaatcctgaagttaaacaatgcactcagtgacatgattttgaggaaatacactacagttcatgcaatctgacattttatttatttatttttgcaattgtttgtgctactatctgcaagactgctgatgtgacaattcctgaaattgaggagatgcggctcgcgcattacgtgacaatgggttcagaatgcaccgcctccttcgataagtatctgaagaagctgtaagcgtatcataaattttgtcatatgaaatcatttttcaggctgacatgcgtatgaattcaaaatgatgatcaattcattgtacactcaaaccatgctgatgcaggagcaagtctgagattggttgggatgtgaggatcgcgctgagcgcctacgggtcgttcagcagcagagcttacctgaactcgcaacgaatccggtgagctatcatatctaccattcttcagacattcattccaccatcaaacttagaacactatccactctgaactcgaaatgaatgaactcttctttttttgcaggaaccgtcagatgtacttccacgacaagatctttgagacattcgacgtgatcgtcacaccaatgacagggtacctatgcaatcttgcatggaaaaaatcactcaccactactactgagtgtagcagtgacagtttcagggcctaactgtgtacttcttgtacagagtgacagcgcacgaattgcaggacaacgcggggcacaccggagagctggactacataaacggaggtgattataactcaaccaatcacgagcaattaactgaagaaaaaagagttcagtttcagaataattaagctggcatctcactaactcgtcagtgttgcattgcattggatcgatgcagctgcgctggtgaggtactcgatcgccgggaacttcctggggttgccggcgatcaccgtgaaggttgggtacgacagggaagggctccccgtcgggctgcagttcatcgggaggccgtggtcggaggccacgctgctgcacctcgcctacgccatgcaggtcaccgatctgatgctggaaacgaactgatgttaattgttctttccaaatcctgcattgcatgtggggagtgaaatgtgtttaattatctacacagaagtgattatttttaattttttatatatttttttgcaggaggcgtgcggcaagaactacaggaagcccatggtgtactacgatctcctcaacaagaacaaatactagtttcagtttcaaaagaacaaatagtagctatatatgttgtgagagttgagtgacagtttgattctgagagatttggactggggagaaatttatcatcgatcattcttaccatcccaaatacagaatgtgatggacattattattgtaattgttgttatgtttgttgttgttgctgctgcttgacataagcatgcatgtaagtcatatgcatgtcgctgtatatgtttactattattgaatgtgcctactgatttactaaatatgatatttcatttcttttactctaaactactactacttactactagtacaattgtttttctcactcaactctcctaagaatatcggtggacaccaagcttagcttggtaaaattctgtgaaacacaaagtcgagtggaaatggtgaagggcccatgtggcctatgggccatggcccatcatccttcttggaggaaaattagacagcacttctggttcccggacgagcctggtccacatgtcatttactattgcacccctgtcaactttagaatttacagttagctcgttgatatcgtagcttttatggactagtatgtcctggggagataaattttctttcttatggactaatccaaaccagagtaaagataagatttatcttctcctaagacaactgtatataaaggggcaaggtgagacatttgagatttgcttatactcaatatcatatctataattaaaagagaacttcaccctatatcgttgtctacttctacaatgttgttgagggcagaggaaaaggcacaggtattctacattttctcacgtctctactgcggcgggagggacagagaatggatccggtgatctgctaatagacgtgttggtttacaacagtggcttcacaatctgtacatgtttgttgtggggtatatgggctccggttggatgaagaaatatctcaatcatccgttaagcaccttgattgtacttgtagttttcatgatctagttgaattcatggctttttcagcacaaagattgatatacttgatatgttgattttgagatgtttggtagcactctaaatccataatatgctatattagaaatttatggcttcctcaatacaaagattggatgacaaaatatctccaccaccgtcaaatcttaggagtacaatctgcattcatgtcgagaagagtcagatagatagttcacactcaacctgaatggagttatcaacatggttaatgccagggtgaattataaaaaacttcgcaaaaccccacgttgccttaatcttgaaatggcttaaatgatgactaacaaactattgtcttattatagttaggcggaagacaataggggagattgaggaggagatgacctacaagtggctttgcactgtattgtttttttcggctcccccatggccccaagacattatccatgagacaaccgaacaaacaagaagcatcaataccggtagcagaagcacacaccgtcgctcaccctgctaactgctttgtactagccgaccgccactagctgttgctaccgtatccttcatctagaccacccacgaattaactgaaaccaccgtcgtgtatgtcccataaaatggtctacttaggattatatacaagtacacatgttgatcatgaacatgaaattttgaatacaacaatggtatttgatcaaatttggataactttacattcatacacaagatataaaataatattgctataatatgttactcataagcatgaagataataatactagcactacaaaatgtcacttgatgaaaccacaattgatgttaacacataaatttcttcccttccaatctgaatgccctagattaacatggagaaaatttttatctgcagataacactaaaccggatccaaaatttcccataccaaggctgtgtttagttcatgtgtcaattttttttaagtatacggacacacatttaagctattaaatgtatactaataacaaaaaaaattggtcacgcgatttacatgcaaactgtgcaatttaatatacattattagtatattatcaaatcatggcgtaattaggctcaaaagattcgtcacgtgatttacatgcaaactgtgcaattgatttttttttcgtccacatttaatactctatgtatgtgtccaaacatttgatgtgacagaaaagttggaagttcgaagaaaaatatttgaatctaaacgaggcctgaatggaaataatcaaaaccgcaatgggctggcaaactgtcgatttcagataatttttttagtacggacaaactgcagggacctaaacgaaaaagaaagaaaaccgtgacgtcgctcgcttccagagatcttcagatcagatcagaaatccccaaaaaaaaaaaacacaacaaaaccaaacccgacagatcttctcttcttcctcctccctttcccatcttcgacgaggcgacccggcgcgagagaagaagagatcgatcgatcgatcaaccgatctcgccggagaaggaagaggagcaaagatgtcgtcggtgttcagcggcgatgagacggcgcccttcttcggcttcctcggcgccgcctccgccctcatcttctcatgtaatctccgccatccctcttcctcttcccccgatcaagcgattaggtgtagaaagctccagtttttccaatcaaagtcgccatctttttctttcccccatctggttgatcctgcgatttggttcgatggtgatggaggtccacgcccctccgattcgcgcgatctgtgacgccctgagtgtgaattttcttcttcgcgtggctagatttgacccgattggagatcggatttgtggggaaaaaaagttgggagctttggattctgttcttgatggggggatttgcttatttgctttcattcgatctgttgcaggcatgggtgcggcgtacgggacggcgaagagcggcgtcggcgtggcgtccatgggcgtgatgcgcccggagctcgtgatgaagtccatcgtgcccgtggtcatggctggtgtgctcggtatctacggcctcatcatcgccgtcatcatcagtacagggatcaaccccaaggctaagccgtactacctctttgacggctacgcgcatctgtcgtccgggctcgcctgtggcctcgccggtctcgctgccggaatggccatcggcatcgtcggtgatgctggtgtcaggtaaagatgctgcctgctttgttgatctgtgatgtagttagtgtgtatatgctgttactgctgtgcattggtgattaagtatggttttatgatggaagctacaggttgattaacaattctagaagactttctataggttgttttgctaccaaatatgattaagggatctgtatgtagtttttgtagcgctgtctgtttgataacttgtattcattgtgttcttgtattagcctagtagttaatcttgaactggtagtgagtagctgttacctacaaggttgtgcgtttcaatggcttcaaggctgtggaaatgaagaacaaagctcatataatccttatatggtatttctggatcctcctgtttgtaaatccttgtggtctggtaataagttataagtgccaaggctttataaattgttagtatttatttatggggggttctttcctcgtgggcacttcaatacgtagcatatactgaataatgatgttgttcttggtactgctctctggtattttttgctgaagttttaacttttaacaactgaaaaaatgtgctgtggtgtgaagagcaaacaagtggtcaaggtgttatgccttaaattttttcaacgatgtaatgctgagtagttgtgatttgaatgtaaataatctactttcacaattttagcacttaactggaatatgattccattcatgatggcaagtgtgttattgtataatcgtacatattgtttcttagaaattttgacgttagaaggttaattttgggatgatttattagattgtgatgttactatgatatcatatgatcgaaatgtgcttcactgcttttttggtgttcacctcggtgttcatgactaccctttgtgttgagagcttgaggctactcctaagctgcctactttggattacaattctgatatctcttgttggtgttggcagggcaaatgcacagcaaccaaagcttttcgtgggcatgatcctcatcctcattttcgcagaagcgcttgccctgtatggtctcattgtgggcatcatcctctcatcccgtgccggccaatctcgtgcagattaggcactttgcggtaccataccgctgttattccactggctatattcttgagaaaacctgaaacttacttgggagctctagtttaatgtattaaaagatcgatttgtagcttaaggaaggtggcacttccagtcctttttgtttcttttgtggtggttcatgcaaagttttttgggttaggctggatttgctgctcctgagcaaacggatttaatctcattcgtggtgaataaaaaacacggcattgtagcaaaataaaatcattacaatatattatgttcatcccttcactctaatgtattggattgcaaaaatcatcaatgctcctttttgttatgagttcaagtcatcattatatcatccgacttgtgtgataagctcatgtgttcattgagatgagtaggctaattactctcagatgttgctctaagaaaggtgatcttttcctcttgaatggccgttctgtacaatcgcaccaaatttcgtacgctgctagtgctcaaccaatctgtaactattgttgactcaattcattaccctattgcagcatctcttgtaccgaaaatctcagataacctctcaaagagctaagaaaatctcaggtaatttacaagaaacaaggccaataccacagaattccaaatctacctgttccccatttcaggaatgcttcttccaaatgcattgacctacatctgtttcatcgctacccactgatgccattgcaaaaacagtggtttttggatgtttcgaaactaggaaagaaaattttgttattgccacgagacagaactcgtgctgttgatttttcttcagtatcagaaaaacagaatgcagcggcaactttagctgtataacgccgcaaggtcatcctcgtacgccttcttgatggcctccctcttgagcttgagggcagccgtgacgagtcctgactctggggtccatggctccggcaccagcttgactttggctgggatctcaaacttctccagccgcgcttgcttggcagcctgaagaacaaacacacgtcagtacgatccaattgtcataagacttgcatgtcttgcattgatattacttaataagcttgctagattcaatttgttttgagattgttacggtgcgtgcaatgtggggttgcattgcatactgagagtgaaaaattggtatttggcatcgaccattcggaccgtacacatgatatctggttgagctcatgaatgtacatcctttttgcacgcaaaatatggagatatcgtcgcagattatgatcatatcaaattgcatattagtgtatgggttatattctctgtttactggaagattataatgtgttcttttcctgattctactgataacctatgaggtccaacatatcctccgttgttctcatattggtacggcaataccacattgccactctcaaaagagagaaaaatagaagagatcatgttttgctgaatcatccagggaatgcaatcattagtaaagtagtactagttaattttgatggaaatattgagggttaatggattgctagattaatcagatatatctaattaattaaaacgcagggagaatacacacctttgctaaacattgaaggacttctttgacagtctcttgcttctcacacaaatctgaaacatccgaatacgtgatgccttgttgtgaggcccagcttttcagttcactgtgtgcaactacaacaagtgcaacgcagtagttgtggaaggggtcagcatggatcatgatgttgtcaacatatgggcacacactcaaagcagcctccacctgtggttttataatagttagattacaatagctgactgccgctaatttggctggaaaaggaagcttagcttacctttcctaaagatacatattcaccatgttgaagcttgactatgtccttcttacggtcaataatttcaaggcaaccatctggatgcaaacgtccaatgtcaccagaatagaaccaccgcatgcctctttcatcatccttcaataaattggtgttgttaaagaaaagttatcatgggcttcacagcacagattgctttggcatattatcgtaacataccttgtagacttcatttgtttttgcctcattcttaaagtagccttttgtcacgtttggacctccaataactatttcaccccgaggcattggtgaatcattagttaaatatccaccttcagcccaatctatcaactatcatatacaattcatattacgttaggaaagaataagatctgagggataagatattaatcttctgaatctcaacatgaaggagaaaaccaaaataaactggatgggcataatacactaaatttcaaaatagatgttcttttttgagtgaagcgtgcaaaagattacatgcatagctttgtgtaaactagctatccacaatgtcactggactggctgtaaggctagtggtcaagtaaagctatccgcaattccacgcctcatgtcaaaaatttgaacacaaaagtttatctgtgatctctaatacgaagaaaaacaatatctttttgcacttagcggaaatctttcgtacatatgaatatatggaaatgaggatacaatttatatcacagtgataacatgcatggcaacaataactttactatggaaatgaggatacaatacaccc

SEQ ID NO: 64835 - DNA, 775 bp, Oryza sativa
atcccgtaaatcaggaaccatgcaagtattagatcatagatcgttaccactcgacgtgctgcgcagcagaagaagacgctgagaagtcgaaggaactctcgcgaagtagcgcgcgtcgatgtagaggaagtagtcgatcgcaccggctcgaccttctcctcgtgcgttctcctcaccgtacttccacgccgatcagcaccgcaaaccagcggcgcctctaccggtatccacacgcatagggacggaacgccacgcgtagatgtgctagcatgcacgcgcggctagggttttgctcgggaagggaagtgacggctagggtttctcacgtgatgcaatgcctccgccggtcacacccctcacgaatatataggatccatcactcgggcctctaaggcccgtaggactcctattcggatccctatccgaattaagctcatattgggtctctatccaatccccttattccggcccattaagcttgcgaccctgtaggttcatatatactcggttgtaacctaaaaactcattttcggtccacgcgtcaacagcggcccctagcagaacgtattgacccaccgggtatacataaagatcatatcggctgaacctctagtgtatacttgtatgaacccctttgcctcacgatatcgattgagctcaaggctaaatatgtgacattctctaatagctcaatcattcactcgaacttgttgatagattatataacttgtgattgactcctcaatcacctttggcatggccatgcacttccata

SEQ ID NO: 64836 - DNA, 873 bp, Oryza sativa
tggtttggattttagatgtgattaagtagcctcaactggtttggtgaactgtgtataatggagatggggtgggttggatttggattggatttctgcccattagcaggctgtgacaagtcgattgactggacgaggaatagtaaccctgcacattgtgaagttcagatgatgttgcgagggtccattttcagcttataggtttatgttagcagaccagaccatgtcgcactgaattgccatttggcttacaaaaagtgggcaatgattaattatctattagtaatgtgttaaccaggatagaatctcattatggtgttggctttatatctttggtcgaaaaaaaaggggatataatctcatatttttctttttcataccatattgagttttgcaagggttttgtgcaccgaggattagtttagattaccagaaatcaaattaatgagaggataatttagaactccatagaattcatctgaaaatcatgcaaatttcatgtaaaacttgtgttccaaattgaccttgagccccgctcacacacgccctgccgtgcacgtcgtgatacctgtttttacctgtcaaaccattcactttcctgtcatttcggcctatatcggcctctatggtttccaaattccaagtctcctgccataaccaaatagcccccgattggccaatcatttagtgatcgtctatgttggttgacttgactcggtacaaggtaagctggaaacacatgaacagtagtgcaaggtaggagcacgaaacacccagcctcgcggttgcggtctccggcgagtctagtattcgggagtctagttttggggtgaattcaattgaggttgctacagtttaatttgtttattttatcaa

SEQ ID NO: 64837 - DNA, 742 bp, Oryza sativa
tctttggacttccatcttctacttagaataagcctgttaatcatgtaacccttttctagtcatttatagttctatgttattttgtttttcacaagtcctgttgaaattcatcacaaatgccagatccctgcaaacctggactggtttgggtggtgcacttgggatgctttttataaatctgtcaacccagtgggaattgaagagggccttaaaaggtacaaatgaatcgatcttacttatgtgatattcgaaaacaattgaaaggtcttttttattacccgcatcctccatttgtcaattcctgataaagcatttcttgttgtatagtttgtgtgaaggaggtgcaccaccaaggtttctaattatagacgatggctggcaagaaaccgttaacggattcaaggaagtggatgaggcctttattgaacagactgtgttagcgtctaaccatttttcaacttgctgatcggtccatgaagtatattaaattcctgtttaacaaagaaaatttactccaggaaatggacgtttgagtatttgatttcatattaaataaacaccaatacattttgaaatctctccttatctgtttgtgaaagagaatctagatccaccaacatagactgtatactttttctttattgtgagatttcctatccaatttccttttttttttcccctgaaactgtaaatcactgtcataacctcatattatatctatacacataaaaagtgggggatc

SEQ ID NO: 64838 - DNA, 1407 bp, Oryza sativa
tagcataacatgaagaacataagcgaaatacaacagtataattgatttctcaactaagtgagaatatcaatatggttaagctgaagcagttcaatgttcaacaaaatcagtttttcatgagagaatgtaaatgacttcttatatactcagctgtgtcattaatttgatcatttttgtcttgtcatatctatctagatagcacatagttccttttgttctcatgagcgcatttcactttatatatgcaaggatggtgatggaacattgtgaaaaggacaggttgagacacttcaagaacagtccgcatcatgtaaattcaaaccttttatgtacacacaaaaaaactatggaagttataggagcgcgtgggtagagaaagctacctgcaatgcaatctgccactcggcccgtgtatcggcgaaaatagcaacacgctcatccctctggtgcccaattcgcactaaaccagatgagaagttgcagacagtcttgaatgcatcagcatagcttttccactcatactgccccaaatgaagcttctcaaaggacctcccatcgcgggctgcctccatttccctcgaaatgagctttctggtgccaaggagtggcatgtagacatactgctcgcaggactgctcaaacagctccgcaagcgtggaaaccccttcccagtgcgtttcaacgggccgctcgaacttgtggttacggatcacatagccgggctctccgcccacatcaaccggcactccccttttcttttcacccttcctcttggtgaacagcagagatgccagaaaagggatagcgaagccgatgaaataaggattcatatttcccagccttacacaaagctactagtccgcggagtgtcggcactgatctgcaattgacttttcaagtgataaacctgaaatgataatgtagctacattatcagatatttatcgcgtattaacagacacagatacataaaaggggaaggcattgctatccagtggtctacaatcaattagaattagaatcctccccccaaacaaacgagttttgaattcctccccagatgcagaaaatgttactagtcggactcctctcctctggagcaactcgttcgcagcgagcggagctattcaaatctaacgtagtagtccactccatcctacaagatcctctagtcgagaaaaacccactgcggcattgctctacaagatcctactagttgccttgcagagacaccaccaaatcaaaccagcggacggatcagaccccacccccgcctactggatgctgctgtggaagcttctagaaggtaatgcagggaactagtagtagtagcagtagctacctgtgtcactcaccggcggaggaggcggcctccgggagaggcagaggaggaggagagtgcaatggc

SEQ ID NO: 64839 - DNA, 11522 bp, Oryza sativa
taaggcagccacgttggctataacctatggcaggagcgttcatttggttttacggttgtttaaagaaaaccgcccgcgtccattgcttatcaacggaggagagtcgatcatccttggtgggcaaggattttgaggcggttatgtgcggcttgccttaaaagctctgtttttttccatttgtaccaaatgcctctcgtgccttagcaaagtaggagtagaatttttcttacttaagatttaaacgtgtccttaagaaaccatgtggagaggaaaccatcgatatgagaatttatagttcaaactggattagacgtgtatcgataaaacaattgagacacaaggtgcttttttagttacaagtttagtagcaaatgtattcgacccgattattgaagcgggcccaataaaacaaacataatggcaagaaactcgactaatagagtgacaaagggtgtgtttagttcacgccaaaattaaaagtttggttgaaattgaaatgatgtgacgaaaaagttggaagtttgtgtgtgtagaaaaattttgtgtgatgaaaaagttaaaagtttaaagaaaaagtttggaactaaataagagcaaacatcaaatccctttatcttattgttcttatcaccggtctcctaaatgtaatttctacctactagaaaccacaaatccctttcatcaatagggcgtgatgtcaagagattggctctctcttttccaatgctaactccaaaccaaccaaaggaaatcctgctggaaatgccactgcctctaagaaaattatcccatgagaaaaataaactaacgtaaacgacaacaattaaatatcatcgaattgtgtcattggccttgtttagattctaacttttctgtcacatcgttccaatttctttaaacttttaattttagcgtggaactaaacacaacaattatttgctcatcttcctgttttagtacttagaccatgatgtgaaaacacaaatatagttttcgatcagattaacataggcgtagcaattaaacagagcggagccacaaaactatttgataacctaaactgaattttaaagtttgaaggtttaaccatcaaatgtgaattcccttcaacctcctcaaaccaaacttgtaccaaaaaactcaccacacttttgtacaaacccttgtgcatcacatcacagcaatgccgtgcatcagacagcttaaagatcaatctacatgcatgcagagcaaccatgccaaaggcatcacctttcctctccctcctcctcctcctcctgatcaccatctacattgcccatggcgccgccggtgacgccatcggcggcgacccatggcaggagcccgaggtggcccagcagccagccgtcgtcctcgccggcgagtggcagctcctgcaccagaacaccggcgtctcggcgatgcacatgcagctgctccccggcgactacgtcctcatgttcgaccgcaccgactccggcccctccaacatctccctcgacgcgctctcgccgtgcgccgccgcggcgaccaccgccctcgccgccggcggcggcggcgccgttgactgcaccgcgcactcggtgctgctcgacctccggtcgaacgccctgcggccgtacccgctcgccaccaacccatggtgttcgtccgcggcgctgctccccaatggcacgctgctgcagaccggtgggttctccaatggcgaccgcatcgcgcgcctcttctcgccgtcgacggggtgggtcgatctcccgtcgttcttggccgtccggcgtggtacgccaccgacatcctcctcgccgacggccgcgtgctcatcctcggcggccggcggcagttcaacttcgagttcttcccccacgacgacgcgccggcgccgcagccgaccttgttcccgttcttggaggagacgaccgacatggacgccgaggacaacctctacccgttcctccacctcctccccgacgccaccgtcttcgtcttcgccaacgaccgcgccgtcgtgttcgacccctacaaccgcgccccgctccgccgcctccccgccatccccggcggcgtgccgaggaactacccgtcgtcgggatcctccgtcctcctcccgctccggccggactcgccgtcgcacgccgaggtgctcgtctgcggcggcgcgccgcgcggcgcgtaccgcctcgccctccgcaacggcacgttcgccccggccgaccggacctgcggccggatcgcgccgaccgacgcgaacccggtgtgggcgatggaggagatgccgctgccgcgcgccatgggcgacatggtgctgctccccaccggcgacgtgctcatcgtcaacggcgcggcggccggcacggcggggtgggagctcgggcgcgagccggtcacctacccggtgctgtacaagccggacatgcagctcggcgcgcggttcgaggtgctcgccgcgtcaaccatcccgaggatgtaccactcgtcggcgacgctggacacgctcggccgcgtgctcgtcggcggcagcaacccgcacgtcggctacgtgttcgacaacgtgacgtacccgacagagctcagcctggaggcgttcctaccaccatacttcgacgcacggctcgacggcgtgcggccgcggctggtggcggcgccgtcggaggtcgggtacggggaggcggcggcggtgaggttcgaggtgcccggcggcgcggtctccggtggccccgaggaggtgcgcgtggcggccgtggcgccggcgttcgcgacgcactccttcgggatgaaccagagggtggtgtccctggccgtgggcaccgtcgcgcagctggccgccgggctgtacgaggcgcaggtggccgcgccgccgtcgccgtcggtggcgccgccggggtactacctctggttcgtgctccacgccggcgtgcccagcaccgcggcatgggtgcgcatgcggccgctcggtgcagcgacgtgatgacgacgacgacgtcgacgtgtgaaccagtcaactgccacgtctcactatttttctctctcaaaaaaaatgaaaagaaaaagaaatggtcaactaccacctactagtagtactagtaataacacctcgggcttgtggtttatttacaaaagagcccatggagaagtaggcgagacgcagaaaggtccctcgattcgagagctgtggagagagatcgcccaaatctcatctcgctttcctctctctctcgccgccggcgatgcctccgtccccgtccgccgccggggcggcctcgccgtcgaactcttcggcggcgtccgcatccgaccccaccccgtcctggtgggagtcggtctcgcaggcgaggtcccgcatcctggcgctgtcgtccatcctcccggcgccggccgattccgacgtcgcggcgctcgccgactccgaccgcccggcgcgcgcgctgctccggtcgtccgccgcgtacgtcgcgctgtccgcggcgctccggtcggggggcggcgccgacgacccggcctgccactggctctacgatacgctgctgtccccggaccccgacctccgcctcgccgcgctcgcgttcctcccgctcctctcgtcgctctacctcctccgcctgccgcccgcgctcccctcctcgctctccggcttcgaggccgtcctcctcgccgtctactcctccgaggccaagaatcgccagggcaagcccgtccttgtccaggtacccgacctctccgtcccttccctctaccacacgccgctgtccagccccagctcgaagtcccctcgccggccacagccgccgccgatccccccacccgcggggaatgttgtggtcggggtgctatcgccgccgcttgagccacaggcggcggtgaagtcgaccaagcgcgcggggattatcggagttgccttcgaggcgtactatgccaagatttcgcagatgccgcctgcatcgaaggtggatgcttgcaacgccgtggcggcgtgggcggggcagtactgcaagtgccgatttgagcttgatgagaaggagttggaagaggaggaggctgattcattggggtccgtttcgccattgtcatcggaggccgagaacgggaaggccttggaggaggaaatggcaaagatgcgcgtcaacggagacaccaatggtcggaattgtggcgagagagaggggagggtgccacttccatgggagcttctacagccagtgatgagagttcttggtcactgcctgttagctccgctgaatccgacggaggtgcgggataccgccgcagaagctgtgcgggttgtctatgcccgcgcgtgtcatgagcttgtgccacaggctatcttggcgtcccgtagcttgatcgagctcgacaaaagcgcacgcaaggctgccaaggaggcagctgcagcagcttctggggcaatcgtgtcagtaggcacagctggtagcaccgcgtcgagctctagacccagctccaagccaaacacaccaggcaagcagcggaagcctgatgtactgctcctgtcaaaatgattctgattgcattacatcttgtaagattttctgcagtggtgataaaagagttcatttttctcatgagtttgtcactggaatttcattgaagtctactaaaccttgcaatgcgtaaaggtcgactcttgtggcttggaaaagcattggtttagtatgtagccagttctgtattgtaagttatcttgtcttatgttattgtttttgcatatagctgatgaattaatatatttcacatttatgtgtgcggttgatgaaaagaacatggtgtagtgtgctatctactactagtaatggattttagcaggcgattatgtattgacttgttttatgcatttcttaccgaacatatattaatttgatgttccttactacaactactatcttatggaattctcagcagcataaattgcaatgatttgtgtcttgatgtgtcccttggttttgaaagagtccattaattgatatttcatatagtcacatacctaagttgatgtttatttaaccaaatatggttagaatgaaaagcgattaaagagtcacttgtgatcgtccctgtcattgtttgtcttaatgttctaccgaaaaaggggaaagaaaggaaatgaatagaaagaagcaatattgacaatggaaagcatcaaagacctactaattgcctgtttgctttgagcctttgatcatatgaactgcaataagtttatttctttactataataacagcggctatttatttggtttttgctgtatgtatggagttcattagtagtcgggctagtgctaaactgctaatgcattccaggcgcagggcattgctgttgatctgttctctctcactaggtgatattgctgtagagttgtagaaagggtttacccccttcaatatctctctgtttttaagaggagttcccagttagtaatttgagatgtgcaaacgatgttactgattcttagacttaagctcaagtaatacaagtgaaatgcgttaggatgcgatgttcagttcaccgaaatattcttgacatctgtatttgagcttaggaaatggaatatggtataatattaacattatgattgctggcgctgactaagcatgtactcttttatgtttgttgtgtcatgagcatttggattgttgggcttggatgcaggcatgccaatttgcgtctctggtgctcaatatgcagaaacctgaacatgttcggtagagttacttgttgcatatagttcactaactaataatactatatggtatgactgttgtttggtttgattccaacaacaaagtatttgaacaattcatttggcctcattttccaccgttgattatatcttttgtatgaaggtgtgctcttttttcctctcctagtctcagggtatgggtaacaacactgatgaaatatagttatctgcatgattgccatttcatagttcacactgaattcaaatatgcagttggaggcttggagcaggttaatagtgctcccccaaggcagcttgtgagctgtgacagtttggatagaattattctgcatctttgacagttgtcatatgtaacttttttttttttgcataaccatggatctgaatttctgctcacaactgaacttctggtgttgttgatctgttacataagtttccaaagttgcatcctttacatacagcaggtcgttctactactcccacagtatcatgtcatccacaattaaaaaaaattggcaaaggcaactgaatattctcatgttctaggtaacctgcaatcctgcatgtttcttgagagcaaaagcatgggatagttcatgaatgttttgcagtacacaccggccaggaaacaaactggcaaagcattatgcttctctcgtaacctttgatttaggccctctttgtttagacttaggcttattggactagacttttaagtcagcttattggcttatatgatttataagccagtggatttaatgtcctaagtttagtggtggagtcatacatctatctcatataagccaaaaaagcttttccaacctagcttttggcttaatagtgttagagtggtttatggcttcaaaaaagccaaatgaaaaagctgcttgtttgttttggcttagactttttgatttataagttggcttataagcctaaacaaagaggaccttagtataacagcagacatggaagttatctgctactagtttctactcgaaaatatgcattgttgaacctgaaatagtattattttcccataagtaagcagctcaaatctctttattgtttttatctaaaaaaaactctatattgcttggagttgtttaattggaaccatacaacgtttgctttcaagcttaatctcagaataaacagtgcagacagcacacgtggttcggtgggaatgtgattgtggacttcaataactcgcagatgatttagatgggctgggcccattatgctaccagcgaaatgtatgcaggtcaagcgctgtcgattagtaccacctcgccagttttggtggagcgggagctacttataaactggagcttggaggcttggggcacgaccttacttgaacaggatctgttctataggctcgtaccgttgcatcctttaccaataaggaggcaagcactctagtctggttgatgggtccatgacctctgggccagagcgtgattaacggcttggatggatctctggaaggaaccatctgacggctgtagaggatcgttcctgactggtggtaccagtgcagggtggcgcagaggtggtctgacagacccccaattttttttttgtctttctttctgtattctactttcgataatttttcatcttttgcattcttactttcaagaatttgtttatcaccaattcacatacagactcctaccttttcttttgctggacaaaaacacaaactttctatgcttacttaggccgtgtttagttctttctattaaacgtacactaataacaaagcaattacagattttacctgtaaactgcgagacatttattaagtctaaataattcgtcattagcaaatgtttactatagtatcatattgtcagatcatggcgcaattagtctcaaaagattcgtctcgtaatttgcatgtaaactgtgtaattggttttttccgtctacatttaatgcttcatagatgtgtctaaacatttgatatgacatttttgaccaaaattttttgggatctaaacacacccttaaaagagctgcgtaaaaatattgttttagaggaaaaccacctactccttctgtcctataaaatactaacttctggggatgaatctgaataaacatatgtccagattcatttctagaagttgtcttttttggacggatgttgtacgtatgatcatgacgtcttgtttgcaccatatattaattatcactaattaattactaatgattaaaattagcgaagattggcgaatgatagcctcatccagccaaattttcctgcagagctcatccaatttcttcgtgcaatttttcaacatgttcatgccatgatcatttttttaaaagggtataactcaggatgcacactaacacacaccacactcacaccacaacacacgcatacacacgcgtgcgcgtcccctaacacatgcaatgatcatttggatgtgatcttccagcttcctgaatatcaatatgttcaacagtgcaaatgtgctatcatcatcagtttctttatgtttcctgatcactgctttacattactctccaataaccttgacgatttcgtcagaaaaaggccatgcaacatcgtgtactagattgggcccagcccatcagtttctgacagattgggccttgaccgccgtgtctggcccattatgcggacaactagcccagcccatttaatcttgaccgctagaaattgtagcgacccaagtcagggttcatcataccgcccgtaaccgcgtggttaccgtggttaccgagcttaccgcggggatacggtaacgtaaataccgcggtaacctccttaaattcaaataaatttaaaaaataatttaaatttttgatgaaatttgcatggttttgtacggtttttcacggttaccgcggttaccgcgcgataaccgtgtttactgtcggggcgtggtaaccctggcccggcggtttggaaacctggacccaactcgatcgccatctctctctctctctgaaaaaaaaaaaccgatcgccaccacgtcgcttcaaccccacaaccctcggaaaccctaaccccatcatccgcagcctcgtagccctaccgccatggccgacccaccctcctcctcctcctcctcctgctgctgcttcgtgttcagctccaatgataggttttacgccccgcctcacctccggcgcctcctgcggcagcagcagcagatgcaggggcagccgccgtcttctccatcgccggcaacgcacaaggaagcggaggatggacgggtggaggccggtgtctccccgtcgaagccgtcggtgtcggcgccgccggcggaggtggttactgctccggtgatgtcggcacaccgagagatatgatgttgccgtaagcagttccgcgacaggagaggtgcaaattttttttaaaaaagaaaaatcttacgggttgcacctcgattttgttatgattgggaaaggttgtgtttacgaagaaatatttattgtatctttactactagtaaatgccactccttccattctaaaatgtacacgtttttcaaatacttttttgaaaaacttacataaatcatatgttttgaaatgggtagtgttccttagttgaggttccttagtattcattagcgcatgattaattaaattaattaaaaacttgaaaaatagattaatatgatttttttaaaacaacttttctatagaaactttttttttaaaaaatactactcccgtcccaaattagatgccatttaacttttttcttctaacgttgaccattcgtcttatttaaaaaaattagtgcaaatataaaaaagataagtcatacttaaaacttttgataataaagtaagtcacaaacaaaataaataataatttcataatcttttgaataatactaatgttcaacgttagaaaaaaacttaaatcatcttttgaataagactaatgttcaacgttaggaaaaaacttaaatcatacttaaaagtacttttgataataaagcaagtcataaataaaataaataataatttcataattttttgaataagacaaatgattaaacgttacaaacaagaacttaaagcaacaagtattttaggacggaggtagtactgtttaactgtttgaaaaacgtacgcttgaaaaacgagggagtgaagttggaaatgtgttgcaaaaacacaatctaggtagttcaagcaaatctgaggggacatacagttaatttatgatatccgatacttaacaataccgtgggtcaccgaaattccgtaacgaattttgggcatattttgctactaatgtttttttcagccggtagaacattcaccatgacccaccgaaattttggaggtttcttccgaatgttaaccctgataccgtctgctcaggttgattacctgcatcagttgtgcttgaggttcttgtactgctgttgaaatgacaaatcactggcgcattgtaaaaccaccacgccttcttgataatatatcatttggattttggagctttcaataatttagaactgtacttgcttggggggggggggagggggggtgttgacattttagatagtccactgttagctccaatttatttatagccaatctaatagccaatttatacaatagttgcttgctatactattaatatatagtcccaccagtcatacacacactgcgtcttggagtccatgctgtagctggttacagatctgtagtccgctgctctctctcatcttttatctcattaaaatatgtttatagctggctaataggctgctattgtacctgctcttatatgtagcatttcttcagtagttcttatagcaataacgtacttcctccgtttcataatgtaagtcgtatttatatatatgttaatgaatctagacatatgaatatgttgttaatgaatttagacacacatatatctagattcattaatatctatatgaatgtgcgcaatgttaaaaagacttgtattatgaaacgaaggaagtaacagcttataaggacaaaatgctgttacattgctataagaaatactgaagaaacacatttcagttatatggttacaatttatgctaccgtttgtttctgaagcagagtttgatttttcagcaatcggccggcgtgctccatggatggtgattgtgtttagtcaggctctggtgagaggaggatcttgctggcctcatcatcattgagcgttgctgacatttttgtgttgcgatctttctggccctcagtttttattctgtaacccagtatacatgagcaagacagtcactcaacctatctattttatctaattatctatatttgtgtgataaaaaaaatttataacacagcctatatatatatacaaattattgcaaattttcccgtggatctgagactccttttgattcgacacgtgtcatgccacgtcactctagaatgtggttgacctggcaattttagacttttaatggtacatttatagcctcaaaatctgttttttcttagattaagagttgggctaatatgctgtactcctcatctgaccaaatttcccaactcacaaggatgtcgatttttttttcaccactaggaattttgatacccactggtatccaatgtagcctgcaataccaggcatcttagctcaataatccatggcatatggtaattttgtgagttgtgacaaacaattgtacggcaaaagacaactagttaagcactagctgatgcaagttcctgaaccaattgatgtgaattgcagataactaggtaagacaatcattttagatctactgcagactgtgacttctttaaa

SEQ ID NO: 64840 - DNA, 11446 bp, Oryza sativa
tctttaagctttcgtgacaaatgacattcttgctgtaaaattgtctgttgacgtttgtccagttttgcagtgaacagatcagaggccacgataatgctagattaacaaattgttgatgaacaatcttgaatctggtgaatgtgtgctctctttgtttggaatcagtttgtgcaacttgtcgtccacaagcagacaacctcagaatatgattgactaaaatacaggtataatcaccatcgcctctactgcttagctcttaacctatattggttagaggaatttatatttgtagagctgcacaattaagaagcagcatttgctagggatctgtactatacttgcatttagtaatatattgagttggatgtagctggatgcagggtaggaatagtataacatttagcagttcattgcttcttccaaagtagctgtttgttcttagccttttgtctaagtagatgcttcttccaagaacccaaagtgttcatgggtgtaagcatctaatgtttgctcagcacacatggacaaaaactctgcattgacaatggttttgtacttctgttagatcttggaagcaagcaaaatcactgtttttggtgtctatctcatggccttgttcccatcttgtacctgcttttcaaacatgtcaaatttgaatgacacttgagagcaactgtgacacaagagagatttgcactttgcaggcagtttttttttttccatttttgcattatgatctgacttgatgaacatgaagtaagtaaacatactacaacctacaacagagaaagaaactagattaagaacagtggcaaaatcaagctattctactggttttctttgatctagtagccactgtatatgacaacaaagcaaggaagtatagctctgggactgaacacgaacagttcatccaaatctgagtaaaccccttctgagcaggggctgacagagtcacagtcatgatcctctgaagaattgctgctgtggagcttcttcactctgccggcgaccaccctgcacaccagcatcgccctcttctcgccgtccggcgaaacctccgccgtgtcgtgcgcccgcccgctcgtcgccatcgtcgtgatcctcccattgccatccaccctgatgaattttttttttgttcatcaatcaaaccaaacaacttataattcaacaaaatgttcttcataaatcttttaaatgacacccattgtctcactgacgtgtgggatcggatccatattgtcagtaaaatacacattaacctattacgaaatactccatccatcctatgataccgttgacttttcatataacatctgaacattcgtctaagaattatatagatattatgtattttgttttgttattaaagaaactataatcttaacatatacttttatatatctatactaaatttttaaataatatgaacagtcaaacgttatacaaaaattaaagacatcaagcattttgaaacggaggtagtatgaatttgtgaaaaaaagaattatgggctctgaacatcttggtcgagttacctgaatccgtctttgatgatgctgcagagcttgcagtgcagcggcggcggcgacgaggaggcgcagcagagggcggtgccgccggcgaggccgagggagcaggcgaaggtggtgcagtggaacctgaggagctcgttgccgtcggcgacgcacctggggttcctcccggcctcgtcgccggcgctcctcgccttctccttcaccgcctccttgtgctgctcgaacctcttgatggtcttgtccgagctctgcaccttgagtatcctctcgatcctgcacaccggcgcgttcttcttcagccagctcgactggaagatgatctccacgatgttcctgctcgtgtcgtccgccccgagctctgaaactgcaatcccaatcgaatcaatggatggattgttagtttttagatgagaagattcagtgggatgtggattttctatctctcgagagacatcctctcgttatttccatgttattctaaatagttattaaattttttaaaaagtttaatagattaatacgaaatatatcatccacaaacatgtaaaaccaaattcattttctacaagttgaaaaaaataaattaaactaaaaatagttactatacactcgcagctatattagctatatttgttatttttattataacttgtagaagttaaatttaaaattgtatattagtggagtgatatatttcatattaatcaatgttgccaaattttttttaaatttttttatgactatttaggtggcatgtacgaaacgagcgaatatactgtgggaaattttgatggttttgagatggtgatgcgatgatacctgcgtgtctggttgatctatggagctcgagggagtcgggcttgacgaacacctcgtcgcagtcggggcaggagaagacgacggcggcgagggtgcgcgggtcgagcaccgagtggcagtggaggtagcagccggagagcttcctgatctgcatcgccctgaacgagccgccgatggatgacagcggcgaggacagcgccgacggcggcgaggttgccgacgagctggtggtggtggtggtggtggtcgcggtggcggatgtcgccgccgtcatcacagagttgaacgacgacgacgcggagacagccgccgcggagtcgccgtggtacccgggacccatcagcgacctgctcgacgtgctccctccgccgccgccatcgccgccgccgccgccgccgctccggcggcgccggcctctccccctgctcgacaccgaactctccttggtgctgcagatcgatccggcacacgtgatgctcctgctgatgctgctcctcctcttctccttcttgccaccattcttgccttctgctgcagacactggttggcttctggaggaagaagacgaggagtagaacgccatggatccccagcttccaaccctgctcatcttcttgccatccttgtctttctccttggctgcactagcttccattggagaagaagaagaagaagaaggtgtttgatgaaatgaggggagtgagtgtgttgtcactatgcctagctaagctaaaaacttgttgtttttgagcaagacagcttaagctttaggctccattaccccatgattagtttaacactaatgaccttaatgaagcttttggttgtaatgtaatgtaaatgtggtgtggtggtgttgggtggtgtgggaatgaatgaaaagacacacaaatgcaacacaaatgccaaggagaaaaaaggggatctttatgtgcggttgcagcatgggcgattgggcatgcagaagctatgccatcatgctcccaatcctgaccttctgatgagaccatgtgatgtgatcacctgtttctttccttctctgcattttattagccatggattagaggagagtagaaagatcacctgttaattgaatacttctacatttgtggcaagaatgcactaaaatactatttctgaatatttctctccctctctctcttaagttttgtttgactgaatttctgcaatgtcattgtttgcttttcagcttataagccattgtcagaatttgaattttgaaattgactttgtggctttctcattgtagtttctttctagcattttcttttaaaccacgaatagcacagatattgaagttttgcccacaaactattttgtggttgcttatacgctgttctatggtttaacgatcaaacttctgaacatcattctgaatgtgacagttccgaaattcagcaggaagaatgcttgcaatgcaagatgctgttgtgatctcgatggcatgattggtgcaggttgatgtggattagtttggattaatcccagcatccgttcttagcggttactgtgcagtcaaaagagtgcaaattaaagatgtatattagagagagtcaagtaataatgcagtgtagataagatcttcagtttcgcctaaaaagccctgctgctgcactgctcacaatcattagcacttctgtacgtagatttcttctttggaagatcattagcatcgcagattcagaaacggctaatctgtagcatagctttgtcattcatagctagtcttgtcagtctctgcgtgatttggttcggattggcgcacgcgatgatgattggaaagtgatttggaaaaaaatttggaagaaataattccactgtgatacgatcgtcgtgtgcagattttgtggggagagatcccggccgtccacagatcaggaacggacggagaccagcagacatgatccgcgatgcgaggcagcgtcaatcaatctcggccgttcatcacaagaaacagacggtccgcatacttccagcaggttctgcgtcatgcacccctttctggccccacctgtcagcgtcagacgccacggcccttcttgtgacacgtgtcgtgttgacgcacagctgaactcgacggtttttgatgatttgatgttgctagacccacgaacctacttacaggtaaaggatcctattgtttggcttattggtgaaatatgccgaataacatatttacaagcgaaaactaatttatgaataaaacttttatatacgtgttattagtgatctaaaagcaatgcctaaataataaacttcgatgagtgaacctcaaaatcagattcaaatttaagtttgaaaattcaaaatttagctgataagcataagcataaacgaaaatacgaggccgaaaatcagtgggtaacccacgggccacgaattgacatgttgtttacttagaattaattaatctataagtgggttcacgggtcgaaccacttgcatcctcaggtacggcaagctgccacgatatatgggaaccggtgggtcactcacttatctgacctataaatgggttcgcgtgtcggtccatttgcatccctagctgccacatgcacccgtgaattgtatccgttattatatatttattttttatctatgaatttggacattacacttatctagattaataggagtagcttaaaaatattatattttagaatgaaggaagtattattttagaacattgaagacttttaagttgtgatgttttgacgaactaaatagttatatttataataaaagtattctgataatatgacatcttcgacatattgtaacttttctttctaaaaaagtataagctattaaagttggtactctacatgaactgtgtctggtgtaagtaaaaggaacggggagggagtatattgtaatttaatgtataaatgcctttgacaattgacatttttccccttcatgccaactttaatttgagaagagggacaaagtttcaaagaaaaactaaagtttttggcatatgttattcgtcctcctataaagaaaagccactcgctcgcatgtacgcaacaaagaacatttgaacatgcatgagcgcgcgcttccaggttccagcgattagtatacgctaattgcatgttagtatagttcatcacatctgagacccagatcagagaggaactattaatttggaccagatactattcactactagtatagtactccgtagtggttaatcatgcatatacctgggctctgacaatacaaatcatgttgtatttgaacgtgtatgcaataatgcatatactggcaattccacgacgagatacaatcatgctgtatttgaatgtttggagcgcgagaaatctctcttactatttttttttacgaaaactatactattttagtgaaattactgtatttcaaataggatgaaagaacattgagttcatttaaaattatagacaacattgtccaattttattaacgcattaaaaatttatatttgtactgtaaattgccaaagggctggtttggtttgaggcctaaattagacttaccaatatttggcaatttcaatagtgtttagtgtctatttggtttgaagccaaaatttgacatgcctaagaaaataggccatttcaatagtgaactcaaactattttggcttcaatacaaacacaactttgccttaccaaaattagtcatgctaaaacttgctaaaatttggcactgacaaaatttgataaggcctatttaggccacgaaccaaaccaacccaaagtgacaaaaactgttttttatgtacaagtttatgggccttctccaaatccggcccagttatatgtacatgggctggttagttattttgaacattggccaactttgtgggcttcctaattttttgctggtagtctccttccattcacgaatgattttgtagggagtttgtcaacatggatgccatctccaatgttgtgtatatcttgtaaacatcgtatatatgtttcttgatgaaagcagtaatgttttcaatggcgtgtatatattgtaatcatcgtatgttgcttgatgaaagtagtagttctttttattcaagtctgaataattgagctaattaccaaaagagaaagaaatatgaaaaataccatcacatataatagagatactacatgagttacacaatacgaatcatatgtcgatgacacattatacaatggtattttagactctgttttttgcgatggtattcggagtattgagcaaaagagatgccatcagattcaggcattcagctagccaccttggtcaacgagcacgctccagaaatgagccgcacatcgatatcgaatgggttaattgcatttagatatccagccactagcgactgtagctaggagccatgattaagcatatgatacatgcacgcaatgcaaagtaattaatggaagagagccacacatgacaagaacaaagcagaagcacatgcggatgtgtcgaccgatcttatggtgacagagacatgagaatttaatcagcattattgctcgacacacatatatcatcatttcaagacgattgtcaattctgaatgttttaaaagcctaatgtaaatttacatcaatgttcagatcatcatttaaatcattttatttacaaatgccctagctaaattaataatggttcgtgggtacttaccatctatggatcaatggctcatacacatgaacaaggtattcagaagattgggaggtagatcgttcaaaaaaaaagaatattgggaggttatttggcaatactaggactaggaagttcaaaagcatagtagttctagggtataagaaccacgttcaagtcgtttgttggtagtgtcagccaccatctagtgaagctctgatgactcctgtggtgtcatgaaaaccgtagacttatcctcctccacgtgtctaacaaaagtgtctcagaataaatgtgttgtaatataattaatatctagataaaaactacgactacctctgcttttaaataaagggtgatgctccggtgcactctacttgcagtattctactacaagtagaattaatctcgaccgtttatttaaaagggcaggtaagtaatctcctaatatagtttaggggtaattttggcatgggatgttttgttcggttcgcatcacatcaggttcggtggatgggcacggcaggcaccacaggcgattgctgcagcatggtgtcgtcgtctctcgccggcaagggccacagcgcggtgtacaccaccgacggggcacggttcgagggtgccattggtgtacctttgcacggtggttttcggcgagctcctcgccatgtctcaagaggaatttggcttcgccggcgatgatggcaggatcacgttgacgtgcgatgcatcagtgatagagtacgtcatgtgcttgattagcagagatgcctctgaagaggttgagagggcgttcttgagctccatggcaagttcttgccatagtgtcgaaggaatcagccattagttttccactgtgtcggagaatggcgagctgctcgggatcggatgccacggccggccgaggtaggtctccacactgctgccggcgggggcaccgcggaggaggtcggtgtcagcgtagatgctgcagtcctggaacgagaagcctgtggcgcgggactgggcggtgatggtgttctgctggccgcggagggggaagcgtgcgacgatgtcgcagtgctggaagacggcggtggcgtcgccgaagatgagttagatattgataaattatgataatacccctgcacgaattattatccctgaacgaatatacccttgtacatttctactaccactaactctggtgggagtagaaatagatcacaaccctacaattaaatataatgaacggctcagattgctttctactccaagtagaaagcaccggagcaggactcttaaatatatgatgtgtttgactcctgatgataataaattaatttgattattcatcttattaaaaatactactatatccatcctgaaatatataatataacttagctatatgtatttgcataaaagtatgtccgtatatatagctagaattgctatattttaagatgaagggagtatgtaaatatcacttattttatcattaaatatacttcaaatatgacttattcatatttatattaactttttaataagatgaatagtcaaaagtcaacaatttgtattttaaaacatatgtagtagtccctccatcacacaaagactttattgttacctttttcatttgtcccataatgccttcatttttaagacagttaatacatcaaagtttggaaaagtgaaacacaaatacattagagatttaaaaaagcgaggaacaaatgtattggagttcgaaaaaaatggagagcattttagtcttttgactttatattggtatgtgtgagataggaaaataatgaagtttttttttacagaggtagtagcaccatattactatagtatagccatattaatataaggccgatcgatatacacataatcatttaaaaggcgatctcacggtcagtcaaggtgcaatggccctttcatcaatcaggcccatatggccatatgcataatgcataatgctggttagcccaaaagtgatgaattcaacataagctagctagccagccagctctgccttcacgtactcaagccagctgaaagactcctgccatctctctctctagatcgatctcaacatgtgtaatgatcatgccaaaattgaaattaaaggaaacttgcaaatatacctattacacaacagttgatctatcatctgtgaacgtccttttgatgagatggtccgaaagatagagaaattggggcacctctatgcatatgcatatgcatggtcccggcagattcagagatgaaaaagtctcagaaataaaggtagctaggccaccatgagatcgagggcggccatgatgagagagattaagcttaagggtaccattatattatattgcacctttagtttctttagtaaccaacagctaactgcagctccaaaggtaatcatgagatcacacagagttggaagctaccaagcaagtaagctcagttgattgattattcttcactccgttccaaaatatagcaacgtaatacaggatgggatacatctcgatactaagaaatccctattcagatttatattactagaatatgtctcattttatattaggtcgttatatatttttaaacggatggagtaacgttcatgtatgaagcataggtcgtttgtgcaatatatatgtatgcacatatatgaagccaattacacaccggcctagctagctattcggtagacattgttgtttcccccttttttctgattgctgattataatatatattccaataattaagttagcttggcagtttggtgcaagtcaaaaaagttggctgatcttcatgaataggctagaaatattccagacattagttaggttggcactctcaacacattgcaacttcattttcattctactgtgtgttgggctggcctttttatagtttttgatatactcgatttgtaattcacttggttaatcagtctcctaagaatagtagaatcgtagagctatttttagatctttattattattaaatatcattcaatgtagaaatatatacgtagcaattactccctccattataaaatataaagatttctaggttgtttacaaatactaagttaggtaaaaaaaatcctttttaatcactttagttatcaatttttgaatttcaaattgcttagatttcctttccaagcatttgattggctttagaaacattgaaatgatgagaataaatggaaattttatattgtggtataaaatttgaatcctagaagtacatatatttatttttggaactgagggaatactatatatattttgttaattcatataataaatcatctacgtacattggcttatgtgatctgatgacacgcataacattactactttgcaactagtattacatcaacaggatttgctttttccctaattattgttttccgagaagcatgtttcaacaagtgagagctcatcatcataatcaagacctaccaacttcttggtgcatgactgcacgttctgggaagtgatatttgatttgaatttgccccaagactagtacttcattgatcttctattgttacttaatatgagtatatgcaaagtgaaattccgattccaaattaatcactagtactactggagtagtacactatatttccccttgtttattgaatcatatagaaattaaaggaggaaaaaaaagaggagcactattaaaaaaagttggctaggcctacctccttgattccttgtagaaccttgtcaatcataacttgtgaacgcacactttaatttaattttgatatttttgagtccccacacatcacattttttccccactttcctgacacttttatgtgattcacaaagaagttctcctgtatcaagcaaagaacactgatgattattctgagccggatgcattgatatatgatggattaaaaaaaaatgcattgatgcatttatgagtcagaagagactattttgatgggaatagtaccatgataacgactcaaaaatatataatgtctattgaaaaatagacataccaagacgactaactacaattatcataatagacctacatatacttcatgtatatagaacggtttcatgacctggcaaatgtgtggtaatacactatatatgactttaattgcttaatttgatcatgatatttctttatatggttatatatttaccttatgttaatttccttttatatatactactatgtcattaattagtattatgccccgttctaattaatttcatttttttttatttttatggtcccttctgtgtttgattcatcttgaacatgatttctccacgagtgggcaatggtgctccacattattgtgctacacgtgtgacaactaattagttatgccactgccctctctgatctgcttgccgaccatatgtatacagcagctgagagagatggagag

SEQ ID NO: 64841 - DNA, 5690 bp, Oryza sativa
ctagatgaaaaccgctcatatacacacgtacttcatccgtttcacaatgtaaaactttctagcattgtccatattcatttagatattaatgaatctagacatatgtatgtctttatattcattaacatctatatgtatgtggataatgttaaaaagtcttacattctgaaacggatggagtacatacttattcctatgaacatatatacacgtacattttatccctataaacactttcgaaaactaaaataaatatttactaattgcgcacaagaccactgaacacatcgttattaatcacgctgctaaataatattaatattgtcttctaaaatagttattactccatctgtcccaaaatgacttaatttactgcgttcaatatttgttaaaaaaagaattaattttatcccctacccttgtccatataaatcgtggagttttatccattcaacatatatcctttagctacccatttggcaatactactttcctacaaataatacttcctccgtttcacaatgtaagactttctagcattatccatattcatttagatgttaatgaatctagacatatgtatgtgtttaaattcattaacatctatatgtatatggacaatgctagaaagtcttctattatgaaacggagggaatactaaataagagacactttggtgtttttcttcactagtaaattttcttagattgcttagagaaatcaagtctttttagacgtatagggagtattaattcctgtctgagtaatgaccaaattactgtagatattacaatactcccttatttcataatactttactaattttgattggctttgttttattttgtccaccgctgacttataaataaattcaagagtattcaaaacctaccatattattgaagtatgttagacaataaatatatccgttcatcataacaaacgatttgaaagttcgtcaaactaattaaaagtaaaacagtgacaatcaaaattatattgataggtatagtgaaacagagaaatggagtattagccgttccgtattataattagtcgtttaaggttcaagtttgacgaagatcatagaaaacgcagtaacatttataacatcgaataagtttcattaaatccaatatttccgttgtatatttgtcttgtgttgagaatgctgctatatttttctatataaacttgttaaaaattaatgaaacttaatttaggataaatcgaaaacttctttttcttacacaatctaaaacgtcttacaatattcataaaagagggagtatcgaaaaactaattaagtgcgtatttttcgtgttaattaactaattaaggatagaagtggcctctgtgcgcatgcatatcttttgcaatcaatcgagatgatggccgatcagtgtaactagctgtcgtgttgagatcttctatatatcgtcggccaatgataaggggacatccgtgttaggaaacgatagacgaacaaacgataaaaaacaatagatcaattacaaaagacatgagatttaacgtggaaaaccctctcaaaacaggagaaaaaaaaccacgggcgctagccagcaaaatatttcactatatctgaggtgaggttacatcgccgcacggcggcttacaagaggtatatatatagtggaaccctaaaagggatgatgatccgtacggcagaagctggcctttattaagtgtaaatgaatttggatcacaactcaacaatccggacatgcatggatcgttgatcattggccaactttgcatgcatgggccacgtctcctagtactaagctccaaccgcatcgatcgatctggctagctatctgctatagagatcaccaaggccggccctggggcagtacgaacggtgcgaccgtaatgggcctctaaaaattaggggcctccaaaatatgtatactatggtattaggcttgaaattcgttaatgacaatgagtttttaaatattatcttgtttttttatggtgaatgggggcctttattttttttccgcaccgggccaccaaaaagtcagggccggccctggagatcacagcaatatatattatcagaaatgattattcagaagatatacatacataatctgtacttccatgtctttgacgactctctgtctcactgcctagccaagccatgcagtagtagattcagagagatatagcaaagatctaaataaactagacaaaactctaaccctttttatatatatgtatgacaaaaagttttagtgagatctttataagagctctcataattctggtaccagtagtggagactcgagcccttgccgtccttatattagatcatcccctggagccatgcatgcagagataatatatacactaaactccgatcttttcatacatgaatatattagtagaaaatcatagctcgtagtactaagaacatgtaatattccatattatgtttatttattttggagcacaatgaacaatcagaatatttatatatacaatagatctctcctacgtatctaaacctaattggtacttgctaaaaactggtcgtacgtacgttaaaaaatatctgaccattttagatggatcatattaacatgatctatatgcatttaacttttcaggtcatgttaaaaacttatctattctacatctacatattgtgggagtttatacttcatgatgaatgtttttttttataatgggaatttataaaacccggcttcaaactggatacaacggggtttttattgattccaaattctagactaagcaaaatgtcggtaagctacaactaagattacaaactgagtacaactcaatatttattaattcagaattatgaaaccattcagttttgctatataattgtcgataaattttcttctagaaatttaacatatataattatagtactatcatgatataattacattgtaatttacatataactataatataacttgtacgcaactttcacaaaaaatttgaattgttagatttgtttcaagattcttaccggcaaggaaggaaaaaaaatcaaattgtgcgtacatgtgagaggattcggttgacctccatttcacgaaaatagcatgctacgaagagatttttaaaagttacatacaagtgacattgtagttacaatgtaattacaactcgattgtaccataattacatctgtcaaatttctagaagaaaagttgtcgacaaatgtatatgtgacctcaaaaaattaaaaaaaaaaatatttcaaatgtcaataacaatagctgtgcgacacacggttttacgactatgaaatacaagaaagaagagatcgggaataacaaataagctcagatatatgtgtagttgttatcacttgtttatatcagtggcatggccgctcgtgtgctgctagctgcatgccccatccatatattgcatacatacacacatgctagctactctcatcactctaaattctaaaatacacacgacaagacagtacaaatcgacgagcgtcttctttataaatcaatagccagcctgcaccacagcctgtgcccatccaattaactacaagaccccagttcatccagtggatcgatcgatcagagctagctagatcgagagatcacaattcagaagcaaatcaatcaagcatcgatcgatcgatcgacatggcgtcggagaaggtggagacgatcgtggcgggcaactacgtcgagatggagcgtgaaggcgccgccaccgccggcgaaggcgtcggcggagccgcggcggcgtcgggcaggcggcgcggcaagctcgccgtctccagcctcttctggcacggcggctccgtctacgacgcctggttcagctgcgcctccaaccaggttcaatccgtcgtcatatgacatgacatgacactctcatggcgatcactacgatcgatcttgacgtcatcaatggcgtgattctgtgcaggtggcgcaggtgctgctgacgctgccctactccttctcgcagctgggcatggcgtccggggtggcgttccaggtgttctacgggctgatggggtcgtggacggcctacctcatcagcgtgctctacgtcgagtaccggacgcggcgggagcgcgacaaggtggacttccgcaaccatgtcatccagtggttcgaggtgctcgacggcctcctcggccgccattggcgcaacgccggcctcctcttcaactgcaccttcctcctcttcggctccgtcatccagctcatcgcctgcgccagcaacatctactacatcaacgaccgcctcgacaagcggacatggacctacatcttcggggcttgctgcgccaccacggtgttcgtcccgtccttccacaactaccgcgtctggtccttcctcggcctcctcatgacgtcctacaccgcgtggtacctcaccgtcgccgccgtcgtgcacggcaaggtggatggggcggcgccgcgcgccgggccgagcaagacgatggtgctctacttcaccggcgccaccaacatcctctacacgttcggcggccacgccgtgacggtggagatcatgcacgccatgtggaggccgcggcggttcaagatgatctacctcgccgcgacggcgtacgtgctgacgctgacgctgccgtcggcggcggcgatgtactgggcgttcggggacgcgctgctggaccactccaacgccttcgcgctgctgccgcggacgccgtggcgcgacgccgcggtggtgctcatgctcatccaccagttcatcaccttcggcttcgcctgcacgccgctctacttcgtgtgggagaaggccatcggcgtccacggcggcgccggcgtgctccgccgcgcggcggcgaggctccccgtcgtgctccccatctggttcctcgccgtcatcttccccttcttcggccccatcaactccaccgtcggatccttcctcgtcagcttcaccgtctacatcatcccggcgatggcgcacatggcgacgttcgcgccggcggccgccagggagaacgccgtcgagccgccgccgcgcgcgctcggcggctggccggggacgttcgccgccaactgcttcgtcgtcgcgtgggtgctcgtcgtcggcttcggcttcggcggatgggcgagcacggtcaacttcgttcgccaagttgacacctttggcctcttcaccaagtgctaccagtgccctccaagacactagaattttaattttttttaccatggttaatttcttgatgaggagttaattaatcctgctacctactgttgcataattgcattgatgcacagagagagaagaaaaaaaaagttgagagattgcatgcgagcttcatcatctatcttaatcttccatggcgatcgagctcatggcattgttgattatgattagtgtctgtgaggagagagattaattcctgtatgtatgtatgtatgtatgtgtgtatgtgtgtatgattgatgatgatatatgatggatcgaattgaactatatgtatctctctgaatcataggtgtgatgcatgttcagttaggtttttttttgttggcgtttcatttctttcctaattaatttgatagaaatggatatagcttctgtgatgcaatgttgtgcatgcctctgtcttttaaacaagtattggagattcagattcctactagtaagtgaacagtattattgca

SEQ ID NO: 64842 - DNA, 2003 bp, Oryza sativa
aataataaaaattcagaaataaaaataaataatattggaagaagagcatagagtctatatagaaatacaatttacagaaaattcggaattaaatataattaataactgacacgtatataaaatacaatatgaatattacatatttgtattttcgtaaagctattgcaaaatttaaaattatgatgtaattttaatatttttgaataatataatgagaaaacatatatgctattatataaaagaaaatataatgatgctagccgcgcaatctgcacgggccaccatgctagttattatatattgggtatacttaataggggcccttaagatttggggccctgtttagtcgcacagtccgcactggtacaagacgccctgacaagatacaatgcctctaatcctcatcctctttcaccttcacattaccaattcatgcacttctctcaccaccaaagacgcacgtactcattttttttcctactcctccaaggaaaaaaacaaaaaaagaataaagatagtgattgaattgatgaatatgtggacggacgacaataccgccatgatggagacctttgcctctgcagacctttacgtggaggtagcttccatgccgccgcagcagcagcaggtggtgccaacagcgctcgcacccacggtgacgttcaaccaggacatgctattacaactcctccaattcatcatcaaggtcctattaagaatatacgtaaaacatttttttaaaattttctatgataattgtatacacgtaaaagacttatgtgtataggatacattcccgtgcaacccatggcaattatcaaccgaaccaattaaccattcgattattttgagggcgacccatgcattcgcgcgccgtggtcggcctgcgttgtctgatctcgatcgcgatggcccgtgacgcgaggcttccgtgacccggtttgtccaagtttactccgtacgtagtagtatatttgttgccgttgccaatggaacggtactcaggcgggggcggccggctagttccacacgctgccaccgctttgccgaacccgcgcgtcgatcgttcgtgcacgcgtctcgcatgcatcctccacaaactccggccgtattctgcacgttgatgttggcctctggcggtccaacaacagcgctgccccaagccatccagatacggccatacgggaaaaccaatggcgatcggcgaccgggacgaccatccgtttatctgtaccttgaaggtgacccgtgcgcacgacgctcgccgccgcttcctgtactgtctttacccaatcctgcaccggaaacaggagagagagagagagagagagagagagagagagctagtaggaaccggattaacttcacgacggcttccatatgctccccgttctagctggccctctctgtaatgtactaccagtagtactgtcatttctcaccaggacggctacacagctactgcgtttatctgagctggaagtaggaaattcgggaacccaccgagcttaaatttttacagtatcacttttgataactagatatatactccatagtaatgatactccgtaagttacatgcctgcatcgtcaatgagcatctctgttactcttgctcttggtggcgatgagcacgagagggttcttcttgcgcaccgccagcccgttctcctcctccacgtccacctcgcgccccggcagcgcgcgccagtcgaagcagaagaggaggttggccagcagcagctccgccgccgccgccgcgaagtgcacgccggggcagctcctccgcccgatcccgaacggcaccagcgcgaacccgtcgtgctcgtgctgctgctcgccgtcggcgtcgtgggcgcggtggcgctcgggcaagaaccgctccgcgttcgggccccagacgccggggtccgtgtgtatcgccatcgcgttgacgacgacgcgcgtcctggccggtatctcgacgccgtgcgccgtgcggaacggctccgtcgtctcccgtgg

SEQ ID NO: 64843 - DNA, 1485 bp, Oryza sativa
  unsure (1)..(1485): unsure at all n locations
ttaatgctatagacaccataggtttcgataaaaatttaatgagatgtgaaatgtgtagctagtttccgtctacgagttaggagacatatccgcgcggtgtgaaagtggtgcgcgcgcgcatatcgcgtcttccctatgtccaggaaaacgtatatcacagcgtgctatgctcttgtccaggtacgtaatatgtacacgtaccgtgagaatgcctttgatgtgggtgcggctgccgaacatgctccggtgagccggatcgccgtggaggcggaggagcacgtcgaccaagtcgtcttcctcgtcggatgcatgcttgcgcttgtttgagggtggtcagtcgtatgacggcgctcgttatgagcgcgttccgagctgggcgggaaaccggccgctcccaggccgcctacctacttgcccgctagaggagtgtcgcacctcacccggagccaacggtcatcggtagtacggcgacccccagatgatccatccaagtagagagacctgggtgctacgtatgtaggtaccagccttgtatcagtaccatgcnatnctcgctcagcccgtacgcccgtcagcccgacaggtcgtacgtcgccagccacgtatncctagctgtctggtgagcggacgatctcantgatcgctcaagggattgacgtggggaatggcagccggcgggaccgcccacgggccgacgacgaagcgacggcggtcctcgacgctcaccgggcggtcgacggagcctcgcggcacccgcgggcgggccgaggagctccgacatgcacgcgcggcgcgcggcgcgccagtacgcgccgtcgggcgcgaaggagatgctcttctggccgtaggagagccttgtggccgcgtacagcgccgggcgccccgacagcgcgcggtcgttgttccgggaacagcgcccgcgccgcgtcggcggtggagacgacgagcgtcggcacggagccgaggcggagcagcatgagcggcgccgcatgcctggcggcgagcgcggcgagggagcggtgcgggagcgcgccgacctggtggaggttgccgatgagagggaggcccttcgggcgtggcagcgacggtgaggcggcgcgcttcttggacgacggcgcgagaagctgcttgaagaggagaatggtggcgaggaggaggaggcatgacgcaaggaactcaggagcttggagagacgccatggacattgctgtcttggttgttctctagcttgtctctagggcggctgagtttatctatctatatatatgtcatgtcaggaggagatatcttagggcatcaacaatgtatccttaccaagtagtaagtaagtaaggttggaccaaccaaaagcagaaagcaggtaattgttattcaaggtgggtcccacatgtatataaatataaatataaagacgtagtgacgacgacgacgccgtcaccagcagcagccgccgctgcccacggccgtgctggcccgcgtccccct

SEQ ID NO: 64844 - DNA, 1177 bp, Oryza sativa
ggcccacatggcccacctttattaattattgtttttatgtaactgacctatgggtcccacgggtattgttttttctcaaatcgagttgtcacttaagcgccacatcagtgccacgtagcatggagacctagttaaactagccacgtagacaccacgtcagccaaaaccgctatgtgccggtttttgtaagtttggagacgggtagtatccggttttggagtttagggatgaaaatcggactgggcgacgaatagagggacttaaagtgaacttattcctttgccgaacccgcgcgtcgatcgtgcgtgcacacgcgtctcgcaatcctccacaaactccggccgtattctgcacgttgatgttggcctctggcggtccaacaccagcactgacccaagccatccagatacgggtacgggccggttgcgcctgcgtttcctacctgatcgcgacgggaaaaccaatggcgatcggcgaccgggacgaccatccgtttatctgtaccttgaaggcgacccgtgcgcacgacgctcgccgccgcttcctgtactgtctttacccaatcctgcaccggaaacaggagagagagagagagagagagctagtaggaaccggggcaacttcacgacggcttccatatgctccccgttctagttgcttgtaccagtagtactttcatttctcaccaggaaggctacaccctcagtcccaaaaaagaattaaactctagggatggatgaggactgccgtttttgtgaaagtttggggacgcaaacgcaacccattggctcttggcaaatgcaacagtcagtgtcatcatctttctgagggcgacatacgtacccatccgatccggaacgaccgagaccgttccagaatccagagtccgtggcttctgccttatgtgaacttgtggtatctcagtacggatacgtctgagctccgtcttgatgggagcagcattaataaactttcttactgatgatttagtgcttagagcttcttcagtttttgctgaaatcaacctaaccgatatttagcgttaccaaattttggcacattttaatgttgtcaaattttcatagcattagttgcatttagtttgtagccctatcaaaatttggtagtgtttatataagaagaaacttttgaaatgctaaattttggtagaacagca

SEQ ID NO: 64845 - DNA, 736 bp, Oryza sativa
gagctcattctcaggactcccctggaggctggctcggaagccgccgacaagaaccggcagcatgagcgcgtacagcgcggcacccgcctcgctcctcgactccaagagcagcatctgcgtctccgctggcacgccggcggcgtcctcgcccaccgtcgggatcatccaccagatcttgaacctgaacagggacagccacttccacccactgcacaccaaaacccaacaacgaatcagtaccaccgctgccggccgcggcgcacaccgcaatctctgctctgggggcgggggctctacctggcgagggtgccgagggagaacacgtggcggctggacggggcgggcgccgtggcgccaaggaacgcggcgccccccggggaggcgacgaccgcggggcggcggagggccacgctgggaggggcccgctccaggagctcccgcccgccgaccaccagcgacccgcgctccagccgcgccatctcctcgctccgcgggcacgcgacggcggcggaactgaggctgggacgcggccacggccggcattgcgccgggacgaggccgcgggggcgcgaattattcccgcgcgagggagtaggaggaggggcccgaagcggcgacctccagggcgccgtccccgtcatcgccatgtcagcttcgagctgggatagactaagatatccggtagtacttccgctgccatgatcgggacccccgcgtgtggatgggggcgctcgcc

SEQ ID NO: 64846 - DNA, 2288 bp, Oryza sativa
cgctgaactaaaacgtctcagcactacccgacttggcacaaattagccatgtaaaaggaactcagcgtcactatacattacgctgacctcttaataggtttaaaatataggcatgcgctgaaatcctgagtagtatttaactttatccgttattaaaaagtgcctataagtattaaaaatagataaaacaattttaaaattaagtactgaatttaaatttatatgagtaattcatagcacatactacgagtacatatgtaattttcaattattaaataaaccaagattagtataactatgtcttaagcctatggtaaaggttagcatatatacattagaaaagtgctctcacgaattgtgtgtatctagttaatcctagaatgaattcatattggtatatgtatttctttctgaaaataggattccaaaggttagcctatctgctattaaatacatacatgcataattagcccaagggcaaaaaaaaaaacaagcataccaaagtatattataagatcacaaattacccatcttggtcatctcccagtcgcagagaacatattacgacctctgctgattcatcatcaaaatagacatcctgaaaggagaaaacaatggaaatccactctgtcagaagtacagcttcaacaaatatggttatagacactattttccgcatgcaacattccgttctttttacatggctgattgaagcaaacgttaaggagttgtactgaaaatttaatcaaattgaacataaaaccaggtgaaaagaacaaaaaagcaataaatgggggtaaactagaatccttaaatatacctcatcatcatgttcaagtgtcccttgattctgcattcaagaaacaagcatcattagtatctagtatagtaaggctgtaaggaactgcaaatctggaatatggtagagctgctgagtcactcaagtagataatgcaatagcacgagtaacaggatgatattttatccaccatagaatcctctcaaattaaacctaacaaaatgtgctggcagagaaacatgttgaccgacgcaaaccatcaaagcgatagaaacaaaatcattcacacacacacctcttccatatcatcattgctatatatcccatatcgcaatgcctggctcaagttattagtaagagctaccacatcataatccatgtctcggaagtcgtcatcatcactatccctaccacagtcatgaagtgatgttgggcgcctgtagcagcaagacatatagagaaactattcagtgaaaaaacagaagtaaagacatccaagtttagcatacaatcaaaaaaaacaaagagtcacatgcccacaagcccaatgatacgaattctccacctcattatgcttgactttaagcatgatttatatcttatacatttgcataaatgttctggataaaacgaatggtcaaacacttatttaaaagtcaacgacgtcatctattaaaaaatgaagggaatatattctaccgatctctcgtaaaaaaataatctcataaaatgcatggacatttgcgtcatatttcaccatactttcagaaccgataagatttagttctaggctaataagccttgaacaaaacaaaccaaaaataatttatagataaaaccaaaaaaaattgtagacagatatatagcaaatcccaacttttacatgtattactagtgatttaaaactaagggtagaaaaagataaacaatgatggaaaaatttgagaataactgaaaactttactaatctcaaaatttaatttttagctgcgatagttagtcaacaagaagacaatgaaagttatgaaacttccttagtgataatacacaaatgcattccaggagtactcatgcaatatatagccactcagttgattcttaacactctgtataacatatctgttgttttttcaggaaaaaaaagtaaaaaaagaatttgaaacatatttaatcactaccaaaacctacaaccttacccacaaatgcacaatcaaactgtgcatataatctggtgaagggaggtgtaggtgccaacgaaggcgatgcatactccgatgactagtattccgacgatcgccgccacctcgaagcggccaactccaaatcgaggcatgtagatcttgaggtagctcaggcatgggaacaacacgacaatggtgaagttcagcgaagatacgttgaacggcatgaggtagctgaagaaaggggtaccgtgcacgccagcaccaccgtgctgacaacgacggctgtgctggtgagcaccctggta

SEQ ID NO: 64847 - DNA, 4123 bp, Oryza sativa
aaaacttcataacaactaaaaacttaactaactcgaaaatttaaattttagctgtgatagttagtcaacaagaagacaatgaaagttatgaaactttgtcacaccctgaaaatcgctaaattataaattgttgtgaaaaaggaatttttagaatttatttaataattaaagcaagtgtgtgaataaaatctatgaaaaatttgaacataaacttgagctagataaaattttattaaatactttgtattcccaagtattttctgtatttttaccagaattatttgagcattggaagtatttttaataaatgaaagatcatttcagaaattatttaaattaaaaagttaattaaaattcctcttctttgtttgggccgaattcagcccactcctctccctctctcttagccgaagtccagttttcttccctctagcaatcgggccaagcaagtaaggaaaaggaagcccaggaaaagtctactttatctaccctcgctacagtaccttcttcctcctccagccgagccgtacagagccgagccgtgtgcgtgcgccgccgcttccttcgcaaaatccgtcgcatcctgtgctccgtttccaaaattggttgcaaaaacggattcccctcgatctcctctaccttatccctaagaaacccctttgaatatcgttgtatatcgcgtgaattcgacgcggtttcgagctccgtttttccggcgaactcggataaaccctcgtttttctctcgccaaatcccgttgtttttgatccaatctcttcgcacgaatcctataaatagcagcccctcgacctcctcttccgtttccccctctttcccgaattttttccctaaccctagccgcctccccgcgagctccctctctctccacctccggtcgcctctccagccgtcgtgcgccgtcgccccgcccgtcgccggtcagccccgtcacctccctcggcttcgcaagggtgagagctaccccggccacccgttcctttgcgccaaacccccgctggaagtggtcgtcaccgtgaagccgatctaatctatctccggccgcgctgttcgtcgtcgtctatcgtcgccttcggtcgccgttgcttccattggattcgtagctgtgaggagaagctcgtccacccctccgttgccgccgcccatcgccggaaagccgtcgccattgtcaacccaaggttgccgccctttggagctcgtcgccggccatctccctcgccgtttgtcgttgcgtaagtggtggtaagggttgccttgatctcctctcttccggtgccctccgtttgcgtcattgtaccgtggttcgctggtaaccgccgttcccgggctcgccagtgtcgatcctgcgtggcagccatgtcatcgctgacaaccgcgccatcttggccatccaaaattaatataaatttgtcatctcttttcaatgacatattattcctttttaataaatgtcatctaccaaatatgatctaatcttttccggaggatgttttaatcttttgtctcagctataaatcatttgtaaattgtttaatcaatttggaatagtcttttctttaataggtttaattggaattaaatcttgtaaaattcatatctaattcatacgaactcggaaggaggtcgttcaagtctcataattcatctaaattcaagctctatctatttatgaactttaattgtactatttatttggtttttattagtgtttttctcgttttgcattctaggtttagttttccgttgtttcggaggatcattcgttcgttggagaagttcctgaagatgaattgaagacgcttgtttgcaaggcaagtcacacaaatcccaaacaacactttgagcatgttgaacccgtttaaagttaatgttttatttcaacttatgaattattttcgaatgccatcgggtggtgagtctttcccaattaattaacggctgaagatgactttattttcctatgggttataatttgattagcatgaaccttatatattggattggttcagctaaatgccatatgtatgtttgcttagtcatgcttagaaacattagctaattaaagaggattaaatataaattatattatattattattattaattatggttatatttaatggtagatcacgatggttaatcatgttatgttaattaattaataattaaaacctggttaatggtgggttgtgagcacatggttttgaaggtcgtgctcatggcaattaaggaccggttcgcgagctactgttgtgagacattaaccgtgccaaccacaagctagcgtgggcaacggctttaccttttgtatagcatgattcattacggggcaccagactgagaagcggcaagaagtccgtgggggtcgctggggagtccatgcctctggttatatttatagagggggtgattatgatccaggaatggtgcactgtggtgagttgtgttgtgcgaagggtattgtcacgatttccccctttgcagtgccgtagtggtacttcggggcatggcaacatgtgtggaatcgtgtcttgtaggtacagtggtacacctctggccagagtaaaactattcgaatagccatgcctgcggttatgggcgagttgagcaatgtttttcatgattagtcccacactactgattaatgataacaatgtgataattaatttgactcctggtttggaatggttaattcctggtttggaggtttgatctgtacgaccgggattggttgttcaggtttgattgggcctgagcagcattggtgtgctgttcagtgttgattaatattgatgattaattactctactgttttactactcttaaatctttgctaaatgctgcttttgcaaatgagcctatattatgccatcctttggtatccttgtgcacttgcatatttactgtgtggcttgttgagtatctttgctaaatgctgcttttgcaaatgagcctatattatgccatcctttggtatccttgtgcacttgcatatttactgtgtggcttgttgagtatctttgctaaatgctgcttttgcaaatgagcctatattatgccatcctttggtatccttgtgcacttgcatatttactgtgtggcttgttgagtatgtcatatgctcattcttgcaataatcatcgaacctcagttgaagaaaaaggatccagaaggagaagacctttggcttagatcccagttgagctgactgtgggagtggagcataagcttcgctagattttatttttcgctgcagttttcttcatggtgaggactaagtgcctcttatgtaagtatttattgttttagttattctgatgaatctgtatattaaattgtcagtttgtgtacctcggctgattcctgaacaagggtcttaatgtacaaattagttcggaaattacttgtgaatttctgggcgtgacaaacttccttagtgataatacacgtaggcattccaggagagtacacatgtaatatatagccgctcagttgattcttaacactctgtataacatatctgttgtttttttaggacaaagtaaaaaaagaatttgaaacttatttaattactaaaattgtaacgacctgcctctcccaggccaaggccacttacatctggcagctttcataggtcatagagagggggcacatgtcttttctgcaccctctcccaggccaaggccacttacatctggcagctttcataggtcatagagagggggcacatgtcttttctgcacactttgtcctcacttgtgtgcacccgggaaatccgaatttcccggtcagtcacccatcccaaattgctccaggccaagcacgcttaaccctgaagttatttagagaacggcttccggaaaagaagttgcaacttgttgatatgagtattctattaatcctattaagccctaggccgggatgttacaccctcacccccttaagagagatcgacgcccccgtcgatcaaccccaggccaggaacgtcctctcttggccacgtccgtgtgtccagtgctagcgcatgtgccatgctgtgtgaccactccaggtctacaccagccatgcgcaccatgcctgcgcaactgcgacacacgcgcccgtga

SEQ ID NO: 64848 - DNA, 5260 bp, Oryza sativa
agtcatagactgccctcacggaccaacacatgtcttttctgcacacttgtcctcactcgtgtgcacccggaaagaatttcccgatcggtcacccatcccaaatgctccaggccaagcatgcttaaccctggagttctttggagatcggcttccggaaaagaagttgcaacttgttgatatgagtattctattaatcctattaagccctaggccgggatgttacaaaaatgtgcctataatctggtgaagggaggtgtaggtgccaacgacgacgacgcacactccgatgaccagtatcccgacgatcgccgccacctcgaagtggccaactcctcctcagggcatgtagatcttgaggtagctcaggcatgggaacaacacggcaatggtgacgttcagcgaagatccgttgaacgacatgaggtagctgaagaagggtaccgtgcacgccagcaccaccgtgctgacaacgacggctgtgctggtgagcaccctggtctgcctgttgttctcggcgtccgtcgccgctgccgtcgtcaacgacagcttctcctttatcaccgttgcaatgagctggatctcgagtccgtacttctctagcagggagatcagtgtcgtcaggatggtgatcctggtgtatagcttccccgagggtaagttcagcgtcacctgcgcctgcacatcctcaccatagatcagatatctcaataatgttgtcactgcgtaattgagactgcacagcaccgaagagatcagcaaaacctgcatattaattggagaggaatagaacattattggagtactgatccattatcatcatcatcgtggtttcataaaccaaattacgataattggaattgataatccaatgatcaattatcattgtttgccaaatctctccaagtgaaaggtaaaacttaaaatgcaacatcattgagctacatcatctgaagatatggaccattgaatgcaacggttgatacaatatatgccgttagatcatggataagtatcagtaaaagaatggtaaaaggtccaagattgtttaagaaacttccatgagttaattgagcaatagtcagtgccctacaacttttgcatcttatccctaacaattctcatagctgttggttgagtctaaacttagtacaagaatatatacgacataatagatatctattttaacttggcattgaaaagtttatgatgcaacacatcttccaactttagatatgctaccttttaatttacctaaaattgttttggactacgcattaaattacttaaaaacaaaatttcgtaaactatgtattcaaatggctaatacaattatttcatttgaagtgctagacgcatattctaagttcaagttttagcaaataaattaaaccatattagacggctcatgattagctttatctttaagctacattgcttttacatgggtggatgagaggtaaccaaatatagttgagaggcgaccctaattgcctccattcaccagtttattccactggggtgataggctataatatagcacagtacgcctccatgtcaccgcacacgtcaaattagtctaaaggccaatctgacattacgctaaatttacatcattatgcaaaaatatatattaatgctaaattgtgaatattgcacttgccagtaatgcactcgccattccgtatcactgtaaattaacattacatctttttttaggatagtacaacttattttaataaatgattttagtgttcatttcgtctgatcctaattcttattggacgatcaaataaacttattagcttaaattttatctacatgatgtatatatagacctgcaatggtgagtatgatgagaacgtagcagcgatgatgattaagaggtgtgcatgattagtgatgtacgagttctcaaaaatatttatgagtgtgcgtgtcttccatgcatacatgtaataaaaaacaatttgtttgtattcttactaaacctgttgctaatttaattccaccattgacttttcaattttcattaaccataattctaaatttacattgttgattgttatcacaaaatttagcaaacttactatcaagtaaaacatataaatacattttaaaaagtgtaccttaggaaaatccttcttagacttcatcaaggagtgcacggtcgggaagacgccatggccgatgaaatagatgaagaagtagaggctgagggtggtgggcaggtggtgggcaacctgctcagattctagaggttgcttcccgccatgtggaagcacttgtcggccacgccggcccaaaccagcgaggttcttgagccacgtcgtcgagaggatgacaatggccaccgtgagcacgaacagctgcttcccgtgcagctgtaccatagaatctccaccaccgtgctggggagaagcttgtcaagttgtcgccctcgagaatgaggaagctgatggcgacaaagtagagctcgacgtacatgacgaggctgatagccatccggccatagccgccgaaggcggtggccaatgtctaggtagctccatattcagcgattggcgcgcatgcagtggtcgatgagtttgccggtgtagaagcagttggcaccgaccatggtgaagagcaccaggctgagccacccgccctgcgatagcgcgtacggcaccgccgacatgtgggaaggaggagttgcttctactccacgtcgtaaaccaccttatcgtcccgtagatcatcttgctcgtgtttgccatggaggacagccttgtcgatagggctcttatccgccaccataatcttcgtatttgtttgtgcacatgttatattaatgtagtatctagatcacccgacataaaatcactcagatttttaatacttatataatcatacgtatcataacacagaattcattattaaatataaccttatagttaaaaataaagtgtaacttacacttagtgaaaaatagaaaaaaaataaattacatacaagtctaatagaattacattgtaatttacaacgagtcacaatgtaattacaacaaattacaccctaaaagtactatatttacactgtattttttcctcaacttacctcctctctctctctctcatatcattaccatgctttaatcctctctacgcttttgggtaacatgaatttgacaggaaaccgtacactagatgattaacaacaactttaaactatttaattagtgagcgacaaagataatcagccgtgtgcatggatgtacagtaccaccaggtggtcaagtgctcacgagttacgtttcatgggagtgccgacacaaagagggcacgaatctcatggttagattaacggctgaaaattcgacaaatcttaatgaaaaaaattgtcgatggaattttagcatagtcgattattattgtgagttgagatgagatctaattgtgaatgggcatgatatgcgagattagttatacgtagagatatcttgaggattacatgtacgcattacatgtacgcatatcaaactatagaatgcaatgcagttatcaatttaatgaattatcttaaaaccgtagcgtccttgggaagttcatgttaaattatttccaaatagtagagcagcccttgggaagaagttgcatatttaattatctcaaaccgtagagcctgtggaagttattgggatatccatctagtagtcccttggtaaaaaagatgaccttttttgacttccgatcaaaattagcataaacacagctttttttggaacctaaattttagccaaagaaaaaggaacaagaacagcatcgggaatttgtggaaaccgtgataaaacaaataatatttgcacccatgaagctagcaagctaattaattaaccgatggacactattacagtatgcttaatataggaattacataataattaaaatgtaagtacaacataattattatgtaagtccaacgtaagtactatttaagtgtgtaagtgtagtgtaagtacaatgtaaatgtagtgtacaatgtaaatgtagtgtaagtatagtgtaattatatcatataagtgtgttgtaagtacaatataattatataattatagtgttgaacattatatgcacatcgtaacttctctacttttcattctcttttgttctctattttcattcttccactgatgtgtagccttggacaatgtttgctactactaggtaatgtgccggaagatgagcaacattagctcgggtaaggagaaagcaaagcacatatttaatgactcaggtttggatttgcttctcttcatgcaaaagtgtgaggacaaatcgagatgaaaaaaatattaaatcaaaccttaattaattatccagacagattatcgttattttgtttgatagaatacaactgcttcttctgcttcttctactgactgcattgtttaatgacgccaaaaaaccaagtcagtggccctcgtacgcatgcacaaatcttacataaatctaactgtctaaaatttgactctgattccataaaaaatgtgttaccacaattatagcaaaaccgattaataattcttttaacatgcgggtagcatactgctagactgagagcgcaaacaaaataataatcccatccaaattagaggagcaaggaaattactaaaaaaacaagtctataaggatgtagcagaacatgcaagaaaccggcctaataacaacaaggataaaaagagaggaaattataggaacgtagctaatttttcacctcttgccagccggggttatggccgggcgcacatgcgcatgcaccggcacacatgcgggtaattccgagcgcttagcgagagaggtatcaaaccgatacatagaagaatgttaaaaaaataacgagtgagagattatcgagaaagagattacagaagaatgttctctcgagagattagatatgttttcatgtttcttgcgaaattgatccaaacttgatggcaatgctgatccagtttgtgaaattccgtggatggatgaagatggcggtggccatcggcaaggaaattcccaacgacataccgaagcaccattacacgttctacaagagaactacaaggaaattggcggttggacgtgctctacaagagccaggagtacaagctccattacacgttggaaacgaagcaccgcaaccgcaacacggcgaattccaaagacggcataaggatggctgccatggagaacctctccaacctgaagccggagccggcggcgagcaagcagtt

SEQ ID NO: 64849 - DNA, 1126 bp, Oryza sativa
gtgctagtagccgggtgtttagtaaattccgctgcatcttctgcctcctcgataggaccattcccaagattgacagtatccatatgatcctcagtaccaatgacgacttcaccatcatcagtttcctcagtgtctggggaaatctcctctgaattaggtgaagacgaaggaaccgcagccaaacggtcagtaatacctctctctccatcaaatgtaaaccaattcgaatttgtaaagagggaactgcttttaaatacataaacacataattagcccaaggacaaaaaaaccaaagataccaaagtatgttttaagatcacaaattacccatcctgatcatctcccagtcgcagtgaagatattacgacctctgctgattcatcatcaaaatagacatcctgaaaggagaaaacaatggaaatccactcactcaaaagtacagcttcaacaaatatggttctagacactatattatccgcatgcaacattctgttctttttacatggttgattgaagcaagcatttaggaactatactgaattttaatcaaattgaacttaataccaggtgaaaagaacaaaaaagcaataaatgggggtaaactagcatccttaaatatacctcatcatcccgttcaagtgtcccttgattctgcattcaagaaacaaacaagtatcattagtatctggtatagtaaggctttaaggaactgcaaaactggaacatggttagagctggtgagtcactcaagtagataatatatagcacgagtaacagaatgatattttatccaccatagaatcctctcaaattaaacctaacaaaatgtgctggcagagaaacatgttgactgacgcaaaccatcaaagcaagagaaacaaaatcattcaaaacacacacctcttccatatcatcattgctatatatcccatatcggaatgcctggctcaagttattagcaagagctgccacatcataatccctgtctcggaagtcatcatcatcactatccctaccacggtcatgaagtgatgttgggcgcctgcagcaacaagacatatagataaactattcagtgaaaaaacagaagcaagacatgcaagtttagcatgcaatcaaaaaaaaa

SEQ ID NO: 64850 - DNA, 832 bp, Oryza sativa
gaagaactaccccagtgattgaggctttggtagtcctctccgtgggccggctcccgcctagcccaccccttgacgaagggggcgtgcggtggcttcgtgattgagcggtggagttgggctcgcctcaatggggattaggaaaccggcgtgtcggtgacatgggaccgggagtatcatgacttagagacttgaggcagacacgatcacccacgtggcctaaccccctcggggggggggggggtcgggcccgagggtgatacggccgcccttctctttgtctccccgaggggtcggaccgctcccgtttcggccccgagggctggggtgccccgaccccttgtggattttgcgccgcgtgtatgggttaggtgagcgcagcggtgctcacctaaccgcatttattgcggtttggacgagcgcgtcacgccgcatgtaacgcagtgcagcgcgctcgttcatccggtctgtgattagtcacagaccggtcaaatcgtgggttaggtggcgacaggcggtctgacgcacgcctcgccccatcccgtcaggacgagagcctccaagcactcgtccctagccggagccggcgtgttagctcctggagatggcacgttggttccggttagatatacgctaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaa

SEQ ID NO: 64851 - DNA, 740 bp, Oryza sativa
aggcaaaccggcaagaagcaagacaaaaagacaagtcatagaggccaaaacctaacttgctacaattgctgcaaaaagggacatattggtaaaaattgtcccataggtaatactcctaagcctaatattatttttgatgattatgtgcttagaaaaaataggcaaggcaatgtgtttgctagatatgttggtttacctagacttgcatctagaaggaggaccatttgggtgcctcgtattttggtaactaacattgatggacccaattttgttggggaccaaaatgcaccaaaatgagaatataagtacatgagaggcattagagttttggcctatgcgagaaaatgtgattctcaccaagttcaagaattggagccaataatgaggatggagaattcacatcaaggaccaatgccatctcggtaacatgcttttggtttgtaattttttttatatagccttgtgtatgttgcattgcatactcatagttccaaaattaaatttccttctcttatgaaagtcatcataaatgcatgttgagcataatgagtagtggcatatgaagctataggctcgatcatattaatgcaacatatttatcatcttgtgcttattgtcaatcttatttgatatttattggatcttgtgtctatttgcttatctttgttgggttgaagggaatatcacattaagggaaagtattgcatttcttacgtatgcactacaacccttagaatgtg

SEQ ID NO: 64852 - DNA, 1953 bp, Oryza sativa
tatatgtatacttttatgaaagtatttttcaagacaaatctattcatataacttttacattttcagacttaacaacttgagagttattcatgatttatattcccaaggtttgatttaaacattgtcctaaacgacttcctttacgagtacggagggagtataagagaaaaaaatgtctacgtacatgctagatagactcgtgacaatatgacatggatgatgatggatattgctaaaaaaactcaaaagacaaatgttttaagaaataacgatgactttttctttttggaacaaaagagcttttggaatacgagcatgttggctataggggtccgatcatttctcatgaaatatacttatgttgagagatacgaaagtgttcaaatcgagttgcagcataggcaccaccgcccggcttctatgcagttgtcttgaaaacaaattaaagtttacatgagcattttttcggatgggggatacagagtactatgttttgtaacatgttttaagtaatcatactttttaggtctaaatattttctaggaccctagatttatatgtacgtcatctatttgactaaggcatttgaaatacttgtacaaaatagcatgtggtacttttaaaagtaaatatacatactagtcttctgttttctgtttatgtagtcttggttaccttgaaacaaattgcaaagatcgcaaaccaaacataccatttgttgtttattttgactgtgcaaatatgacatttcaacaatcccttatatttcgtgaattgttataatcgtgttttcgccataaaagtataagtaatgttttcctctatgactaagtatttaacgaaaagttttatacctatattttcttccattcttcctataccttaagagttaatttctttcttccacgtctacttaacccaaataagagtgcattcagtttggaggaatttcacagaattttcaaggaagtgaactatttctggtaaaaggcatataatttttttccctacgtttctaagatgccctagcttggcgaggagggattttgtagcttataccgtgtgcaaatatcaaagcaggcacgatggcatttgaaaaaccaaggcactttctttttaaaactaagactaagagattcactattcattatatagagagaagaatgaatcatccttaaaggaaaaaccaaccgtagaagatgagcatggacaccatggagtagacaagaactccattaaagcaccctatgcaaacatagagcatgcgtcttacgagttaagacaacaaccaaataactttataatacattactcatcctccaataattaagtatagtcatagccaaacacaacgcggtattcacattcccaggactactactatgttatgacttcggacacatttttttagtttgttatacgcctccgacaaggacgacaagggtgtcatgagacggctcacgctggactacgacggtagccttcgcctctacagcctcgacggtggcggaatatccccaggaacgcggcttgtcggaggcggcgaggcgatctcatgttaaggcacgtcgaaggcagcggaggaggatttccggccgacgccaacacgagccgagataagttgagaagacgaggcggtgacgagaggagaagcatgtcacgttggatgcatggggcctatagccacagctagctccccgatcacctttttggtatattaagaccttaccgaggcgagcatagccgatggcaaaattgtcttttataaaaatttctctctttgttttcatcgaaaataataaaataatacagcggttgtccaccagctaattatcatatttttacagtgtccacgagaagataaacattctttggatgtctcttagacaaggccacaaactttgagtgtctgtaggaaaatttttatcttttttggtttgtttcgatgagatt

SEQ ID NO: 64853 - DNA, 1320 bp, Oryza sativa
cctaactcaacattttattgcttcaggtggatacaatcctagacaaggaaaattttacactggaagaacttcttgacgaggatgaaattattcaagagtgcaaagctctgaatacacgactcataaatttgtaatttccttaaatatttctgttattagtttgaggagacttgagtggcatgacatgattagtgtactattggctgttgcaacttaccattcattccttatgttgtacgtgtgtagcaaataagaaacatttacggtgttcttatgatttcacttattcattgtgattgatgcaaaggcaattcagttgcttcttagataagctagcagcttattgggtagttgctattttttcctggcacttattgttcgttggacctgcacaattctaattccatcatatggaagaaaaagtagctctttcatttgttgggcaatataggtggaatactatttttgggagtattgtatgtcatagtgcctttttatcccttattatatggttcaaaaatttcctctattatgtttacataactatttccatttcctcccttttctggggcacaattgttctttctcacttctacttcatgtctttttatttgcattcatatacccagagtctactggttgaatgcattacagtataatagtgtttcattgtttcttcaaatagatattagttgttacatttatttagtccgcctataataactaaaaattttgtttgtagcttgcgtgacagagcccaggtggagcaattgcttcgttatgttgtggaagaagtaccagatgatgctgaaaaaaagcgctctttcaagtatgacatttttgttaacatatgccatcatttatgtaaagagaagaattttccacctcaattttctgtccatctgttgtaggtttccattcattgcttgtgagatatttacatgtgaaattgatgtcattttgaggaccctagtcgaggatgaacaggttggcatttcttcatatccttttgaagtgtttgttcagaacattagtggttgtagctaatcacaattgtctagctaatgttatttatccttctgtatgttgcagttaatggaattgcttttctcatttgtgaaatccgatcatccacatagcacattgttatctggttacttcagcaaggtacttcatttgatcaggcattatatgtaactttaccatgggtaaactcatagtatgaaggcactgtagaagttaattttttaggtgattattgtggttacgatgttaaactccaacctgcttttttttttttgctgggttgaaatcagcttg

SEQ ID NO: 64854 - DNA, 708 bp, Oryza sativa
aggttttgaataatttagaacaaccaatcaaacaaatatgctgttcattgttgaattctgtttgtgtcaccttctatcatatgttctatgaaatttcagttttgttgggaggctatttcgtcatgcacttgaagaatcaaggcccaaatccgttctagttcattcattgtcagtgtgcatatctctgttggatccaaaaagattggcatcagcttcctatcaagcatttagaagcaacttaagtcacggggcgttggtcactgccagtccagagactgttgatggcatgcttgagagcctaggtgagttctggatatgtctttgtgcttttttttgttaggaaaaaatcttctttggttcatctatactcgaccttatcatatgttccatttctagggtatcttgctacctgccctttgcaatgttaagtttttgtatattggttataactgaccatttttgtaggcaatttgctgaagttattggatacttctgatgctgaaaatgttttgcctacgacatatggatgtttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctaga

SEQ ID NO: 64855 - DNA, 11189 bp, Oryza sativa
  unsure (1)..(11189): unsure at all n locations
gcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgataattagtcaacaagaaggcaatgaaagttatgaaacttagtgataatacacatgcattccaggagagtacacatgcaatatatagctgctcagttgattcttaacactctgtgtagcatatatgttgttttttcaggaaaaatagaatttgaaacctatttaattactaccaaaacctaccaccatacccacaaatgcccgatcaaaatgtgccgataatctggtgaagggaagtgtaggtgccaacgatggtgacgcacactccaatgaccagtatcccaacaatcgccgccacctcgaagcggacaactcttcctcggggcatgtagatcttgaggtagctcaggcacgggaacaacatggcaacgacgacgttcagtgagaacccgatgaacaacatgaggtagccgaagaagggcaaagtgcacgccagcaccgtcatgttgacaacgacggctgctggtgagcaccctggttagcccgttgttcctattgtcagccaccgccgccatcattgccgacagcttgtcctctatcgccattgtgatgggctggatcacgagcgcgtacttcgccagcggggtgatcagtgtcgtcaagatggcgatcttggtgtacacnttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagctcgcggatggcgagcacgatgtcgttcacgtagcagaagcccctcgcgccgccgcggcacgcgtggtgcatcccgcccgaccagttgatggcgatgtcggcggtgccgctcccaagggtgcgcgccgcggcgagcgacccgccggagtagcggaggcagtaatcccagaggcggtcgaacaccgggttgtcgacgccgcggccgccgcccttgccctcgacggcgtagatgcccctggcgcgcgccatgtcgccgaccccgtcgtcgcctccgcagccgtccggggtgaggtcctggaggagggcgaggtagccctcgtcgtggaagtcggcgagctccgccgccgtggcgggcgccgtgcggaggcggcgcatgtcgccgagcatgccgtaggcggcgacgaggttgtgcgccatggtgacgcggtgcggcaccatgacgtggccctcgccgtagtcgacggtggagatccccgggtcgtagtagtagcacacccgccgcttcttgtcgtcgccgcacgacggcgaaggcagcgaattgccgccgccgccggccatggccatgtttaacctagctacaccggcgagatgcagacgtcacggtggcgcatgcaccggacgtacacacgcacatatataggctaaacatatgtaaggctgatcgaagcccagttcgtgccggagttggattgttaattgacttttaaattattaattaatccgaaaacaacttccaaattaacttccaactacctgatcggaagtttggaacggaactcgtatatatatcctcttaactttcttcccgtgcaacggcgtctcctccccgcacgcgcgcttcctaaccctacctttcctttttttttcttttaaccttcttccatatatagatctaatcctctctcgctattttcttttaaccttcttccataaccccggccggtgagagctctcgtccacagctcgtcacatcatcgttgtcacgcgcgtctccaccggtatatctcctccgggcgtgcggcagcggtgtaggcggtgcgcacgccgcggccgacatcgatctacaaattggtgggagaggtgagaaattagctacgttcctataatttcttctcttttttcccaatttttgttattaggctagttaccctgcatgttctgctatatctttctatacatgcttccttcgtaatttccttgcttggatgggactagaaaatcgatgcgcccgttggcgcgctcaatatttatagcctattatattattatttaatgggttttaaaatttaggtttaaaactagaatagtgcccgtgcgttgcaacggataaaaaaatacaataataaatggatgacaacgatttaattatatcttcaggatattatctaaataacattatatatttttttatgaaaccttatatgtttgatattgtgcattagagtggccatgatggtaaataacattccaggaaaatatatttgttaaaccagccgtatcatttagagttttatagaattgaaagaaaaataagtactcccttcatcaaaaaaaaactcaacctagaagtggatgtgacccctcctagattgatgtatgttgttctaggaggtttttgttagacggaggaagtatttgttgaatcgtcatggccagttcattagttatactaggtaaaaccccgtgcgttgctgcgggagttcagtataataacaataagtaaaaataatgtgtaaaatagctaaacaatataaacttacataagttgatatggtttatgataatttaaatttaaatagatatatataataatgattcaaatgtaaaagtaagatgatgtggctttatgagagaagaaagggagtgagatactttggaccgtagattaatcgtgtaaggcaaaaaaaacaattgatatgatatgatttaatgggagaagagaaaaataatactaactaagtgaggatgaatcatataggtatatacgatattataaaaaatgatgaagatatatattgaaatattatgtgaattatgtgggatgatgatttaacatgcttacattttaaaactctaaaatgtaataaattataaaattatagataatataacatgtttgcatgatgtttaaatgcaataattgttagtggatgatgatgtggcatctttgcatgttgagctttgggatctagtgggttataactttataataagaaaagattatatataaccctatttttgctcatattacaaccctgataattgatagcaaaatttctgaaataattttgatgccaaattttgtgaatttaattttgaaataatttgattgatagcaaaataattatgtctgaatttaaatatgcatcaatgcaaaataatgttgtatgagcaaacaatacaaaatgatgtgtgagcaaatgtttgcccagagataagattgccttttcatacaacttaacggagaggagttaacaatagtttggctgtgatggaatttctgggagaaatatgcttgtacgatggcattttcaggaagttgtgtttgtcgatggcatttctgggattagggtgtttgttaatggtatttcatggattttctcttgattatatggatgagtatatgttaaatattataaaaataatgaatatatatgtgtgttaaaaatattgtgaataataatgtgaaggaagatgattggatgttgtttcgtagaattaaatgaattgtagatgatgttgcatgcttgcataagttttctatttaattattgctagtgaatgatgaggtggtatatttgcatgttgagttttagaattagtgggggttataattttatagtaagataggattagcttctccctaagacactctcgctgtcaattttgtcctcattcacctaatcgctcttcttcttcaggtagaagctaatttctgctattactacttgattattgatacaattaggccgtcacaaaatcacattggttagggtgggtttacttcgtgaaaagaaaaattttaggtatcagatcggacgtttgaccggacgtcggaaagggattttcggatacgaatgaaaaaactaatttcatcactcggctagaaattgcgaaacgagtttattaagcctaattaatctgtcattagcacatgtggttattgtagcactatggctaatcatagactaattaggctcaaaagattcatctcgcgatttccatacaaactgtacaattaatttttttaatctatatttaattttctatgtatgtgtctaaagattcgatgtgatgttttttaagaaaaagttttgagaactaaacaaggcctaacgaggccttgttacaaattatgtaatactctgatcaaattaattaggcgtacatcgacgtgtgccgcctgcggccggcatgcgcgcgggagttcacgttctacaagggcgccataaaccaaggctgcatgcatgccgtcaacgtgcatcgttggctaccacgagggcttcggctgcgacagtactgtgcatgcttaatcaatcgcgttggcccgtgtggaaagtaaaatagaaatggaaagcgtgagtggaacgcgggcgaatttttttgcgcgggcatatgcctgctgttcggacgacnnaanaaaaaaaaatccaaatcctattgccccgtggatcggcggattagataattacggagtaaaccgatgacgtccaacatttgttaacaaaaatatcttcaatttttataatagtagcgaaatacacgatgaacaaaataataacatatgtgttgctttataatacaagcatattatttatggtccttttcaagtaaaaatatacataagattttacatgaataaattcaattcttgttaggatgtgctacctgtctaccggctgaaaaatttcttgctttcagccgcttattttagcgctggataaatgtatcggacgatccaacgatttcctgcggcgctatcagcctatcacacattccgtcagaatttaaaagttgtcctttttgcaaaatagccatcaattttgtgagaattttagatacacccttcttaggcctaagctgttacaactttttcgcataactacctatagtttttttttataataaaaccaatgaaggaaaacttcctttctccttcgcatataatacttaagtagttttgtatacaagattttaaaaatactgttttgtatacaatctttgtgtgcaaagtactcggtatgctagttttttttgctaatttttgccatatgtgttcattcacttttctaacatgtatatagactggtcaggatcacgtctttactaccgattcaccattctctgtttgttttgttacgaccttcacgaaagtgaaacgagacgagaattgtaggcttctttcctaaactaaaagcggtggttcttgcctccctgtgcctaaagcgcggtgggcgactgcggtttgagtctttatcgatcgggtagatccatatgttcttgggggagacgaggtgtagcgcagtctggtcagcgcatctgttttgggatagtcatctcattgatatttttagtacaacatctaatctagcttaatcaacgtgcgtctagcttaatcaacgtgcgtctactttagttatctcattatttttttgtcaccttttgtattaatttactaataaatgtttcttgtttgtttgtaattttgttagcaaatttttaggtgtaatgagtagttgtctagtatctctcttatttctattttgtttcactaaatgtaagttgcactttatttttaactataaggttatcattaataatgaattctatgttatgatacgtatgataagttatacacgctattttcatatgtgtatcatgtaagtattaaaaatctatcaggtgattttggtttaacaggtgcacacacagacacggggattatggcggcggataagagtcctatcgatgaggctcttctccataggcaagaagatctacgagatgaggtggattacgacatggagcatctcctcctccctaccggcagcaacatggagcagcatctcctcctccctaccggcagcaacatggagcagcatctcctcctccctaccggcggcggctcattttgtatgaccggcgcttcctttgggaggagctgcctaaaccttagcaacatcatatccggcatcgggatgctctctgtgccgtacgcgctatcccagggcgggtggctcagcttgacactcttcaccatggtcggcgccatctgcttctacactggcaacctaattgaccggtgcatgcgcgtcgaccgctgtgtacggagctacccagacatcggctacctcgccttcggcagctacggccggatggccatcggcctcgtcatatacgtcgagctctacctcgtcgccatcagcttcctcatcctcgagggcgacaacctcgacaagctcctccctggcatagtggtggagatcctagggtaccaggttcacgggaagcaactgttcgtgctcgcggcggccgccgtcatccttccgacaacgtggctcaagaacctcagcatgcttgcgtacgtctcggcggttgggctcgtctcgtcggtggcgctgacggcatcgctggtctgggccggcgtggccggcagggcctccacatggagggcagcagcctcttgaatctgagcgagctgcccaccgccct

SEQ ID NO: 64856 - DNA, 26853 bp, Oryza sativa
gctaataagtttattttgaccatccaattaaaagtaagaattaggatcagacgaaatcaacattaaaatgatttattgaaataagttgtaccatccctaaaaaaatgttgtactagttatcaatttcgtaatgttaatttacactgataaggaatggcgagtgcaatataaaattaatggcaagtgcaatatacacaatttagtattgatatacttttttttgtataatgacataaattaagggtactgttgggatagcctttcgaccagtttaacgtgtgaagtgacgtggaggtgtactgtgctacaaaacagcctatcactccagtggaataaataggttcctggaggcgattagggtcgcctctcaactatatttggttacctctcatccacccatgtaaaagcaatgtagcttaaatataaagctaatcatgagccgcctaatatgatttaatttatatgttaaacctaaagatagaagatgtgtctagcacttaaaatgaaagaattatattagtcatttgaatacaaagtttacgaaatttgtttttaactaattttatgtgtagtccaatacaattttggataaattaaaatgcagcgtatctaaatttggaagatgtgttgcatcataaacttttctttgccaagttaaaatagagatatattgtattgtatatattcttgtactaagtttagaccaaccaataggtatgagaattgttagggataagatgcaaaagtggtaggacattgactattgctccattaactcatggaagtttcttgaacaatcttcgacctttcaccattcgtttactgatatttatccatgaatattgacaaatattgtatcaaccgttgcattcaatggtccttattttcatatgatatagctcaataatgttgcattttaagttttacctttcaattagagagatttggcaaccaatgataattgattacgaattatcagttccaattatcataatttggtttatgaaaccatgatggtgatgataatggatcagtactccaataatgttctattcctctccaattaatgtgcaggttttgctgatctctttggtgctgtgcagtctcaactacgcagtgacagcggtgttgggatatctgatctatggtgaggatgtgcaggcgcaagtgacactgagcttacccacggggaagctgtacactaggatcgccatcctgacgacactaatcaccccgctagcgaagtacgcgctcgtgatccagccagtcacaatagcgatagaggagaagctgtcagcgacgacggacgccgagatcaacaggctgactagggtgctcaccagcacagccgtcgttatcagcacggtggtgctggcatgcacggtgcccttcttcggctacctcatatcattcatcgggtcctcgctgaacgtcaccgttgctgtgttgttcccgtgcttgagctacctcaagatctacatgtcccgaggaggagttggctgcttcgagatggcggcgatcatcgggatactggtcatcggagtgtgtgtcgccattgttggcacctacacctcccttcagcagattataggcacattttgatcgtgcatttgtggttatggtggtaggttttggtagtaattatataggtttcaaattcttttttattttttttctgaaaaaaaacatacattatacacagtgttaagaatcaactgagcgccttgtttgtatcataatttggcttttagttagtccatttatgcaagccaaattatttagaaaagtgttgagtggtttgctcgagagtcagttaaataaatatatatgtgcagagaagagaagtatcggttatttgcaagttactagcaaagaactatagcatgcagttcggtatatttctgtatctgatcagattttgggctaagtgctgtaaaaggtgcagatggtacagctgatgagattatcgtgttctttgatggttttggatggacaacatcaaggaggcacagtgaatagcttgacaacatgaagacatgatatggattcttgtatttttcattgctgtcaaagccttatggtgttaatctagaaaaaagcataagcaggagccaggtctgtgctggtgttaagggaggtgaccgagatgaatttggattgtatctcgtctatacatactgattggtcacgtgaagtgagatttggtgttggtttgcatgtgctgaggacgattagcgcatgcagtggccagccagctgaggattgagatatatttttatcactttgtttccttctaagatcagagaatagcattatacgcatacatatccatggtactactttatgtgccatatcctgctatggatattaagcactattattagtacaatatatgggctgttgcacttgccctttggctctgtttgtgcatgtcttgttttttattcctctatgatacaagagattctctttttattgggtgttttattttttaagtggtttatttatacttcatgaagggttaaattgaaccatattatctaaaaaaatcctcactagagcattaatcattggaataatcaataaattacttgagccacaattgatggataaaatattcttaaccactacttcttgctattgcccaaaatttgatattggcaaagaacaaaacagatcctacatctgtgaactgagcaaccggggtggcatcactagcacgttgcgcacgtacttacacttgcacagttttatcttccacaacaagagtgaatagccaatgcggtctcttaattttttttatgttagtttaatccctgattttatattgtccaaactccaaataaacctcttaatttatcatgtgacttgatatagtctctaatccaccgaaaccgttatacagacatgccacgtcatcctagcatacatagttaaaatcaaaatattcattctaccttgtatataccatagaaaataagaaagaagaaaggaaacgacaaaacataatgattatcatatctttgtgtctttatttactacatttttatttgtcctttttctctcctttcctctttatttctctttttcttaaaaaaaatggcataggtgaggataaaatcaaagttggatggaagtaagtcaatggatctcaatccgaggaaggcacataatctcattttgttataacgtcacacaaatataactttggataaaagcatatctaacaccctaacctaaacgcttcaacttactacataatattgttcatataacttctaaggttgttttgaacatgctgatttccgtatacagatactaaataaggttttggttaacaaagatgacaaatttcaggactaatcctcgattattgtgattgtatcgatcctcagttattggtgtaaaaaagagtgcatgggagaatttgacatatatcttgaatatatctactcctcagtccgaagataacttcatttctaacatgaacagtttattctaaaataagttcatttctagcctattataaattgtatttcttttataccttttattctaaaacactcgtaatactatttctttatgaaaaataagttcacttttatcctgttataagttttattccttcaatacctttatctatctacctactcatcaatactattttaaggattattccttcaatgtcctttatctatctatccattcatcagaatggaatgctattttttttttcttttgataaggagactttggtcttttctctcaaccttagtttgaagtttgaacaccaaagactaaaaatagagttatttttgaatagcgggagtgtggcgtcactaaaatcatctattgtacatgtaaaattagataaaaccgaataaaataattagataaaaagcactttagcggttatacgaacagtattatgaagttgatagagttggttatccgacttcaaagtatgaggtgttagatggacttttactgagggtatattgacttctccctatatagtaatttagtaaaccaagcaaactacattaagagaccatggagcaacagcatcactcttgttctacacactttcactgcagcaacaccacaaattaaacctgaatacatcagagttgctactgctccctaattcagtctgttattttggtgttcgcgttacagaaaaaggctcaacttgtgtccacagaacctgcacctttctccctaagcttatccatggctgatgccaaatagttgtcacagtaaccaggtggctcatagataaagcaagagatcacgtctcgcagtgtcacgacaccaacaacctcgaagtcaccgtccacgacgtatatccggtgggttattcttgatgcaatgctgtcaatcacgctgccaagagaagcgtcaggcgaacaggtgagaggtggcttcaccaggccgttccctgaatcagaaacggtggaacctatggtcttcatgaactccatgacagtaagttgcctgtatggaagatttatcattaggaacatggaaatgcaaaattttgaaaatgactcacgcggtaacaaatagccggatggtttgatacctgaaattcgaaaacaagtcaggcctaagtaacaaaaagcgaatatcccttatgctcacactgccaacaagttttttgttgggaccttctactacaggcacaccaccaattttgttgtccttcatgcacttaaaagcttccaagattagatcaccactgttaacagtgataacctgaagaaagcacaaaattgttcaactaccagtttattgcaaagtgaagagaaaaaaaattacattgtagcatgtttcagcttgagatataacttttatcttgataatgtaggcagacatgatttctcattagtaaagaattggattagggagacacaattacctcatcaagtgacataaatggaagtcccaagtccgagagagggagcgctgaaatataatcaaaccaatcccttcctttgcactgctgaagtcctttaacaacaccagtctgagtaatgaagttcttaataattggcttatcaggctcaatcactgggacattccttaacctgtacttggatagcaacagtaatacagtaagcattgaagtgtccagtgtaatggggacaaaaggagaccagcggtaggattctacaattgatcgaacctataataatgagaaaaaaatatgaaggttagcaggatttacatcagaagatcatcatgcaatattcaaatgaggcaaagaggacagatatccaaactattattagcaacaataagttgcagctaagaaatcacaggaagttttcaatcacgccaagctgcggcatatattgtaactaggatagccaaacttcggtgtagccacacagcagaacagtggttcaaggtaaaatatataccaaataatttgagactgactggactctataaatgatcgacatttaacaaaaaggaaaaaaaaatccaaatatgcataataattcatcatagagtaaaatgcatactgtagttgatttgaaaggttcttgctgaagcagaactttgtagaaatcttctcctaaatgatcagcagcagttagtccatcctttgccacacccttttctgctgttaacccaccagcaacagcagcccctactgcagcggcagtcaagccagcaacagctgcaggaccagttgcacccaatgctgccactcccactgcaccgacagcacccattccaactcctgctgcggttgctgacccagctgatagagcaacggcggcaatctcagcattttctagaacccagaggatgatagccgagtaatcaatgatgccaaggtacctccctttccaatcagccggagctccacattccggatttagcactggcgctgccctaatgttgtgtttggagagaattctcacagcgtcaagaacggaagtgtctcctggaatttcaatcactgcaatgcaatgtgagggatcaaaaaaatacatggcgcggacaactagttagttaattttgtcttgcagacgtgtgtacctcggccattaggaacatcaggaaaagacgagacaggaatctgagcaaaggcagcagtgagcgattcttgcaaagagaggggcagcttcttcttggactgtatagtgtcaaaatacgcatcacagcttgggaatttcacggtttcatcaggtcgatccatttctacacaaaaaacaaaaaaaacaaaactcactcaaacattaatcccagtagatggcagcaatctggacacgcatctaatctaatcatggcacagtagatactcataactaacccaatcacgacaagccactttggcatatattagcaaagttcatcacaagttcaacggaggtacactattaatctactcctgtcaactaatcaggggctaacactcccaatccaatcctaacaaactgctactcttactctggttaggtccaattcaagaaaattgcttgcggatctggaagagaagctaaggctaacgaaatccgagaagaaaaaagaaaagggggttaggcgtagtgggtagtaaagaccgcaaagagagatgaggaagaggatgagcgtgagtacggatgcttcaccgggcgaagtggcggaagcagctgggacttccgccggcgtcggttgctcgcgggaggggaaggggatcgatcggggcgctgctccgctcggcggcggcggcgcgaaccgcggcgattgctggaaaccgtgggcggcggcggcaatccaggaggaggaggaggagggagatggattcgattgctagctagtactagtactacggtgcctcgcggccatgggggcgcggtgccacgtatgcgcttgggtggggccacgtcgcgcgaggggtggcgttttcgttattatattatattatattactatctccgttttttaatagatgacgccgttaactttttattacacgtttgaccattcgtcttattcaaaaaatttacgtaattataatttattttgttgtgagttgttttatcactcaaagtattttaagcatgatttatatctatacatttacataaaattttttgaataagatgatgatcaaacgtacatttaaaaatcaaaggcgtcatctattaaaaaacagagagagtatataattttattcttttttactaggccgcctacataatatggcccacggttgaaatagtccgccacatataccaggacacatataaaagtggaatatatttattggagttcccttaactttacaccaaatctgattttcatccttaaaccaaaaactagatatcatcggtccctgaacggtcaaaactggtacaaacgaggtccctcggcggttttggctgacgtggctggtttgacttgatcttcgtctcatgtggcatttgacgtggcgcttacgtggcaattttatcccaaaaaataataaaagccaggccccacatgttagctacacacaaaaaataattaaaaatagtggggcccccacgggtcccacatgtcagcctcacctcccttcttccctctctcttctttctcatcctcactccttttcttctctctccctctcttctttcctctcccctctcttcatcttctcttcccgcgggcgagccaggcaggcagcgggcggcgacctcggcgagacggtgccctcggcgaccttggcgaggtgacgacctcgcgtgccactattgcactccacctccaagccaccgccttcctctcccctcctccccccgccctcgccgccaccgatcccgggggttcaagggtaaacgtgtgagaaatgaacgagtaaacgtgtttttatgcgggtagtgagataggccacttacatcactacataaaagtaggtcaaccgctttgcagtgtaaaatacatcagagcttcagaaaaaaaatgatgaaaggctaaagtttgcaaatttaacttaacaaatttaaccaattcaacataatttgtttaacctagttacaaataataaattgaatttacataagaagttgagccaatctgctcatctggattcgagtctaagacttaaaaaaacaaacaaacaaatggaatgtcgttattcttgtatgtcaatgtcagcaattggaatttggatcaaaactaaggactggtatgatttgtgacctaaattggtcttaccaatttttaaaatgccaaattttggtaagttttgacatgactaattttgggaaggtaaagttgtgtttggattaaaggtaaaatagtctaagttaactattgaaatgacatattttcttaggcatgccaaaatttggtttcaaaccaaatagacactaaacactattgaaattgtcaaatattggtaagccaaatttaacccacgaaccaaaccagccctaaaaatttttttgttgtttaccacctgtgcattagtggtagataatttgtatatttatggatgctagtacagggtgtttgtcactcgtcagcatggaggagccaagttgaagagctctccggcacccttcccaccggcaacgcgcgcgctctgctcacggtcacggacgtagctcgcgacggcggccgccaccgtcgcctggaacttggggtcccagatcgccttcgccacgacatctgcctgaatagggtagtttctctggctccatgacgactgcgccgccggcatcgcgcgctgaagctccgaccacgtcgaagacgacgaggaggaggcgagcatggctaccgccgccgatgaggaggacgacgacgacggagggagcgcggcggcgtagggcgtgatggggtggttgtggacgccatcgtaggtggtgacgaggacggaggtgtcgtggttgcagcgctgcacctgcttcttcacggggcaccccggcgcgccggtgcaccggtagtagccccgcggccacgggttgcccttcgccgtcttctgcccgtacttgcgccattgacaaccgtccttcacctgtgagataaaattcaaaaataaatcagctcatctataccattgtactccctccttctctaaatgtctgacgccgttgacttttttaaacatatttgaccgttcgtcttattcaaaaacttttatgaaatgtgtaaaactatatgtatacataaaaatatatttaagaataaatcaaatgataggaaaaaaataataattacttaaaatttttgaataagacgaacggtcaaacatttttaaaaaagtcaacggcgtcaaacattttgggatggagggagtatttgcataattttttttacataaggctgtatattatgtctcaagttaatggtgacgtatgtatttctttttttaaaaaaaagagggaatatacaataatgaagcgtgcatatatgtctcaacttatacaatacttctttcattttatattataagtcgtttgatttttttcttagtcaaagttctttaagtttgactaagtttatagaaaaatatattaacattttcaatacaaaataagaatatcatcaaaatatatgcaatgttaaatttaatgaaactaacttggtgttgtaaattttactaattttctctataaatttaatttgttcaaacagaaaaactttgactgagaaaacttataatatgaaatatattaattggtcactatctatatgcgtgtgctacgtgcgtaccgtgggtgcgctgcatcgtgttctgagtacgacccggccaggccgattcgccgtcgacgcagccgtgatcatgcaagaccggtcgtcgtcgtcgtggcccgccggcacggcggcggcggcggcgccgcccccgtattcgccgcagatgctgctgctactgctgctgttggtggtggccctctgcctcttgggatgcaccattggctcgccggcggcgggggcgcaacgcagcgcgagggcgaggtacccgtcgccgccgccgttgccggcgtccgcttcgtctttcttgctggcgtggcactggcacgcatcaggagacgatccgaggctaagcccaagtgacaggaataacccggcctcgtcgtcgttcgcgtgatgccgatgaacctacagcaaaatcagcaatcgattaacctccagagatgtttaaagctactaaacagcatgtaactgtaataggttgacataattatcatcatatcatgcatgcatatgggcgttctctcggtcttaaatccaccaaatcaatgtaagtatgtaactgatgcttttcagaatagtttgttcattagtttctggtatatattgattacagagatctttgtcaaggtaacattcaaacattcatgcatgctaccaattaaatgtaaaatacacatgtaagagcataaacaaaatttcacaaaaagatgttcttctaataattattggtcaaattaatctgaaactatagggggcatatcctgtgaaaatatggcgaacagtaatagctcattatcttttatccttcaaaactcgttgttggagtttgatcttcagacaatacatagacagtaaaagtgtacgatatatgcctttccggcaacatgttgaaaatggaatttgcacaagaagtgcagaggtgtgtcacagagtcactggacatgttaatctccctagtagcaaccgatttgcagtaaaacatgtagtcccaacaaaagaattatatcatcttaatttctgaagctctgaagcatagaaaaaatcatctctgaatcaatgaaataattactgcatatatataccttctctgaagctttctgcacctcatccctgaaaagtgtaaaagtgttcatctcgatcaatctctgaattcagacagaatccaaaaccctttctttctcccactccctagtttttgctcctttctgcaataagccaataactaagcatatccctgcagcgagttctatctgaatatatagagggagcagcacctgaaaatgtcaaaagctgaccaaaatatccaacgaactgccgaattcaatctctgacagagccgccaagatgccgagggcaagcaacacatgcgtcaaaaacgagaataaactcggttgaatttcgtttagaattcgagacgtgaccgctttggtcatttcaatttgacggtttctcgctttgccgcacatccactcccacgccggaaagatgtaaattcgatctaatcctcgtgaattccatgtgcacgtgcgtgtccggccgtggtctcgtcaaaattcggtcagaattctgaactaaattaaactggttggtcgggtgttttttcttagccacaagctgggaggattatccctcgtgatggctacttgttaacgataaatcccgtgtgattattttgtagttttatcttttatatgctggtttggttagaaaaggagacaaatttgagacatttcgaagaagagtattcgctgtaccgtgttcaaagggaggaagtaggtttgagaataattctcggattgttgtgacatcagtcagctgcacgcgtaattaagggcttttgtttagaggctttcacgttatcaactcatcatcgtctgacataaagacggcatagaaaactcttcggaaggcacgagacagacggaacagcatagaaagagttttctactagtatgaattaattcagattgactaggcccatatacaaatacaaaggattattagttcgacaagactattgagtcttgtttttttcgcaccatggttatctccattgagagaagacaggttgtttttttttctttttctatatatcctctatatcatgagaggcatgtcgtggtgctaataaagataatatatactctttacatataagtcgttttgattttttagtcaatattgtttaagtttgactaaatttataaaaaaaatagtaacatctaaaataccaaattagttttattgaatatattttgataatatgtttattttgtgttgaaaatattactatatttttttctataaacttgatcaaacttaaagcgttttttctttttgcggggaaacttaaaagaagtttgactagaaaaaagtcaaaacaatttataatataaaatggagggaatatctatctatctatctatctatctatctgtgtgtatatctatcaatttagcaatcttctatactaactgggtactttgatggacctcctatgttaaagaaaaatatagatgttgattagatcgagtgcacaattatgttgtaccgcagattgtatttagaatgtgtcaatttaaacataaaactattgtggactcttcaaatttacttaacatattagataaaaccagactttctatctattacaaaataataattattaattatgtaattattataacatataaaagactaattatatatcatataaagtctaaacgtagtacaactttatttaataagagcggattgtatttttgggctccattttataaattttactttggaccaccatttagctaatattttcaattgaataaattgtgctttgagttattttttattatcaaagtatcacttttagatcaccctttatcttatccttttactttggactaaataattgtctttgttgcaatttaaaccacccccaaaccttctttttttttcaagtataccactgcaggggaagtccctacagcatcaccccagaccattttcttcagtacataaaaaaccttgagcacattgactacaactcaccgataaactccctcatccatacgcaagatatatctttgttggaggagcggttagtcatagctggagaaaatacttggggttgatccaaagtgcaaaaaaaaaagagtaaagttaactagtcctaagtgaaaaagaaaaatatagtcaaaaggtagtctaaagtgaaaccttgataataaaaggttagcctaaagcacaattcactcttccacttaacttggttattttgcttatgttgcactttggaacatcccaactctctgctcgagcacatcaattacttcatgcacatcggtgcccacacattagggatcttccccacttgcgtgtatgccaccctttgttggaggagaggctaatgtggctaaaaaagagagttataatggtctacaacaaatgcaaatttgcgtagtccaaagtgaaaaaattaaataaaatatggtccaaagtgaaacttagataataaaacatgacgtagattgcaattcattcaaaaataaataaatttgctatgaacatgacctaagttatgaagcatactaaatttaaactttaacacaaatacaattaaacactaattaattcaaaaatatttaaataaaacataaaacaatagaagatacattaggttggatttcgaattcagtattttattcaattctaaaaatttaaaattaataattagcaagtaataattgatgtgaactattattttaatctaatcatctataatttgaaaattttaattattgtattcgacatatgattaaattttaatattgatattactaacactaatatataactcatgcagcacattagttgacaatcacttattgtataggcctattgtatataccctaagaaagacacataagagcatgtgtagtgcggaacaccaacccgtctccccagaacctgccgtcctatcgccgtgagtttttccttaggagggagagatataaagttcttttttctatttctatggccattatttggtccaacattatagtgttgaagcttgtttcattttgccaatctataatgttcaatttttcataaaagcaaccatccagttatttctcaagctaacatttattttaacatcaaagtgaatgaaatggttgacttcaagcaattgaaggatgcacgtgcatatttgtgataaactggctgagtaatgaaccctgtgacatgagagtactcttggtttctatttgttacctttaataagttgacaaatgtagaatgaaccagagaacagaggggctggattgattagcatttaattaagctagggatttgtttgctataaacaaaacaaatgataatttggtatcgaccacgtgaaaattgcatcattggtccattggacatatacatgaatggctggtccttttcgcaaggtagcagtagtgtattagaaaaacatactatagataatgcgcattcaatttaaactgtttagtcaccaagctttggcccttccttaaaataaaatcaaaccagaactgtttcgatatatgagatgacacatctgcaacggtagcttgcgtacactcaactatatagtaatagagtaaattaaatgtcaaaaaagtcgtctggtattagttctctcggtgcaaagacacatataatattctttgatgcgtacctttatgtgttcctgttggttatctctcaccttgaaggaattaatttattgaatcttgtagaccatggatttttttccttaattaatttatacatagtatatatgttttatattgtactagctgaaaacacattgtaacatcctcaaattttaaactaaaatttgactgcatcatgctggcttttgattaaatttgtttggttcaaaaatctatttgatttttatttaaaattggttcaagtattagagcccaaccaatttactctaacttattccctttattctaaaccctagtgaatttgagcaaattctctcaaattcaaaccatagattatttctttagcttattctaatattagtggagatttgctatactctaaaccctagtaaaacctttccaaactcctagtttgaattcaaatcttttctagggaaatattcaaaaattttgatttttcctgttcattgcacacaagctgctcgataaaatgcttagcccaactagagcagcccaccttcaacttaatcttgcacaaagtctaggtttggtcctaggggaccacatcccactcaaaaccgtggctttctttgcctcttactccccttcatgcgcgccgcccgggcatccaactttgccgcgcgccgtgtcgctgcgcgtcggcctcggggcctcttgcgcatgcccgaccgccttggcgcgccatcacccgtccgacgccctccgcccaccgccgccgcaccaatctcgacgacgacaaagccgggacgacgaccgccgcacgaaatcaccgctcgacgccgtgcgctcccatccaagccaccgccgaatgtgattttgcttctacccggggtgaatcgcgccaattcttgccgcacggttggattgaagatagacggtggtatcccctctcacaattcaaaccattcaccccctagccggccgttttcaccctcgccgccgccgcgcgtcgcgcccagattggcgccaacacgtcgccagccgattccaaccgcggtcaagtcaatccttcgccggtaagtattcgaacgtggcctcccgccactcaaatagatcttgcccgccctctctcagcctctgccacctttgcctcatccaaatctcgagctcctccatggcgatgacggtgcccgagctcatccgctcctcctagccctataaataggaccccaatcccttccttgtccatcatcgatcatcaacaaccatagccccacaaccccgaagctctgcttcaccaatccatctcatcaaccaccctcgcctgtcggtcgaacaccttgtgcgcgatcgactccacccctctccatccatcttccgccctaaataacccttagaacacctatattctaccatgttctagcgtattaggccctaaccgaagctctgcgtcgagttttacctcgccgcaccaagccaagcaccgccgcccctgcgctactctgttcttctccgccgcgaagtttttccggccgcaatccgtcgtttcaatcgatctcggtgagttcttccgtttcaaccatctacatactacctagagtccatttttgcaatcggtttgcactatcttgccaccctctgagctgccgacgtgagcacggccgccgcctatggaggcgctagtcggcaactatgctccgcgccttgccaaaggttggcaagctgccggaatccctctagacacctcgtagatgctctagaacccctcccctagccatgtctaactctcatcactctggtcgccatcacagcctaaccgtgccaccgccgctctagccgctaggccgtccacacaccaaattagttccatcgccgccgctcgccgtcgccggagatccctagctccctcccctcctcggccgcaaccactttctccctctagtgccgccgcaatcctaaaccctagcgccgccggcccgatttggggaacggccggaggtagaagaagaaaagagagagagagactgacaggtgggacccacatagtgccatttcacatttatttgattttcaaactttagaagaccatatcttttaaaatatagatccaatttcattaaaacttggaccaatattcttctaaaatcatcctctatctactagacccctttttgctatttttacattttattttatttactctatttttcttatttttggattttatttaaactcctttttgaatttgaattttatatgtctaaccctaggtcttgaggattcctctgacactctagataatatcaatcaatctcaggacatcgagcaaggcaagttaccatatacatgttgatcatttcagcctatattttacaaattatttatttatagccttctattcaatattctattttctatgcataaattaatcatagaaacccagataatttagtattgcttattttgtttacaatctggttaaaataccctatacttagattgggacaatacgtaagatttggatgatttccgggtggctagtattgtctcaatcgatataagttttaccaggtacttatgtcgaatgaacgagtacgaccgcagtttctagaatggggatagacctagttattaggttaattggcaatatggcacctctgtatagtggttcttatttttaagtcctcgcgcaggaggcaactatagccgcgaagggcaactttaaccattaccatgtacaggtaaatggcttgtgatactcgagtataaactatatggtatatttataaaccctgatcgagatgacgtggtgtcatacgatcagttccccttaaatacctcgggaacgccagaactcctcttgctgctgttaacattatgttcagagcatatgaggatataagttcatggaacaggtgccataattgttaatgacttaatgttgggctatgactaaagccgataattatcagcaagtcgtggactgcgggtaaagcgtacatctgctgcagtagaatatctttgaaactattcgaatagctgtactcgtggagttgagtaccgggactcatatggtaccctggttagaaatctaaagtttatatgttttataaattctgctataacttttccagattgtctaatactgctttttgcaaagaaccctattatatgtcaatgcataacatattttcattataacttgctgagtattgtgaatactcatccttgctcttataacccctttttcagatctgggtcaagaggaggacccatatgactattactacgaagaccccgataacttagaaaatccctgagggttttacctcactagtcagaatgtatagaaacttccgctgtgtactaattagataggtgagtacctattattgtaaaacccttagtattgtaagactttaacatatgcaatgaaaaaccagttatattgtatgtatcaatttttaatgatccagggattgatacattaatctcagtcggatccaagttattagttttgggctccgacacacatgtatgatgtgacaaacactacaagaaaattggtgctctaatgaaggtaagtcttaaatttgctgttcatataggccgtctgaaaatgaattgttttattgatctgtacgtgctgcctttctatatatacagctgcctactagtttattttgagcaattttacggtccttaagtagataccaggaggtaaaaaaaaattagtataaaatttaggtatacctcgtagtaactagatactaagaggtaccaattttacaatagaaaaagttatatcttatattatctcctcaagaaaccgtaaaattgctcgcttaccttgtgtagtcctaacaaattaatatatgtattatctatctatccatatatctgtctactagtagtgtatctattagctagttttatgtgttctacacttttatgtagtcttaaaatcaaaaatatgtattatctatctatatatgtatttgcatgttagtttatctattattagtcagtgtacatactttatatagtattaataaaattaaatatatgtatcgtctaccttactatatgtctactggtgtatctattactagtttatgtgttttacacttttttgtactcttagaaagcatatgtgttttatctatctatatatctgcctgttagtttgtctattagctactgtacacgtcctacacttttatgtacgtagtcttatttttttagatacctactatctttttttttagataatgacatacctactatctatctctatatctttcttgaatatctattagctaagtatagatacatgtattacaattttcggtagtaaaaaagatcttgccaattatatgtttgctctccttatggtgcatgctccgatcatccgtctttctctggcacgagcgctgcatgaaggcctctcataatgagaaaaattgggaggccaaacaaaatgaacaaaacccttcgaggttactctataaacacttatacgttcaaacatgcacaataatctcaccaactcaaaaggtgggaccacctctagtctaaattctttgttggtaaggaatcaaatactggataattcatttcaaatagatactcaaatggaaaatttcgataccaaagtagatgctactccctcgttggatatttagcaaaagcccaattttgtataggattagggtatcttattagtaaccaatttggacctatttatcatatttggatattcttgattggtttggtggttattacatttttttttgcgagtgacatacttgtagagataagaatatcataattttggtagagatgttgagggcgctcacaatgcgtcaccaatttttgccgttcctcatataccacatagacgaataacctcataagcttcatactccacggtgcaagtaccagtagtgggtcccactaatacatcttttcacttttcatctcccaatctctcaccttcgtttcttttctcacccagtactctctctcaagtactagtagtggagcgaccggcggggcggcccgagcggcgacgaccggcggggtggtcgagcagcggctcgagctgcgcggcaccaggcggcgaagcggtcaagaggacggcgtggcgggagcaacggaaggaatcggcgcacgagctggggaaggcgatcgaggtcggcggcgggggccgactaggtcggcaacatggacttggcgcgggagtgaggacggcgaggtcaggagcgacggcctctggtagcgggagcgaaggagggcgagctcagcggcgtggaatcggcccgggagagagggacagcgggcggtgcggatctggcgcaggagcagccggggccgcgacctgccccacgacagcgccggtcctctgcccccgtcggtggctctcccctctcccttctccggcatcgtcgggcgaaggaagccggcaagcttcttcagccccaccaccttccccatcgacccagcgagcatccagcggccctcctcccctggccgacgagctcggcgggcgtggagcgcaacgatggacaacgaggtctctctcctccctctcccatccttgacgtgacggtgcggagcacgagcgtgggtcccacctgcgacgaggaacccgtggccaaggtttcctacgtgttcttgaggaggccgcgcggatagaggacatgacaacgaatattcgcctttttggttgaggccgaacgccacgaagacgcactgtgaatggcctgagaatatgcgtttttgcagggggcatagataggagaggcgagcggtggtttagcctcccccatgtcttgaatttttcactagctaaagttactgtcactttagcaaaatttgaaaaaattaacattattgatcccctcaattataaactttttaagttctagctccacggctgctttttttttttgtgtcaatcttttcgaggaacacttctacgtcatcgccaacgtcgaatttttgcttctatacatgcatagtatgcaccactgggcacgcatcaggcagtttcaattcgcctctaggcttgacttgtcacaaatgaacccaaaaaaaaaagaaagattgagcataatcttcaggtgtcagagctgacgagacgacagaaggaagttttcaaagaaagagtggaagaccaaacgattgaaatgcttagctagcagatgcagtgcttctatcttctggttctgcccttctcctgcagtaaaacatggatgctttcgtgctgctaaatgataaattattggtcaaggtagtatttggattcttgattgccacgaaattaactatgacttcgtctgacggtcaggatttcttccagggatctattctacggatatgtattctagtattctacggttgtatagaagagaagaatcttttttgcagaatagcatgtatcttggtatagaggttttactggtcaattttattgatcattttactgtttcaattcagagtccacaatttggagatttcctttcggtctttatttaccctttgaaatcagttacacagatttaagaatcttaaatcgtataatttattatattaccaagaggtcgaaagggacttaaatagattggatggtgggtctaaattataacggtcgcgtagatcagttgaatagttgatataattataatggatgtgaggtcgaaaatatatgtttgaatcaaaacattcacttgaaaaactaacataggaaaaaaatagagttgtcgataaacaggacacatagtttcaccacaaaagattattcaaggaaaaaaaataatgcttggtacacaaatcttgctagcttcttaactcacatcctttgatcactctccctatctctttctacgactatgcatatctctataccaggcaaagaatatccaaatttctgatggaagatttgcatgccctcaacataaaaaggggatcaagtcattgtacttggcttcacaagcacagcgttcatattgaaagtgcaacgttcttttctcaaccaatcagatagttcatcagtaatccgcctgcttactccacctacggttaaaaaaaagtcacacaaattagcaactaacatttagtgttcaaatattacataaacttagctaatacaaagaatttggttgtgtatcttatggcagatatcgggggtataaaatatttataatgccaaaataactagtaataaatagaacaaattggaaaattttagagcttacgtggcgaaggacacactccatagtatgagcagtcccttccttcaactgaggaatatggtgggcccatgacatcaagcactgcacaagcagtttctgcagtgaagcaatgaaggtttcctccactctctgggtatagaaccgttgtcttagatgaatcatcgtagatggtgttagttctcaccttagcaaaatgagcacctgtattttagaagactggatattagaaaaaaaaacttgtgaaaaaatgtggtgtaaatgggaacatgtgagagagaaaaaagagtgaatatgttagcgagaaaagcactcaaactaaccatctatttccctgcagatacgatttttaccattgggagttttaacccagtcatacgactttatgtgcattgagccatgaagaatcttgctaaagacagtcatccctagatggtcatggagtggaatgacagccgattgtggtagacaaaacacaccaaactacaaaaaaatgtgtaaaatgtgtcatctaagtggagtttacactaaatagacacattttccatgattcaatgtcaacaaaatgtgaagtactaaattaccgagaagttaagactatcatcaccaaagtgcacatatgttactttaggatgcccttgaggatcagctctaaaatacggcatgcttgcatcaagcccaaaatcctctagcttcaaggtatctgcatcaatggtttaatgtgttgatttgtgtgaataccacaagtgcatgtagctaaaaattatgaattggatttcttgaaaacaattatcaattggaagcaaaacgtttccattacattcccaacaaattctcatatttatgcagcatccacaagaacaaaaaatatatatgtaacttcctatatcagatcacataattagatacacttttagctagcatatttcaatatgtgcgatgaaaacattgcatagtaggcaattacaacaaccattgctatcgcaggaaaatgtccatatgaaaagagacgcagtggacaatgcaaccaccaataaaagatcatgcctgagatttatggattaaaatcttgtaagaatacgtgtatgaaataaaaaccactaaatcaaactaacctccataaaagctcagagtatagtcatgctcatgcaaagctcaaagtgacgggcatttctagatataagatggtatgcgcatgatatagatgcaaagacaagaagatgactgctaaccgagcaacttggtgaggtttgcctcggctaacgatgatggaacaaagcctggcgtggctgcaaagaacacatccctagcgatgtcatgcacttcttggatcttgttcatcgccgagtttggcagttctagttcttcaagagaggaagtaggcggtttcttctgacggcgggtggtcttcttggatgatgagaaggatgactccaaaacacccttgctccctgcccgtttcatcgcgtaacagacctagaaaaaaattaaatcctacaattccaatatagaaatgaccttttcaatcaccaaaactataaacaaaatcaccaaaagaatcaacaagaacatgaatacgattaattaaaacctaccccaaaaggaacccaatgattgagattgtataagcggcgaggaaatgaggcaattagagtaggcacaaaggtgaggaacggccgattgggtatatatgagcgaagggtcgcatatggtgggtttggaggaaggagaaaactaggggcgggctgtataggggacaaaggcgagattgccttgcttcctctagaagattccattttctgtgggctataagaacttggaatccaaaccgctggtttttgtaaacttacaattaaccattcaactatatcaacattttagggaaatgacctacttaagcattaatcaataaactccaatatgtcacatcaaggtaaatcccaaacctcacttaacactaccccgaagtatcacaaatttctagttcacggccgatttgcaaaggtagcccttcctcaccatactctggttgttattcatttgagaatttcattattcaattaatttcacaacactacatactttgacaaaattatcaccaaaactgtaaatttaaatcatcatatcacaaaaccacacatttaatgtcaaacctacctcaaaactataggttgaaggcataaaactataaaatttagcatatgatttatctactatagtaaaaaaacggagtccatccgcccacgcaatgggtaacccactactacataaaaaccatccctagagaaaaaaaaagaatttgatccaatcctacatgaaaacgaactcagaagcaaatcaacccttcacatccacatgtaaccaactaggctagagttacttataaaggtgtgtaaattttggatttttgtttcaaggaatgaccaattaactaggatggagcttttaaaattcatagttctgtgataaaaactaacactaaatctgtaattttacgactctatgacttaaatatatagtttcttggtaagttcagcaccaagtttgtagttttgtgatgcaatgggttaaatatgatacggcttaaatatgcaatattgtggtagttttatcaaagtatccatagtttttctaaattttactcttcaactttattggactgaattttggacaaaaaatattggactaatagttggtggaaacaaagtggtggatctacagtaataccactggtgtcaggcgacaccgacgacttttggcaaaagctatgcttaaactgactatccatatattataacactatattctaaatgtaattagcatgctatgacaccgataaacacgttatgacaccaacgaactaaatttctggatccgccagtaaaacaaacacttccggtagtgaacacaggaagcaactccaagttcgtaacaagtgcagcaaatcaggaaacacttgctatagttgagtctcatgtacattgttaggtccatgattagcttacatatttgacgttctagataagaatagcagcatttgaggtggtcagtggtagcggtggtagtgcatgtaatgactactgctaacagcatcaaatggaggaaaggttcatgttttgtatgttatttttttgtgcgtgtgtgtgggatcaaggaggccgactagaggggggtgactaggcggtttttcaaacttttggctaaaaccgagttttgtatgtggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatttgcacaaaataaaggagacaagagacaaggaattttcaccgaggttcggaaactcgccggtttcctaatccccgttgaggcgagcccaactccaccgctcaaccacgaagccaccgcacggccccttcgtcaaggggtgggcaaggcgggagccggcccacggagaggactaccaaagcctcgatcactgggaaagttctatcttcactccgaaggtggtgaactcaaaaccactctcaactggcgccgggcctcctccacaatctcctcggagaggtcaccgggcaacacctccacaagccgtctaggaggcagcaaccttcaagagtaacaagtctaggatgcttgccaaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttgcccttgctgctggggagtgggtatatatacccccaaccaccaaaactagccgttggagtcgaaatccccaactctgtgctctgccagtcagaccgccatagagtggacggtcagaccggactactttgtaacggctagaaaactagcagttacagggcaatcattgagcccactcaacctggccggtctgatcgcagtgaagcggccggtcagaccgtccacggctgggtcagaccgccatcggctcggtctgaccggttgcggctctggcggctctgtatcgccaccaaaaaccagaccagtgcaacagaccagtaggaccagtcagaccggccttaccacgccggtcagaccggctaacagccccggtcagaccgacctaaggcccacggtcagaccgctggtcacttttcaacacaactaaccgttagtaagacggcgatatctcttgactcggatctcggaatttggcgttctctgactctatggaaagcttattcaaagggctatccaacccatgaacaatccatccaagaaacacaacttttctcagggagaaatggctcacactccaaaggatactccaccggacataaccacgtgaggctacccaaacctataggatgtgcccacttctctctttgtttgggacttgataaaactcaccacacttggctagacaagcccacaaaatgcatctatatgcatatgaactaatatggcacaaaatcatccgcatgctcgcttcatagacccctcttgatagtacggcacctatctagtaaatccggtctacaccaaacaccaagaccggcaaaaagactaagaaaatattcttagctccattatacctttgccttgtgccatccaacttggggtcaatgcttgagccaacatcaacacttgtgaccattcggttgaaccatgtttatgccgaggtctttgccatcctttgtcaagacttaattctcatcacaagcttgacttcattcttgccaacatgacgatgtccttggcttggtgaccattaacccatggtgtcattcattagcctcatcgcaattagatctattcctttgcacggctcaaaggaaaacgttagtcccaacaaatcggttggcatcctccacttggtgaccaaccggttgcatatgaaagatatggatatgtttgttgagtattcattaacatcataagtgtcatatactcgtatgcaagctcaagtgcaaagatccgatatatataataggtgaacaacatggatctaaaacatgaacaataaatgtataggatttgctcccctaagtatatgcatacaaagaaatatacaagagagacaagtgtatgcataagtaaagaagaaccaatgggggtttatc

SEQ ID NO: 64857 - DNA, 1984 bp, Oryza sativa
aatccgatataaacaatacaaagagatgagatgaaagataatttcaaatcaaggttgagatcttataatgaacaaaatatagaataagctccaccttaagatgtgcatacatatggatatgaaggaatgcatatgcacataatcaatcaagatcaatgagggagctcacactgtattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacaatctccccctttttggtgatcgatgacaaatccattaataataaccacatttggatatgaaggatataaaccaacattatattgaagcttgacaattgaattatatccatacatgtcaatgagtaaatagaagtgaaatatatgccaatgacatgcttatgcatatgatgcatatgtaatggtatgatgtgggatcctagaatatttcccccttttgtagctatgatcataaggagatcataaatattctctccctttaagatcaaatgtgggatcctcaaatattctcccccttttggcattaatcacccaaaaatgaaaagggctagaaaataggcaattacaaaagcccaaaaaggaataaagactaacaaggccaaataatatttttgtgcaagcacaaagcaacaagtttagaaatgacccatttaggaaaactcccccttactcatagagtcttgtctttgaatatggaatttggaatagatttcatatgtagaaggggttagtttgagcacttgaactttcacttgagatattctcatcaaaggttttctcaagaatgtcaaaaattgagaagagcttggtcaaggctatttggaagaattttacaagtgcacaatatcggcaaagaatgaaaatgatgagatagtgccgtgttcaagatgatcaagataaactaccatttatttagagaccacttgtgtataggaattcgaattctctatgtgtataggaattcgaatttgggatcaaggaacggtatttggctttagtagcaaggattaacttgtattttggtggaaatgattggaatttggagtctatccttggaggcttggttttgaaaagtccaaaaataacttttgagtttaggtggtttcatatatcatgggcatttcaaaaaccaaaagagttcaaataaggaacatatccaaaagagctcaaggatcatgaagttttcaaaataacaaagagctcattacttgaaacttcttatatttcaccaccatgctcaaataatcaacaagtgatatgcactttgaaatccatgtttagctgaaaaagcacatagcaatggtggcatcttttagcaatagaaacttgtggaaccaagatcggaaaaataatccataaatcctggagatagttcatgtaaaaatgcaaaaatttcattttggggtcctttcccagctctcaaccgaattgaagaaacaaatctcacaagctttcagccaactgaaaatttcagactttttcagatttttggagactgaaaatgaggttgaaaagacatacaaatgaccacttaaaattctgagtaaatttggaagtaaacttcaactattgaggatcaaaattcatattgtgatcttcttcaaatttgcaacccatttggagatacaaaaatcacaaatcagcccaaaaacatggttgttctgaaaatttcagcaagctgagcaaaacgagaaaaagtcaaaatctttgcaaatcaaatagaaatgagttgaaaccttgcagatttgatctttatacttgtgaggaacttttccaaaaagaatttcttaaaaatcatttttctatcaaaagataagacaaaaagagcattgtaggcctttagggtgagtaaat

SEQ ID NO: 64858 - DNA, 8932 bp, Oryza sativa
  unsure (1)..(8932): unsure at all n locations
nnnnnnnnnnnnnnnnnnnnnnnnnnnnnnnnnnnnnnnnnnnnnnnnnnnnnnnnnnnnnncacgctcggcttgcaattgacgcgtgtgccgcacacacggtgtcgtgactcgtgaccggcgtcgaggtgcacactaaaaagaaaaaaaaacaaaaccaaacttgccggccacccaaaccagcaccaacacgtaaagcctttctccgagcaaaacatccaaacggcaaaatataccccacaaaaactaaaaagtgaaaaagagcagagaaaattaggcaagctccacgtgtcgggcttcctccgcgccgccggtcacatccaacccaacccaaactgccagccacacctcggttgggaactggaatagtatgcacggaaaacagagcgatccattagcacataactaattaagtattagctaatattttttaaaaaattaattaatttgattttttaaataacttttatataaaaactttttttaaaaaaatatatttaatagtttaaaaagcgtgcgcgtggaaaacgatggagagttgtcggaaaactgggtgccgaacacaccccaacccggcaacggcaacccgacccaacctgcgcgcgcctccccgtagccgcagaacgaacctgatgccgcggagtcgaagcgacgcgagagcgcgcacacgtgttcttcagccaagccgacgtcccgcctcgctgcagatcggccgagatgccacgcgaaaactcgcgaagaaaaacgcaagggcgaaaaagaagaacagagcagatcagcccgcgcaccgaccggtccacgtggaacggacggcgaggatgaagcgacgattatagtttgttattatagtgttaaagtatgaacaaacaaacccacgggatggagcagatgtgaaaagaaaaggaaggaggcggaaaaaaataaacaaaacaaaaattaaacagaaaaaaaaaaggaaggaaaggtggtgtagattgagccattagaagccttcggctttacggcttcggcgagaggaaggggaggggaagaggagaggaggaagggactggaaggttcgatggcgtcggaggtggaggacgatgcggcggcggtgctcaccaacggcggtgccggcgccgcggaagtccggcggagggtgggttctcttctctttccctgaccatatctcccgtcccattttttgttgtttccgttttgcccctaatttcctccgtttttttgctaatcttttttgttccttcttcctcgggatggttcgttgtttgatgcgcagagggaccaagcgaaggagattctgtccaagcaggccgtcaagatcgccaccaaggccgaggagcacgagcgcttcatcttcaaggtccgttcctccgatcctttttgctcatctcgcgtcgcttcttgcttaaaaatctttttttttttttgggggggggggggggtgtccatgttctctttattcaaattgtatgcgtaacctgttcattttggcgggcattgatgcaaatgctttaaacgagcgtcagagggggtgtatatttactgtttgggggcatttgggcacaatgtaatgctgtagcttccaatttgtgcatctatttttttaaggagcaatttcggcatttattgacccgtacttgaagtattgcctctgtcctaaaatataacaacttttggctatgaatctggacgcacagttatctagattcatagctaaaaatgcttatattttgggacggagggagtatttactaccaggagaccaagattgcgaacaataattggatggctctggatggatgttcttacatggtgctggctttttaatgtgcaggtcacacacttgctgggtgttcttggatttgggacattttgctacctcctgggtgccagtaagctactgcagcattgatctgttctgttggcgtgttactgcatctcaatgttttggtttgtcactaagaatgctctggttttgtttgcaggaccacaggatgtgccgtatgtgtactgcctgttctatgtcatctttgttccgctccggtggatctactaccgctataagaaatggcattactatctcctggtgagtccaattatttttcagtttttcagagtttactatcctgcaaatgtgggaagtaccggtaaacttgtttccgccaaaatttgtttattttatcttgactgctggctggacaacatgtctaacagtttagctatggttattacaacagggaaggtaattcccgctaggcatttgtagtattgaagataggatattaggaattgccctttacctgatgaatgctatgcttgtgatttttgtgcaattcaacatcatgtttcctggtttactctgcaatgcgagtgttccatttggttagtgaaaattgactctgtttttatgctcttatgatagaagcattacagtttcaagccattgattgtttggtaagtcattaataataatcccctgttttataagcatcgtcatttctctgcaggacttctgttactatgccaacacttttctccttgttatgattctcttctatccaaaggatgaaaagcttttcatggtttgcttctcatttgcagaggtatgggaagttagaagtattcatgttgatttctggtctgcacccatctcgtagcatgtgtgattttttggtttgccatgaattcttgcaggggccgcttgcttgggcattaattgtgtggcgctgcagcttggtttttagctcatttgataaacttgttagtgtcctgattcaccttttgcctggtaagcggtctcacaattcaaagtcccagtttactctctaggaaatgttagttacgtaagtgtggtatcattttagggtagtgaaccacatgatttacttgtttatggaatctcttttactatcatttgcaagtaagatacagaggatttacagcaaaaccttgtagcatattattccaatatggtagctcatgattttttaaactagcacattcatttttagttactaaacttctggtatttttcttattgctgacaatttcatgctctgttctaaataaagggtgttgtggccttgtaaaatgttgtttacaagggaaaggcagtctatccatcgtattaaatttagaggcaattaagcgtgcaaataacctagaaatttagaccgtttggcagttgagcattttctagttgttgtacggtagaaatcctcattttggattacaaaatatagcatggaacatttaattgaagcattctagcaagctgaatttagtcaaacctttcttttttgcttctgccatggacattactggcagctccattctgtatagagtaataatgactagatccttattttgtatcaaatagacatggatacatctcttatttggaattgtaaaacgatatatagttgtggaaaactggaaggccattttgcagtcaaacactataaggtcagatggttgtttgttaattattaaatgttatttacaaggttgctttcatgacaattacaagtggaatccgaaaatttttttagcaacacaaacagtaaaataatcaacatttgttctgaggaatttgacaagcgcgtgaggaacctcctgaaattgttggtaccatggtcactggttgggtaaggtctgcagagtgaagacttgggtgcgggtgtgggtgtgtgccttggggggggggggggtctcagttctcagttaactctgaccgggcttgtccctgttgaactatcaagctctgtggcttgttggactaacttaagatttgttgtttgattggcaatgtggtacatggggcccctttatatgtatggatgactgacttgacccttaagaaagtaatcctaatatcatggaaaccagcagcctgattgttatctctaattttttgataaatcttatcacttccttacctaatcttccaaatgggtgccacaaggattgcaagaagtgttggtctacgaccataacagttgacaacctcaagttccagatatgaaacagacctgtctgtactaaatgtattagggttatatgtacttatattctccatccggcgcattttaaaatattttgagtttacatgactgacatactggcaaataatttttacaggcatagttatattcactatccggtggtggaatccacaaacttttgctgcgatgcatccagaaggaagagcagccagagtcacatggccttatgtggaggacaaatcatacctgtggacatggctgtttgctgttcctctagctgcttacaccctgtggcaacttatgtattttctcatagttaatgtgctgcgtcggcaaaggctgttaaaggatcctgaagtcatgacatcatacaggtacatctttgttgttcttggcagtgtacctatgtagtgtggattacattgcttgatatacagtacggtattaatgttgacttaaaagatataaactcatagagctaaaatagctggaattatgaattagagtcgtcgaaaagacgaattgcaatggcaggttgcatggatagttttgcacctggaaccctgtgattggcacactcaatacactaagacccgtaggtaatagttggcccatttccgttcaactaagtgaactaagtttcagttttgaacccctgaaaatgatatttagacccactcccattcaaataatatgggtaaattcacgggcccgtggttgtatccttaaacatttttttagacaatccttgaacaacattgtagtgacatgtgtgcactaccgttttgatctagtttacatttgttctcttagcacaccttttcctaaaagtttctgcccttgatcatttttagctgtgtcttttactgcacaatagtttccaattgttctagcttaacaggttagtttagtaactgttcacagttttaaacagtgtttggtcatgaaagaacatgaagtagcccaataatgtgtgtttcttcatgaatttcttgtagggagctctcaaagaaagcacagaaagcaaacaacatctggtggagactcagcgggcttcttggcgacaggaaccggccactcatgtacatactactccaagcgctgttcacggtggcgacaatggcgcttaccgttcccatattcctgtccttccagatgcatgtggtcttccagatactcaaggtgtgcgcgtcgacatggaacggtggaagcttcatcctggaggtgatgcctaggcaagtcgtccagaaggagaagaagaagctagagatgaagcccatggaagaggctaattcgagccagaatgctgaagaatcacaaggggacctgtcagcaaacggccagcactcatccgagcatagctaagtcactgaaaaaccaaaccatcgcaaacggtagcatttttcagtttttcaccagttaatacactgtggatagcttctctgtgtgttgtgtgctcgaaacaaattatccatgttctgttgggttgagaattttgatgcgtgtgtgaggtttgatctattcagactccaggcagggagcatttctcaggtagaaaattatttttcttttcccagtcaacccatgatattcactgaaacttctgatattgaccatgacaaatttccgtgcgtgacccgtcatctgctagtacttgctggacaagttattacatgactagtacgtaatttcgctgaagtacactgcgtttacgtgtttggcttgggtcttgggtcttgggtccttggggctctatatatacctcgtttctccaggccggtaaaaagttcttttctttagcttctggccttctgctgctccgatctactactacttattacgtactcgcatctcaccatgaagccgctatcgcttctgtcagcgctcgccctggcgttccacgcggtcaacacgggcgtcgccgtgtaccgcagccgcgccgacgccgcggccgtggcgctcgtgctcgcgttctcgctcgcgctcgcgctgctcttcctctgcctgcgcctctacgagggcgcgccccccgccgaggccgcgaggcgccggtggctgcgccgcgccgtctggctgctctccgcggcgctcacggcggcgttcacgcgccgcgtcgcgggcgcaatgccgccagcgggggccgtcctcgtgtgggcgatgagcgcggcgacccgctggcggagggttctacgccctcgtcgtcgtcgacgacggccgcgatctcggcgcaaaatagctaattaataataataataataataataataaatgcatatgatgcgtatatatatgtgacgtgagttacttgctagtcaggcgatccatagaaacaaaataatactactattaaaagggatcaaagtacacaaaatgtgtacgtatgagcacttcacgctcgtgtcgatgttcagctagcccagtggatgcagtacgaaccaataccagcatgctctgctggctatggtgttatacagtgcttgttattgtgattattcgttgagctctatatgtagtgtggttgttgttgattagggatctcaatttgatatcaacaaaggattatatatttatccattgagtgatcgattgatttttctatcaatcattcttctttttttgtttcaatatatagcagtccatacaattttaatttttaaagggatgacatttgttatctcttcctaaaaatagggaaatatttttgtcatctcgcctcaagattgtcctttttgatgaggaactagaattttaaaaaaagtaagatttgcttaatactagccctggggctctgcagaaccaatttttccttgaggactgcaaaaccacagttaattaacaatgaaacccctgtgaaacctttggaaccctgccaattccattatattcgaaaaccaactattataaaaattacaagttgaatgaccgcgaattacaaaattacttaactaatagttgtttctgctcaacagcttaattcttgtcattctcaagctatgtgtagctatggatctaaactctagaatctatagatgacttcattactaaacctgtagtttgtgatattatgccttaagttttagttttaagataattttggtgctaaaatctgtagttttataatatatatagttgcatacgtattttgtgaaatttactcgaaagttctaaaatactacgtagtattttagaatttttgagtatactcactggagatgatttaaactctcacggagatgttttcttgcatgtcatttaaatagttatgaaataattaaaaagatttgataagatagattaatatattatatattgttccacaaacatataagttcaaattcaacatctacaaattgtaacaaaaagaataaattaagctcaagctagtatgcatattatcacacccattttttttatcaattcttagaagttaattttttaagaagaaaacaagttttacatatttgtgacgtgataaaacacatattaatttatcttattgtttttaaaatttttaattatttagataataggcaagaaataggtgtttaaaatccattgtcaactccactaaagaaagaaaaaaatccattgtctgctactatgtgtagtgacgccactttttaggtggagatgatgttaagcaatctgacgtgatcgcagtgcgtaagactgaattctacaggaagttcaccggcacaaactaaagttggtggaagcaacaagcaagtcaaattaacaaatgatccgataataaaccgtgggtacacttatatactaggtgaaacctgcgtgttgctatgagaatttactataataacaataaataaaaataatatgtaaaatagcttaaaaaacttaaggttatctaagttgatgtgatttaaatttaaatggtatataaaatgatgattcgaatggctttctgagagttcactgtgactccgctttgtttgtgtacacggctctgtcgagcatcgttgtccatcaactaattatatatgttggcatactattgaagagttcagttaaattgcgtttccgcttgtcatctaagggtgagtttgaggagagggggattgagaagattggtaagatacgtaaaacgaggtgagtcattagcgcatgattaattgagtattaactattttaaattttaaaaatggattaatatgattttttaaagcaactttcatatagaaaatttttgaaaaaaatacactgtttagtagtttgggaagcgtgcgcgcggaatacgatgtccttttctcacccaatcccccagaactcatcacaacgaaagcagcctaatttttgtttcatcttggaccggacaccatcactataagtacctgcacaatatacatacataagagttattactttagaagacgagtttctaaatcaaaaataatatacatacgacgctgtcgtccaactctagtgtatgaccaatgcaatgatgaaatgcctcacacatgatagatgattcaggtcgtgatgaatctttggttgcgcctgttagttgtgccacgttgtaacacggtcggacatcaatcagacaacagctttggacatcaatcttcaaatgcggcgtctctggcctccgctactagtcgagtcattccttccgatccttccccatccaattcccaatcctaacccttcaaaaactataggtgccgtagctcgtggctctacgacaatagacaccgtaagtcttattcaaaaacttttatgagatatataaaactatatgtatacctaaaaatacattttaacaataaatcaaatgataggaaaagaattaataattacttatttttttaataagacgaacaatcaaacatgtttaaaaaaatcaaacgtgtttaaaaaagtcaatggcgttacatatttagggcagagagagtatctgtgtcaatgtgtgt

SEQ ID NO: 64859 - DNA, 15812 bp, Oryza sativa
  unsure (1)..(15812): unsure at all n locations
tcttatattatcatggactatcttatcaaattttataaaatttttatataactgtttacattacatgcatacacctaggtgccatggcacctagtggtagaaaatactttctgtacgggagctgcaccctgcaccattatcaatgacaacctaagcacaagcgaaattgtccagccatccgaggaagcatttatgcgagaaaaatgctactccttccgtcccaatatataagtatttttagaatagtgccaagtcaaacttttaaattttaactattaatagcaaaaaaatttaaaaagattaatcatgtaaatttgatgtttactatatttatcattaaacgaactattgtagtatacaacttgtcagggttatggataccacatacctaacagtagttgactaaatttcggcaggacccacgtcttatacggaaacaaccttcagatatagaaggagtttcgcataaggaaggatgaatagagttctacatggaaacgacaagggctactcagattgtatccatattggtttccctagttctacttggacaatgggatacctatgggtataaatacaaggcccctaggaggagaggggacacggaacaatagatcaagacacaagatcaacatacaagccaacatgcgccaagacaagccgccggatatcgacatcagagatatgcctggactgaccctatctggtaccttcagtggcctgctgtagggatctagcgctgtctctgatctcgtcgggcacgaattcgaggagaaagactaccttgttgtcgactacgagtcagcacttcagaccgccaagtcaacaacagatagataggctacccgaaatattgtaccggtgtgattacggtgaataagagcaacgactggcttcagccaacaagagtagggttattacctaacaattcaggggcccaaacctatataaaaatcctcgttcccatctcttttattacaatctcgcatatatcctagtaccaacgatctctatactatgcaaataccagaatcgcgacatcaaacgtcgacacaactctttttatttaagatattttacttttattagatattgttggtcaaagtagcatctcggaaaccgtgtccagatccaaaaatgcttatattttaggatggagggagtacacaacttgttttttcatgccatcaaacacgtttaaaacacctaatgctttgtgatgatatcaaatcgccaaccaccttaatctaaaaaactctaaatccagatagcttttgaagattaaaccggctagtggagccaatttagatgaaagataaacatacgtctcgtggatagaacggaaggttttcaggacaaacctacacagagaggattcgcactctcgtggtgaagacgggtagttttcgatgcaaaccagcgaagatggatgaaaactaggctagaactagataaaaagtagatgagatgctgaaaaagtaatttaattggctactgtgttggagtagattgtgtcttaattgaaccaaccatagccattataaaggggttggttttacgttctagaggatcttttttacgtcttactcgggatagaaactaattagaataaaaaaattgtctttccaagaaaaaaaaccaaagaatcaatgtaattcaacttggagtcgaggttagctcgtcttaccgaccatatgccatcggtcagaccagccccaagtcaatggtcaagagccaaatagacgactgcacaggacctacgatttttcggggcccatatgaagatgacgacccaaagtccatttcccacaactataacatgcaaggcaaatcgtcaagcccaggtggccacgcgtacaatactgcaacatcgtcgcattgatcctaattccgtgattgcgtgcgccgtggctgctacgagaatgagacgagattgtcgatcctaattccgcaccgtgttgaccggcgaggcaacaatacagcctgtgactccgagcggcaacggcgatggccctggactctaatcttcgagcagctctacagtatgcagctgcttgctgagctcctggctcctgccctccccctccccctccccctccccctcctcactcttttagtagaacatgactacatgaggtcagcattacctttttcactcttttattattattatcatatgatatatttcaaaatatggtacattatagcacatattgcatctatataatttaattgaacaaaaacatgttttatttatattagacatgcttttataaaaaaaaattataggccctcaatgtgtatttcaccctagggccccaaattcatggagacgtccctgtcgttggtcggacaggccttacgtgttgaaaaccgagtccttccaaatatcatcatgcttttctatttcatgtctaagtgtcaaatttaaatattaataacaagtacaattgaaaatttcaccactctttaacttgatgctcttttttttttttgccctggctgataataggattataataccaagcaacatattttaaatttagaatatgattttagggatttctatgttactaattttgcaaccaagctctttttaaaaatctaattgccaataagacaagtcggtagccctaaagcactagtagatttgaactagatttgcattataatccaaagcggaaataaggcggcaacttttggtgaaatgcattcaactcattataatcattttttccgccatcgctgattcgcgcgcgcctcctcccagcctttttttttctttttttctaccgtttttttttgttttctttcccacttttttctgatttatttttttaatctttagcatgttttgagtttgaaagtttttaaattttaagttgaaaattttcaaatctgaacttaaaagtttttaaatctcgacttgaaagttttcaaaattttcaaatctagacttgaaagtttttgaatctcgagttgaaagttttcaaatctcaaattgaaagttttcaaattttttcaaatttggacttaaaagttttcgaatctgagttgaaagttttcaaaatttgactttaaaatttaaaacttaaatcgaaagtttttaaatctaacttaaaaaaattttcaatctgttagaaaaaaatctccaaaaaaaagtctccataatctttcctaattactatcattagtgttaagtgtattggctaacagagataattaagacttaagaggggagtgcggagtgcacgcgcttgctaggagcctaggagccccctttttttcccgttcctaattacacaatcatccattgcagcctgaaactccttgaaatttacaacaaattttcatctcgagaaccagtcgatactagtaacacactaagcactgtataaatacggtgattaatacgtacatgtcctagtgatcatcaaaccctgcggcgacgatcagtcggactcctgcaggccggcgaggacgacggagccgacgaagaggccggcggcggcggcgaggaggacggcggcgaggacggcctggagcgcgacgagggcggcggagtcgtcggggacgaggacgacggcggcgatggcggcgacgaggagcgggagcgagacggaggcgagggcgtcgggggaggcggcggcggcggcctcgacgaggctgaggaggccgaggtcctcggccttggagaggaggccgagctcctcgagcgaggagagcgtgacgccgagctcctccgccctggacagcagcccggccttctccaccgtgctcagcaccttccgcctctccagcttcttgaacacgtccacctccacctcctcgctcccctccgcgaatatccccgccccgaaccactgcttcgaccacttctcgtcgtacctgttcacctgcacccccaatatccaaccaattaatccgccatggatggatcatggatgaacacatctccaatttcagtcgagacggggcatggctagcttggttaccttcttctggggagccatggccgtgaccttgaagcgccgcctcctcgcgaacggcggtggcggccgggacaggcaagacgaagagcagcaggtggagattgctgcttggacggcagccatttcttcctcctccccttctctcttctcttcttcctctggcgaagcaagaattcgacgcttctttttgtttcttttttttttaggaaggaagagaggaatcggagtgtggccaatggagagcagcttatctctgggctgggcccatcgtgtgggtgatcaaagcttgagccacagaaaatgccacggtggattggatttcctagtgtaagctgtggagacatctcagccattattcgggcacctttttggaagaagtttaataatttaacacttttttcaattactttaattattttttataaggatgataaatgagaacatctgagtgaatgaaagtggaccaaaatatcaaataatcgaaacccatttacggaggattaaattatattatcaaatctctccttttttttggccgttggttgggtaattgaacggctgagatcagagagtgaaacgaacttgctcgaactctctttctcacgtgtgttcatgggcccaaatcaacagcccaggtgtgtttctggtccggagagtggaggcggcctcgaaagcaagtagatagcccaaagcccaatctaagagggcccataggcccagatcgacgaccacaagacaacccgccgtgcggcccgcctggcagtttgcttttgctccacccaccaccaccgctgcttccaagttccaaccgctccctctctcgtcgctgagctctcctccggtgggcggcgcggcgatggcgggggacccggcggcggcggcagcggcggttggggcgatgaggccgtggaactacgtggtgacggcgcacaagctgacggtcgtcgcccgctcctgcgtcggcaacttcaccgcgcccgatcacctcgacctctcgtaagcgctcgcctcgcttgttcgctcgatcgatcacgcattcaccgcacatgcctgctcctcctcctccgcgggatcgcggcgggcgctagggctttgcggctgcgtgttggtttttttttttttacccgcttaaaccctatttcccccgtcgatgtttgctgtgatgatcgattcgatgctttcgtgctaggttgatcgtactacaccgaggtggaggtgctccccttttttttttgttttttggaatggggcgtgcttgcgatttgcgtcccaatttggacacagtgggttttgtgggaaatttaagagctcccccgtgtatttgttctatttttccttctccatgtattgttgtttggaattctcagttcgtgtagcacactagtcattcacactagtcattcatcagaaatgggcttgtggattcagttgtagtggatgttagcctactcatttattttaaaaaaaattcgtggtactgtgatgatggtgaagcagtaaaacatctgtgagttaataaaacttagattgattgtgttttttctaatatgttttttttgtgtgtatttgacttctatttttctccaaaattttatgtacatccttcatttgtttgggctaaagcttgaccgtacaacaactttcaggaaatttacccgtattgagattggagtatctgcttactcatcagggtcttcaggtcagacagatttgcctcgaccagaatatgttccttctgtttgaacctatctattattatggacagcaaataactgtgccttgttgttagcatcaattgttgaaaaggtgttttttaaggttattcataatggctactgttgttcagataaatgctgatatacttttagttgacaagttagaatttgtcctggcagatcaactggttacatgatattcttacaactataactctgtaagaccttttctttccttaccagcctatgcttgatgcacctgtgtatggtagaattgcaacaattgagctcttccgtccatgtgtaagtttgtactctgtttctacagctaaaaaattgaaagattctccctgccttcagacagtattgttgtaggactgatcttaagatcttatgttttccggtcccatcgttatggcatatttgcaaacgaaaaataatttgtgaataaaacttttatatacgtgtttttagcaatttaaaagcaaaagctgaaaaataaatttcaatgaaaaaaccccaaaatcaactccaaatttgaagttaaaaattcaaattttagttgaaaagcataagcataagcgaaaagataacgctcttcattccttgaatgaacctcaagaattaagattctcttttcatttgtacggaaagatacagatattgtattcttcactgggatgggagtaagtcaaagcttcttacaaggtttgatctctccatcatcacattatttttatatagattgcaattattaaactccatttttatcttaagttccttcctcagtagatattgttaggctgtgtttggaactccaagttaccaacccctctccctcgttttccgcgcgcacgcttttcaaactgctaaacggtgcgttttttaaaaaagtttctatacgaaagttgtttaaaaaattcaaattaatctatttttttaaaaaatattagctgatacttaattaatcacgtgttaatggaccgttccgttttccgtgcggggagattgggttctcaaccctactatccgaacacaacctaaaatatgtatccgtggcaacggtatttttcctgcaatcaaacattcagatggttttaaagtatgcatgtgatagtgacctgactgccagactgacattaaagtccaatctagcccctttagcctctcaaagaattcattggaaccaatcatagacatgcattcattcacttaatctatcaatatatccttgaacgagctataaatttaacatttttcaggaatacgtaaaaagattgcgcacaccttagcaagttattaggagtgagtagccatgaaaaggttttgcttaatttaagtatctattgatctagtgggcagggaaaatgtttcactatgttagttgtagatgaatgtatgatttcaaggttctgcatctttatattaggtattggcatctatcaagttctcaccagacagcagagcaaagtcatcttgcaaatttgtgaacgcttttgtctatttgaatcaggaaaatcggtatgtaatatgcaggtcagggagagatgcttctgaccacattggacgccctacaaacaagggacaggtactgtgttcatgattagaagcatttatttttccacttcgtgttctgtacagttatcagctatgtgtttcttgttaacagacagatgaactcagcagggactataacataacctggatgactgcggttgagatgctcgacgactacgtttatattggcgcggacaattgctataacctgtttaccgtgctcaagcgccgtgttgggaggcttttagtcattgggcagtaccatctgggggacctggtgaacagattccatcaaggcccccttgtgatgcaagatccaggctcagaagtagaccagattcctgccttcatcttcggtgaaagcagaatagactcaacgcaatagattggattgatatcggtgcggagtacatataggcacgaaatctcccttatccactcagccggttcatagaaactgaaccgagagagataaggggaatcggcaaaatagggaaacagagatatacacgagatacaattctaacattcggcacggccagtggcgccatcggtgtcattgcctctcttccacattactccctccgtcccaaaaaagacaaaccttgggtttgaatctggacatgcatcatgttcctcgagaagctgcagcttgtcctcgctgattacatcaagagcgttggcaaccttacccacgcgcagtggcgggcattctgtactgacggcaggagcgtaggtgcggcccagggatttgtggacagtgatctgatcgagtctttccttagcctggagccaagcaagatgggaggaggttgcgcggatggtgtggcttcatgcggacgagctgtgtaagagcatctccaacagcctctccataccactctccaagctaaattttagctgatttgatacaaaaacacactcaaacagaatggctatcccaattgccaaaagttagcaatggccaaacatgggctcgagctagccaaacttggccagcctttggccaccctcagccactgtccatccgtgggcccaccaactttttcctctctctccccaccagccgcaccatccctgcccgtgccctccctccttttgccgcaccgcccttcctcccgatccgctcgtgcctgccgccaccacggggaaggaagctcgccatcgccgtcgcttcgttgccgccggcgagatgggagaccagcagcgggatgatcacctccggctccgggtcggcgccacgggtcaggttgcagaggttgagcgggagcatcgccgaggcggggtggttccgcccgccgccggcaagcttggggagctcgcgggcgaccttgcctgtcctgttgcggcggcagcgcctgtgctagctgagcaccagtaggaggtgaagcagctgcttggggagcaacagcagatcggaaccccatgccgggctgacgcgaaggcgaggaggagaagggagggctcatcgggtcgccggccggtggtggtggtggtgatgcgcggatgaggaggagaggccggccgatgcagcgagcggagcggagggggcggtgcctcgccacgcgcctcctctagatcccgctacgtcatggctgctgaggtcaccctcctctcctcctccggcgactatcgaggaggacgaggccgacgaggagtggatctgtcgttgccatcgccctcttgtccacaggagaggataaagaggggtgtggggaaaatggagaagtacgaggaagaagaagagctgtagaggctgacacgtgtgtcctactgttatagagtcagaatagagagggtgaatggagaagctgttggagtaaacaacgtgtttgacttgctaaattagatggagagttggccaaatagatatttggagagttggatttagaaagactgttggagatgctataaggtagtgaaggcgctgaggaaactgcactgtcatgatcgccgaatagatggcactcatggcagctagattctgatctccatgtgctgctgctgatgtacatacaagactggatggaaaatctgtgcatagctccatcgtcaatcagcactaccaggtgagatgttgaaggtgctatttggtgttttaggcttaactaaacggccacacaagaacacagattttgtaacctcctggttctactggttcaatttttccatgtttagttggatactactccctccgtcctataatataagggattttgggtggatgtgacatattctatccagatttattgtattaagatgtgtcatttctaccaaaaattccttatattatgggacggagggagtactcggtaggaggaaatagagtaattgtcagtagttgcaaatcatacgtcctttgtctgaaaccttttagacaaaggttcagttaggctgcagcatagtgcatcaagatactccgagcatatatgccattgttctggagtgagctagtttggcatcaaagagaaaatgagtgtaattacgcatgcaattcatgtaacgcaactgatcggttattctcagctgtgtgatcatgggaaaaagaaagtgtatcattgtatttcgtcgctgtgtatgctttaccaggacatcggacaaaagtaatgttctcttgcaaacgagactttcgatgaattaaggcattgtctagccgacatgggctccactgctccagatgcccactaaagcctcccgacggaacagaggacaaatgaaagaaacagacgaatggcatctaagaattactaatagatcagtaagatcacaggtgattcttacgcttctttattagcagattaagaaaaaaaacaattatacatcgatactgctttttttcccctaaactttaatgccggaggcacaattattaacagcctcttctaagaggtaccgtataattgtccatagtgacgggcatgagtcactccaagaaagtagtattaataaaataaactaaatacgtagtatttattaaaaattttattttagttgatttttctcaattagaataagacattgctcttttcgcttattcaccagattatttgctctacccttcaaaaaaatatatttttcaaagaaatttcttacagtttattgtttaaatcacttgttttaagatactatttgttaagattatttcttaaattatttaattagctctataataaaatagatgatatgtgacaaataatttacttaatgactaaacgagtaaatttcagaaaaaaaaaccctgtattttatagtcaaaactttatttaaaaaactaggcattaaattggtggcacattaccataatactcttaaagttttataaaaccaaccattctactgttgagtgcaattttttgtaaattttaaaacatagagtatgattattattatttaattgagttcttcacttaaggttctgatcgagcaagactaccttctgaaatttactatcgtttaaatgaaaccagcgtgagttagcgagtagaaatacccacatagtgacccaccccaaattcctaattgctgtcatttctctctcatataattctccttgagcttgtctctggcatccaaggtctagggccccttcttttaagaagagaaaagaggcaagcctgagctggctcttcttaatgagttgctcgcagtcacatgctccatgggtggcgccgtgcaggcaggcagcagggagaagaaggtgattgtgtcctcaggcggcccaagaaggatccaccaccgaatacaccgccatcattctcggccgaacatgccatcatttctggatccaaccgctacgagttggccgccagatttacgctccctgccacgtactccgttgtcccgaaaaatatgttcacgttgattgacttagatgtatcacatcttattttagattgagttattttgaaacgaatagagtaaaactacctaatacgatgtacacggtacatgcatacacggctcattatctgtgaagccacacgggaatcagtcgctccagtgcctttgtccaagatggagctattagatcaaagaaagaaaaaagaaggatggagctagagtagatttttcctttttcttttacgtaagacagaacaaatgcacctatgaagcttacacgcacacaaacactcttaaccgcatacacctcattgtcaacttctcaacagggacgttatctttcaccaaaaaaaaacagttagatgcttaaccacgaacatcttactagtaatgaatacatcgtctatcactaaaaaaataattaactcatatataagtacatcgtctgctattaaaaatataactagtaataaatatgagtatttatgtcaatcgtaggacttaaacatgagtgaacaagttccattaaaaaaaacttaactagctgagctattcttaattcaaattaaactaattaataatgtgttataaaaaatatttaaattggaattgaaaatttagagaaaattttattgtttgaaagtaatttttgtgataaatgcactggtgccatttgcaacaattctttacaaagtttctctctctctctctctctctttttcatagcaactacttccttcgtttcatattcactaagactttnnctccacattccgatatcagaatgttnnaatgaatccaagggcacancatatatggtctaggtttgcattcaacatatgtctacgattctatcatatatatatatattttaatcgaatctagcnactagggatgaaaacggagcggatacggacggataatgctcataccgtattcattttcatattttttaccggatacggaaacaaatacggatagctcgaatacggaaacaaatacggattatctcgaatacgaataagaatcgaatatgaccggacacgaatacggaaacaaatttttctcggaacacgaaaaccaacttaacttctaatagaaacaaatatcaacatatataattagctcactttatattaaatgtagtataatttataaatatttttaaaaatttaaataatatgagtgtggactagtgttaacagataaaccactattaaaatctaaaaatgtatattgaaggtcatatagttataaaaaatggggtatgtctcatagcttctgcggatatccgaattattatccgtatccgacggaaactccgataccatattcgtattcgtatccggaagaaaatatccgtattcgtatccgtatccgaattatccgatccgaaagttatctgtattcgttttttgccggagcagatggaaactatccgctccgttttcatccctaatctagacatatatgtgtgtctagattcattaacatttatatgaatgtgagcaatgctagaaagttttataacctgaaacggagctagtagttgaaaacagatataataattgtctagaacatcgaacataagtatgttccattaataatgctttaaaatctcaccgtcatgaaatttgaccatttattcctactactatttgtttaggtgggcacattttgcaattatttagcattaattagacatctttttattgacataataccaactcagaatgagacagtcagatctgagtgatgtcacatcgaaggatagtgttaatctgttaattagttatgagatttttaaaatcttagagaaaagctcatgacgaacaatcttaatatccgatgggttttggaacattaacggcagtttttgaagaacgaatttttagcgaagagttttgtagggtttgaaatggagaacgttctatttttaatagatgattgtgatactgtgaaattcttttgaattattcaatacataaagattttaaatgaaatttaacatggacctaacctctttttttttccgtgaacacgcaaaagcattgtacgtcaatatattaaaagaaaaaattttgttacacgacacaatcagctagattagcttatgccaagaaaagagaaaaaaaacacaacaaaaaaaaagaagagactactacgatgactaaacacaactccaatcagctggggttaggggggggggcacagagccacactaaccttgtagaaattttcttttggtttatttttctccttaaattatcgtcctatttggtggtctattcaaatcatttatgtgttttgtttcgtttcgtttcataaccctatgctttgcaaatgtcatatgtataagaatcaccttttttccgtttatgtgttttaccatacctactactcacgttaaaagaagccatttaatagcttcggccagcactgtgtcaataccctaaagaactagtcaataccctaaagaactagcgagtcaacgggcttatttggattgttaccctatcaattttttggtagtgccaagttttggcactaccaaatatttggtaagttaagattatttttatcatatttagtttgctaccaacatagagtcaaaatgtgaaattgtagtaaagaatgttctagataatgccaaatctagattaggtattaccaatgaatgggcttcaatccaaatcaaacgcaagtactattcaattaccaaaatattggtagggcatgtttttggtagcaatccaaattggcccaacacttatctttttttacttcgtatcatgtttaggtgtatctgtcgtcagtgtgtttgggaaacggttagtgccacccacaagtaggggtgggcattcggtctaaccgaaaatttctgtctcggtctttggtctttcggtcttttcggtctttgaaaagcgaagaccgaattttagtaaaaaaatgtcaggaccgacaaattcggtctcgatcttttcggtctcggtcctgaccgaaattcaacaatattttcatatatgcaaagaaacaatggaaattttcaacataaaaatcacaaaaaaaattcataagcacttatgagtaaagactcttaataggttgcatgcctagaagaagtaggatgtgaaaattagagtttaatctattaaacatagtggattgtatgttgcatttagacatttttttggtaattcggtcttttcggtctattcggttacccgaggagactaaccgaattgaccgaacaaaattcggtctttcactacctaggaccgaattgatgaccgaatttctcggtctcggtctcggtcttttcggttcggtctttcggttcggtctttttctgcccacccctacccacaagctaacccaaacttgtgctacaaccttttctagaagttactagtacactttgttgttaagtcgttgcaaattaaccaattagtattgactagctagttaagaggatggatggttctactaggtgcacgctactctgtcgtatgcaacactctttgattttttttacatacgtataagtacgctaattattaaaaatatcatcacatccataaacaaagaaagcttaccaacccaattataaaaagtaggttgaacagaaaaatagatttggcatgttgagaaagaatccaatgaactttgttggaacatgccaatatgtgcaagccacagaagataagtacaacgtgtcgtacaattgtgagatcctatttatgttttttaattaagaatgtactttatattctaagtgcattattgtttttaaactacatattttctatccacacaaatcaataatacataagagcatataacaaatgaataaatgaggtggctctaacatccattttgctgacgcggagatatgaaagggaggagaggggctgcaatacctctttttaaagaagagatttggccattgttctctaacaaaattgtgaagcttatattagttttctttgctcgtataaaagaccattattataggtaagtgttattttgactgttattttaaatatgatgcgagatttccaataacgagaatacatggaccaataatatccctcctctcaaagttcttatgaatcaacaacaccatcatttgctttttagcttatcagcatatttaaaatttgaatattaaatttagagctgattttaaagttttttttgttgtagttaatcttccaacattagttctcaaatcaacaagataccatatatttttttaattttttatggtttatcaatttatgccaagtgcccctaaaacccagtattcgaaggtgcctatagttgtaagccgtacatgtgtttataaacatgagtgtctgcgcgtatgtgagtgattttgtttgtgctgtgtttttttctaaaaaaaaaatagcaaaacacctatgctttggtataggtaaaataaattatattataatgtcatagaaaaaatatattttttaccaaatatgttagtatacttgtttgcttatttaaatataggaaaaagtacaaattacctcccccgaattatcgcggtcgaccgaattaccccctaaaccataaaaccggacattcttcacccccaactatgcaaaccggacgaattacccccctcgacccaattcgcggtggttttggtctacgtggcgtacgcgtggcagtccagtcagcattttattttttt

SEQ ID NO: 64860 - DNA, 5349 bp, Oryza sativa
ccggttcccctcctcgtctcacgccgcgcgccgccgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaaggtaaggcaacgaggcgccccacctcgcgcttctcttgaagaatctgtggctcttttctttttttgggttcatgtccgcttcttgtttgttgtattgcctcgctcgctgtagctgatatcttgatacctctcgtttttttagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatccatcaccaccaccacctccacctccacctccaccgccaccaccggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggtattatatacagtatcttgtctctgtttagtgtttgccatcattttaatatttcttaatgctactattttataattccaactcctggaaacacatatatagatataaagctacatccatgggaaatgaaatgattggttgtactaaacttttcaagatcatgaacattctattctttactctattacagtaaagttaagtacgaaaggacaagaaaagtgtttattcgcaagcaatcacttccagagaataacatttgttgtcctaggtgcaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggtgaattacagaagccctagtttttgcatttctttacaatacgttacacaatgcaatcatgtagccatgcaggagataatagcttatatggtagatttcaggtttcttaattatccgggagttgtttcttgagcagagaagtttgtaatccattaacaggataccttagtacctgatgaagaaatgcctacatattaccacattttactaaccaaaactcaaaaagtctatatgttgttgattattatcatcctatgttgcaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggtgagcttcaaactttagttacctaagttctaggctgttatattacatttatgtgcatggtatctgatttcagttcataatatgaattagcgttatagagtaatgcatttcaaatttcattccccgatgtagctgatagtttcattcagagctcccaattataatttttaagctaattggtgttgtcttacattctgaagcccatgacaattggcctatggaaataattagtactactaagtgccctagttatgatgtgcaacatcattgtggtagcacgtatctcttcaattatttttgtggcttagttattttcagattgttcactgggttattaaaacagattatctgttccacgcttctaaaatacattttctcaaaaaactttcttctactgcattgctatttgtgaagtttatctatcaaaacatttagtttatccctataatcaagtagataatccgctcaataatatgtttcaaactgagccagtgctatggctacaatgatatcttgctaatactgaaaatattccttgttatgatgctattttgttctatgatatatcttttcacgttctaggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcctgattgcctgcctgataacgatggctttatgaaaagttcgtcaggaattcgtagtctctgtgcagaactccagcgagctcttacaggattacctgagaaggtagagtaaaaccaacttgttttattagtttaacattgtgtgttatccagtgaaatcaagcttgtaggaacttttgcttaagaatatgccacttttctaaataaagatgttcccagtatattgtactcatgtgccagaatttgagctctatcataatcattcacttcgattgccttcttcgtggttttttttcttataaatgttctgtttataaacaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaacaatacagttccaatatcagagtactgaatgtcaagtctcacatgacagatgcttttattcattgcttggttgttatttttttgacgtatgggaataatgctctgtgatctaatc

SEQ ID NO: 64861 - DNA, 1029 bp, Oryza sativa
agaaaaagcaaatttattatcaattgtacgagtccacgaaatgcaaatgcaaatgagcacataagagttggagcttgataaggtgtcccaagttagttacgctttcggatagctttgatctgacacaaaaaaatatctgactgtagtcaggccccaaatatgtcgccacacgtgaagcaaaaccttattaattttgttgacataaatgaacgaacaactaataagcatactgtaatagtgtcaatcggttaattaattagcttgctagcttcaggggtgcaaatattatttgttttttcacggtttccacaaattcccgatgttgttcttgttcctttttctttggctaaaatttaagttccaaaaaaagctgtgtctatgctaattttgatcagaagtcaaaaaaggtcatcttttttaccaagggactactagatggatatcccaataacttccaaaggctctacgatttgagataattcaatatgcaacttcttcccaagggctgctctactatttggaaataatttaacatgaacttcgcaagggcgctacggttttaagataattcattaaattgataactgcattatgtagtttgatatgcgtacatgtaatcctcaagatatctctacgtataactaatctcgcatatcctgcccattcaaaattagatctcattttaactctcaattaataatcgattaagctaaaaataccttgacaaatttttctgttaagatttgttgaattttcagccgttaatctaacctttagatccgtgacctctttgtgtcagcgctcccacaaaacgcttaacctgcgagtgctggacctggactacctggtactgtacatccatgcatacgactgattatctttgtcactcactaattaaatagtttaaagttgttgttaaacgtctggtgtactgtttcctgtcaacttcactttgcccaaaagcgtacaggggatgaaagcctggtaatgatgagagagagagagaggagggtaatttgaggaaaaaat

SEQ ID NO: 64862 - DNA, 788 bp, Oryza sativa
ttatcatcatactcaccattgcatggccctcatatattttgttggccctcatataagtttattttgatcatccaattaaaagtaagaattaggatatgacgaaatcaacattaaaatcatttattaaaataagttgtactatcccaaattaaaagatgttgtactacttataaattttgtaatgttaatttatagtgataaggaatggcgaatgcaatacggaattaatggcaagtgcaatattaacaatttagcatatatatatatatatatatatatatatatatatatatatatatatatattgcataatgccataaatttagggtaatgttgggttggcctttcgaccagtttagcatgtgcagtgatgtggaggcatactgtgctacattacagcatatcaccccagcggaataaattggtgactagcgtggaggtgtattgttctatattacagcctatcaccccagcagaataaactggtgacttggaggcgattagagtcgtctctcaactatatttggttacctctcatccacccatgtaaaggcaatgtagcttaaagataaagctaatcatgagccgcctaatatggtttcatttatatgttaaaacctgaagttagaagatgcgtctagcacttaaaataaaagaattatattaaccatttgaattagagtttacgaaatttttttaaagtaattttatgcgtagtccaatacaattttagataaatcaaaaggtagcgtatctaaatttggaagatgtgttggatcataaacttt

SEQ ID NO: 64863 - DNA, 1151 bp, Oryza sativa
atcgaatcaaaacccgcttcatcttttcgactcagcctccctcagattcccttctttcctattttccctctactcgaaatccccgagttcggtctttcgcttgaaaccactaaagttgctcggcagatctaattgtcgtgcgtcgacccgtatattctcaattctatttctacctttgaaccccaccatgacgaatggatttgtatgccataaaccgctcctaaacccatagtcgatattgtccctacctttgaaacactaccgcgtccgatggatttgcatgcccaagcgtcgcttctaaaaatcccatcatatcgtcgtcaatttattcaagtggtcgcaaagaaaccctaagtcaaatacttgggcgactaaatggccgaatcacttccaatccaaaccccagttacaatttcagctcaaagtcaaaagtccagttatacagtccatttataaggcgcccagttatacatacaaaagtccagttatagagtcccgccttatatatgtttgtggagtgatgcaccgcattgatatatcttgttatttttttagtgaattttaaaaacatgaaaaaacgagatatgtgccctcaagagacaaatagactttctgtatttaacttgtttaaaacctaacaacctgaaattaaacgtttcatttatttccctttaattcgaagtttccaacattctctaagccttagatatacaccctccatcctaaaaagattagcttctgatccttagaagttgattttttcctttttacggaacattacacatcaatgcctcatcaaatttagccttacatatttataaagtaatctatcccatattaatggacgtgactacacagctagtggtagctggtttgtctaaatcatctaccacttcatctataagagatactatccacctatacttcaaatacaattttctcttaaactactcatccaatctacgatccgattacaccgttgtgttcgtaataattaaatctttacaacaagatctcacatgattatattttgatgaaaaatcacaaattacttttatgatatgtctaaattatttttagatttcactaagttacttcttagaaatacaaaagtaaattcagtaaagcttgagtattctatagtgtcacct

SEQ ID NO: 64864 - DNA, 1998 bp, Oryza sativa
cggtagtgtttcaaaggtagggacaatatcgactatgggtttaggagcggtttatggcatacaaatccattcgtcatggtggggttcaaaggtagaaatagaattgagaatatacgggtcgacgcacgacaattagatctgccgagcaactttagtggtttcaagcgaaagaccgaactcggggatttcgagtagagggaaaataggaaagaagggaatctgagggaggctgagtcgaaaagatgaagcgggttttgattcgatcgcaaggttccaagggttcggggaaagaaatggtattgtggcaaatgaaagaattttgggacttcgatcagtttaacatcgaagtgcttgacaagacaaacgggggaaagagagggtaaggaaggatgtcggtttgggggaacactctttaggtggatcgatttatctgtgttattctgacggttcaaggaaaagacggggtactgtaaccgtctagtggagttgaggaggaacagagaacggatattacactgagaggcgtttccagaaaatcactgggttcgagtatttgcagatgcccgaataatttgctcgaggagggtattaacttaggaggaggatcgaactgtggaattcgaatctggaggaatcccaacaaggattgggattcacaagaatggattaacggagatctttggcacaaacatataaatgcacacaattaacacaaatctcattatgcgtgttgggctaggcctttcaaggaggaaaaactagacttttccgtgaatcttttgaaatgaattctttaaaaattttagttcgcaaatagggtttcactagtaaatttcctctagtttttatttgtaaaacaactccaaaatagttaacttctagattttcagaggttagttaacattagccttcattgtaaaaatagttttccagggaattatcccttacaatgatgttttctaatatctagtatttgtttttatttataaaacaaatacatcaaataggttctaattcatagaaaagggatttcagaaagataattgtatttacaaatattttcttaattaatacatttcataatcatggttcttttaataaataatatttgaatctaaaatagattttgtccgtagatttttgtccttgtggtccaagtgcaacagaaaatgggagataaaatccagcgtgacggattttagaaaagttttttgataatcctgaattttgttcccgtaatctagatttgaaattttcagggtgtcacacgccggcagcggcatttttttttcactgaaaatattttcgtagtcgggtgaatctaccgtctaaaaaattatttatctatcttcataggcgtttccttacagacagaatacccgtacgtaaagatggatttggcttgcctgcaaataacttttttcaagtagtggcggcacggtggctcaatatcgcacaattatcttggcgtgacgtctgcgtcgtcacataaacccagctgtttgtcgacggcgttgccaaggttgagcatagtcagcggtacaggagcgtggccacgtcactgctttagttcgttgcaagctactactccctccgtctcatgatataaaatataaggattttgatttttttcttgcactatgtcggtgatatggatccgggggtatcaggtttagagggaggaggctgccccccgatgccacgtggccctcccccgaggggagtcaggcccgaggtggggtggcggccactccttccccaaagactagtcggaggaggctgtcccccgatgccatgtggcccttccccgaggggagtcaggcccgaggtaggacggcggccactccttcccagagactggatggaggaggctgccctccaatgctacgtggcccttccccgagaggggtcgggtccgaggtagggcggctgccactccctggccgagactagagggagaaggccgccccaggcgcctcatggctcccccccgagggg

SEQ ID NO: 64865 - DNA, 1427 bp, Oryza sativa
ccagaagtctttatccattaaatggtgactacaggggcaccccccgtgtcaggcggcaagatttgacaggccccatcatcaagacgacgcgtgcttggcttcccaagtcaagagacaagacatgcatttaatgcaaagattataatacttctccaccagagctaggttaggttgttgggcccatgtggtaaccccttgaggtataaaaggaggtccaggcctagtggtggaggggggacgagggggcgaactggcgcttgggtctcacaacctcaagcacttgtgttctacattcaatcaatcatgtacaggagtagggtattacgcttcatagcggcccgaacttgtataaacctctttgatctgatcgtcttggagggggctaaccccctcaagaccacacagtttcgctcaccaaatcctcgaatctcacccgctgccccggccgaactcacaaaggggggcctcacggttccctggtggaggagttcattctccgacacactatttgaccattcatcttattccaaaaaatatttggaattattattaattttatttgtgactttctttattatctaaagtactttaagcacaattttttatttttttatatttacacaaatttttttaataagacgagtgatcaaacaataaaagcaaaatgttaaaatctcttatattatgggacggagggagtagtagatatcatcatctccgttctagagtactgttttagggcctgtttagttggtgaaatgaaaatttttgggtatcacatcggacgtttgaccggatgttggaaggggttttcggacacgaatgaaaaaactaatttcataactcacctggaaaccgcgagatgaatcttttgagcctaattaatccagcattagcacatatgttactgtagtactaatggctaatcatggcctaattaggctcaaaagattcgtttcgcgatttacatgcaaactatgcaattaattttttttatctatatttaatgctttatatatgtgtcaaagatttaatgtgatgtttttgaaaaaagtttttggaaacttaaacaggccttactcgcccacaatctatccaatctaatcattctatgactctacaggagcatgaggaggaggacgccgtcggcatagctggcctgtgacttttgtgacgcagatagaataaattctgcctttcaccaccagcggtcgtagcaatctcaagatcgaacaccaggatacgtatgcctcccttcctagacgatcgagcatctccgggtattgtgcattacgttgaccgtcgtgggctagcctagtttggaacagaaaaagaaaaagttgagaaccattgtgtatcatcactgtacatcatgtgattttctgggttttaagaactttatgtaagccgtttcaaggaaaaatatg

SEQ ID NO: 64866 - DNA, 18962 bp, Oryza sativa
  unsure (1)..(18962): unsure at all n locations
accacaagataatcaagcctttattttactacaaaaagtaaaacaatagtacattcactcatggtcttgctttcgagcagagcagaaagagaaatgaatggggcataataagtcatgtgcttataattatcgcagccgattgtgccatcatcaaacctggcattttgtacaaccatccgtggagtggcaggagcaggtcaaaagatgaacacaacgctgtcgtggaccctgttcttctgattctgcgcaacacactctgatatccacatcaagttcctaatctcctgctcccgtagccttatgtaagcaaagaaaacagcatagtggaactgcgcaaacaagatatggagtcaaagatcccagcatgagaatccgcaatagtggcataatgctcacaagtttgttatcccctcatattggactagggataaaataaacagaactagatgagtgcactcaagcatgtatgcaggcttcagtgccacatgcattcttttagcaagagaaactagctctttgcggagtgcttattattactccctacggttccataagtcccgtcgttttggacaaggttgaggtcaaactattagagctttgactatcaataacttcaaaaatatttagtttgaaggcactagaacatgtatatttatttatcgtatattgtatagtaggagatcatagtcaaagatatgttttggagactgtcgttgtccaaaatgacaactatggaactgagggagtaaactcgtaagtggaactagaagatcccttgaagaaagttggtatattaaagtccaaaatgagaatgcagatgcacccccaccatggaggtcctaaggtaactaatataaaacaatgaaaatcatacctgctgttcaaatgacaagcacagcctccgcacttcctcctcatagaaggccttatccaacatttggctttccccatacgaaattttggcaaaaatagcctggtatggagggtacttctccattacaccacggacctacatgatgtgaaaaggaaaaaggtgttatggaagtccaaaaaaagaaggatcaatgtaatggtgatgatgatgcaaaaaaagaagaatcaaggtaatgtgatgatgatgcatatagtgtaactaacatattttacaggaattctttatgtatgctaatggtgcaccacactcttttttcatctacctatacaacaaacttaacaaaaagaacagcgtcaagccagaacaaaactatggttatactagtaagcatggtagaccaaagggcaataactaaaactacctattgctactaatgacgggcacaatagaagagaagacaaaacatataatagctaaagcagctttccaatctgctccagatgaaaggcacagaaaaaatagtttggcacacattgatcaaagcataaaacatgtgtaagaccatgcgctcccatgtaataatatgcccattccattactcaaggaaggttccaacacagaattttcaaaacaaataaatgtaataccagtatacaaaaaaaaaatcattgtgtcttggctgaaccaactactccacagacgttgatatagagcagtcagaaaaccaagttcgatgtatgcccatcacacgtgatacgtgtgccacaaaaacatctcccgtggaataccacgcttctccatttcttgtggaggaagcgctcggcctagggcatgatttttgttcaataggactaccaataaatctatttagtatgatgagtggtccttttgctaaacatgttggtaacactccaatagtgttcatttttcatattagcagtttaagttggccaatgtaagcaaatatgagaagcaagatgtgattaaacaattgaagatgtatgtatactaaaacgtgctagaactgaactatgagcataaatgaagacaaacctgatcaacatcttcacaaacagccagttcttcatgaccatatggatacctggaggtcgaaaaaaagtattacaaacatatcttggcaaaaggtactatcaagctggttctaatagaaacctacaataaaccaaagttggagtacagcttccgacggtcatctctagtcaactctgtaccaatactagaaaacatgacagagagatgtcagtatcacatgattgtgcacataacaacaaacaaggaagtatgtaacaaaattatacggtttgaagtggaaaacagaaaaaacttggcacctacctgtttattgtaatgttcacagctcttctgtctgcttcaaatgacagaagatcgcacataatctcagcagttgcaccaccaagtttctgtataacacaaaaagtcaatatgaacactagatgaaattggaggatacagttgaagccactatatttgtgtagttcatacttcacagaatttgtaaaagtcctcaaggtatgctttgtaaagagtgttcctcataatctcgatattcatgtcatccaaatcctgtaaaattcaggcaactctcattatcaagttagccttggtgttcaaattattaaatggattgtaatttattggacaccacaaaaggttacagctatttacctcagatgtaatgcattctgagaagtatggggctaacggtgtgtcaaccaaaaccaatctgtaaagctcgcgcatattttgagcaactgcaagagatgcaatgctattgcatggcaaaaagaacacttagtatcataagaagacctccactcaacagattcgataaagaaatcaccagaatacctgtcaaacattcccaatggatggcatttctccaatagttcattaacatctctctcatgcaatgttccggtaacaataagtacaacattgtcgatcatgtggccatacctgcaaatgttatctcatcagaccaaactatgctgcattactaaagttgggcacattgacatgtgcagacaaaacagaagtgaaagggcatatcctagcaatattgttgcttacgttatatactgtaagaatgtggatagtggttcagtcgcctggcacatcatgtgtttgtactcatcaaccagtttaagagtgcacttctccacaattgtagttgtgtgcaggggtgaaggttctgcagttaatcagaaataagttcatagtacagatgtatcacattagcgtgtaacaagcatgcactgatgcactgcaattatatcacgacaagcatcaacgcaaacagtattccatataagaatagggacatgtggattctaggaactatagcaattattcctaaggaaaataactaaatcctcagtggtttaccggaattcgatcaaaatatacccttccgagtggtctctagtaaaagctaagttgcgaccctctacatgtatagggcaaatcgtatcctttaactgctgcactcctacagaatgcgaaacctatgatactctagaccaagctaaacaacatatcagaacaatctgttaaagcgatccattgactttggtttcttgcaagcatagggcatcgtgggcttaatcaactacttgaaaatttcaggcaaagagcaaccaaattagggcaacccccaaatccccaaattggcatcgcaattcgcgcggaccggatcggggatcgccgatcgatcaggacagtcatggcggcgctacccaatccgatccgatccccccaaaaaaggagatcagagggcggcggcggcgagagagggaggtcgtaccgttctggaggtaggggccgtactcggtggcggtgaggtgcatcttgacgtcgtcgaggttctcgcactggcagaggttgttgtagtcggcggcggtgaggaggcccgaccggttcccccgcacgatggcctccaggaagccgtcgtggatgttgaacgagagcatctcccacccgtacatcctgtctctctcgccggccggcggcggcggcggtggcggtggcggcggcgggaggggtggatcgggaggagggggggagggaagccgcggcggtggcagatccgggtgcggatgcgggcggggtttgtatgagacgagacgagatcggtcgtgctctgctcgcgtgagcgtgtgggatccaggattggcacgtcggcagtgggccccgtgcccgcgtcagtgctcggggaccttccaggccgggccggggcgggtcaggcttagtgggctgggtattttggttgcgggtctaaagcggaaacgctaatacgcgcgcgcgtttcgggcctagaagacccagcgccgctgtgccagcgcgcgcgcctccttgctcttttttcctttttttaccatttttttccttttctttcccacttttttctgattttttttatctttagcatgttttgagtttgaaagtttataaattttgatttgaaaattttaaaatctgaacttgaaagcttttaaatctcaacttgaaagtttttgaatctcgatttgaaaattttcaaatcttgatttgaaattttttgaatctcgagttaaaagttttcaaatctcaaattgaaagttttcaaaattttcaatctgaacttgaaagttttcgaatctcgattctcgagttgaaagttttctaatctcgattctcaagttgaaagttttcgaatctgagttgaagtttttaaaatttgactttaaaatttaaaacttaaatcaaaagttttcaaatctaacataaaatattttcaatctattagtaaaaaaatctccagaatctttcctaattactatcattagtgttaagtatattaactaatactagcaaaatgcccgtgcgttgcaccgggtagtagtgggatgagtactgtttgatcttaaaaaaaatatcgaagcaactaagcctgatcataagcatcaatgatgtgttctatgaccacaaaagcaaatttgttcttggacaattagtctactctacatgtgtggcatgtaaatgatgcttataacatgtgggcccgatgattgtagcatgggaataatggatgggcgaaaaatactgttgcctttgcacataaggcgacagacgaaaatttgcgtgacaaacaaataaactgatatttgtaagcctaacgagtgtaaattggaaccacaacactttgtaaggggtattacacactctctttataggttgaggtcatttattatcttgtattatattttcttttatgaaagttttatatttttttcgcattcgatgctttttatctcgataaatatttaaattgaagagcataagatttttatcttagcgaattaaaataatagtaagatgacacttatcctctagctctctcgtttttctctctccctcgcttcttctcaccactgctcctatccgttgtcacaggccaaatcaactactgaccccattccatcgtcgttggtcttctttttcctctcggcatgtgctcaaatcaaccaaggagacgtgatcagtgagtttggtgccaccgaataaggtcgattatgatgggtgcctctttctcatcctactgtcaccgtatctagattccctaagtttagaccatgtttgagaagagggaaaagaagaaaattaagaagatatgtaaaacgaggtgagtcattaatgcataactaattaagtattaattattttaaatttaaaaaataaaataatatgcataggaggagcggaagatggagaaaaatcgagcatgggagacggtccacctaagatgtacattagctaacacacgggtggtcgaccatggatgaagcatcgtgtgcgcgtcgagtcatggttctggggtagtgttgcgcttctctttagcgacttcgagctcctcgtctatgctattgtagcctccgggcactggcggcatggaaagctcatgtccgcatgcgatcaacactcagaatgcgacgatttagcttagtttagggcacatgaccaaaaatatgcaacgttttcttctgtctcactatcccgatctgatgctatgagcggaggatgattgttggatgcttggagtgaaaagaatcccgatccgatgtgataagcggaggacgattgttggatgcttggaatgaaaagaatccaggaaatgcacattactacaacaaaaacatttttacatatggtcaaaactgatttttttttcgtgtgatttgaccaactgtctgccctgaaaggtgtacggaaatattgatttttccatgcgggtgacgcatccacatgcgaaattttgattttcgcatgtgggcgcctaagtcgtcctcacgcgaaaatgaaaaacgcaaagaaattccaaaaatcaaaactggaaccataaccctagccagccgccaacgccatcatccgcccttcccgtcgccgccatcggcggagaggcggcgggatccgggcaggagggggaggggacgcgtggaggccggatcagcccctcccgtcgccaccgtcggcggaccgcgcgcgtggaggccggatccacccctcccgtcattgtcgctggagcccatcgccctcaccccccacaaccacggcccacggtgccctcgtacagtgcctcctccctagctgacaacacccttatcccgatgagcaacgccctcgcacatcaccctcccccagccagcggtgccctctcagcggcatcaccctattctccggcacaatggtggcaacctcttcacggtagtgccttggcaacagcaccctacttgcggtgcacaacggcatgcccaccaagcttccacagcctcgggacggcggcgtgcttggcctccattgatcagtggtgccggtgttttagtttttatgatttaattttctggaatgattttgatttattgttgttggattttttattttatgatttagtggatatgtgattttgtgattcagcggggtgaaggacgaaaaatcaccacgaaaaatccgaatatttatattagttatagtttatagataggtagttattaagactaaaggggagggggaacagtccccagtctaaaggcgtacatgtcccaaccttttactttattatttttcattcgcacgttttcctaattggtgtgtgtgttttaaaaaatatatatacagcaaagttgtttaaaaaaaattgtattaatatttttataacttttttttagaattacacagtacaacgcaaacacacataacgcacgcgcactcactcctatgaacacatgcaagtaaaccctacccctataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccanncaggtgnnncttgctgtncgancnngggtaccgntnncgccnntaccaacntnngaaagncnnacaancgncnncgtntanancngncnnactgcactcctatagaanncacatgcaagggtaaacccttacgcgcactataagcatcttcgaagactggaccagcaaatactggagagattgactatgagcatcttcgaagactgggccggcaaatcctggagagattgacgaagtcaccacaggtgcctcatcttcgaagactgggccggcaaaccctagagagattgacgaagtcaccacaggtgccttgctgtcgacgggtacgtcgcctaccactgaaagcacaacgccgttaaaatcctggaaaattcactcccatagggagtcgaacccaggacctcaagtgttactgaggctcttgtaaccactaggctacaggacctttcactaatatttttataacttaattaaacatgtatgtcgttttgcgtacgtgggagagaagtttacaacctttcctcccgaactaaggggtgcctttgatttgtaagaaaaaacatagaaaattagatgatttcaatcctatatgaaaaattcctatgaaggcatttgaattaaatgattgaatcatatcctttcctttggaatctattatattattaaaacagtcttgaaaaaaggcaccacgttcgctgtggaggctagaaattcccacattaatcggtgaaaaagaaaaggagagtccaactagaaatacaatttaaaatagttgaaattcggaattaaaaataaacactattgaaagaagagcccatataagaacccaatacgaaattcattaatattcagaataaaaaataaaataaaatccgaaagtagaaaaaaaagaaagaagagttcgagtagaaatataatttaaaaataactaaaattcagaattaaaattaagcaatattggaagaagagtccatataaaaacccaatatgagattaattaaaattcgaaataaaaaaaataaaaaatcgaaattagaaaaaacaaaaagaaaaattcaactaggaatacgatttaaagttagctgaaattcaaaattaaatataagcaatattgaaataagagtacatataagaacccaatacgagattaaaaagagagttcaaataggaatgcaattttgaaacgactaaaattgaaaataaataataaaatattaaaagaacacaatacattattagttaaaattcgaaataaaaaaaataaaccctaaaattagaaaaagaaaaataagatttcaactagaaatacaatttataaataactaaaattggtgataaaaaataaagactattggaagaaaagactatctaaaacacatgacgagattaattaagtaatagacctataaaagagtagagtggtggcggttaatgggacatctaaaaattattaataaaacaccaaatagaatgatggcgggtaggtcgtgaagcaaccgatcaaggctgttggcgggacttctagaaagtaaaaaaaaaataagccccaatgataatcatatttgatttgtaaaatctcaatgacaataaaaataagaggcagcggacaggttgtacgggagtacaatggcaaagctgccgatggtttggggaacttctagaaagtaaaagaatgaattccaacgatagttatgttcgatttttagaatcccaatgacaataaagaatagatagcggacggtcgtagaggagtatagtggcagcgcttgacgggatttctaaaaaatataaaaaatgaaatccaatgagacaataaattataaaaactataaggtccaattttaaaaggttcgggcttctgaaaagtaaaaaaataaaccccaatcatgatcatgtttgattttaaaatcttaatgaaaataaagaagggaggcagcgggcgagccgtattggagtacagtgacaaagtcgctgacgttttgacgaaacttctagaaactaaaaaaaatgaacctaaacgataattatgtttgatttttaaaataccaatgacaataaagagatgaggcagtggacaggccgtagaggagtataatggcagcgtttgacaggaattctagaaattataaaaacgaaacccaacgagacgataaactctaaaaattataagatccaattttaaaaggctccaaagagaatgaatagaaacaatgatagatcaagcaagcaaataaagaaggatatgacagaagtaacgggtagcaactggtgtaaaattataaaattagaagcacgagaatgataaggtttggtctttcaaaccttatcatataaaaatatataattttgtatgggtgctagccgcgcaattgcgcggtaacaatcctatagagattttggagaaaaaatggcaagagatccaacctcttgaaaaatttcctattggtcaatctctctcatttgattcatgtatttttttctactgcataatcaaatgattattcatgtattttgtattcctatattttacacttgcattcctatcaaaatctttttttcctatttcttcgttttctcaatcatgtgtttcaaagggccttaaagcctgtgttcgggagtgagggttgggaactttcactccctagcacacaaaacgaagcactgtttagcgcgtgattaattaagtattagctaaaataaatttgaaaaatagattaatatgactttttaaagtaactttcatatagaaattttttttagaacacacaccgtttagcaatttaaaaagcgtgcgcgcggaaaacgagggagatgagttgggaaagtagagataaaaacttagccaagtatctctgtagttttgtttttcatggcagtgattcccctgttgaagctggtataaaggagttggatactttgggtagtcattttgctcggtaatgtgagcaacaatatcttacagcgaaatatcacgaatgcggaatctattttgccgtggctggctttctttcaacaaagatattgcaaggggaaaaagaaaaagctttgttccaatggaatgaggttcctatcatgctttctataaaagagtggtatttccctacatgcatttgtgtaagtgtgtaacaagtgattccttgaaacatggcaatcactttctgaatatcctaccaccaatgtgatacataggtcagattattccctagtggacaattgtgaacacattacactaatggaatatttgtctttcccttgatgaatttatgcgatactttatccaaagatcgtgatcttcatacatggtcttacgactttgctgaggcctgtgtttttgggtaaacagtcacctccgcctggtcactccgcctggtcactgtgaccctcttttgcgagggggcaccccttctccaagatcacgattgaagaaaaattcttcaaatttagtcaaaaacgttggtgtgaaattcagagaacactaatttataacacagtgtgtcttattaacccaatctagaccaataagatttcaccattgtgccgtaattgcaatgcttttggtttagcataaaagggaaacccaacccctgtacgaggaagcaaaagcctagtgatcttctattgtttgacaattggagaagaaaatggatgattggcttatgggtggtgacttaatggctggctcattatttggagataagaaactagtggaagcttggagcatagattgtttcctgaaagatcatgttgtcatgttgatgccatcctttagtagatgtttgacatttggagaaaatcacacttgggagttgggactgtacttagagaaggctactgcaactgcaattcaaagggtgtagttcacatcaatcaatggcctttagcacatgaagttctgatgcttatgattcgcatcctaaattcctaatatctgaacattgtagatatagtttcagacttctgctagtttgcttttggaaccttgtgggctgttctgtttgactacttccataactgatgaagtttgatgctaactgaggaagatgaagaaagcttgatgtaactgttatgttcttttaaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgccgatgaggaagacgtagagcgacgccgtgggcacggccagctccgggtaccagacgaggacgaggtagaggacgtgaacgagcacggtggtgggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcctgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttgagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtacgcggcgtacggcgcgtcggtgttccacgcctccgggaacgcctcgtcggcctgcgtgccgatccacaccgccaccatgatgtcgccggtcaccatgccgggctcgccgccctcgagccggtaccactgcggcgccagcgggccgtccggctggtcgcggaccggcacgtcggagaggtcgaagcagacgccaccgaggaaggcctcgatcggggacggcgcgccgccgtcccagacggatatctccagcgtcggctccggcttggcgtggttgatggcgaacacctggttccactccgggttgccggtgccggagacgtcgcggccggggcgcgaccggagcgtgtgcgggccggcctggatcttcacgtacggcccctcgcaggcgcggatgccgcgcaccttcacgacgcggacgaacaggtagcgcatcggctccaccaggtcgtacgacgactgcaccggctcgacggcgtcgccggtggacacgaaccgcccggagatgacgcgcggcgaggtggcgtagtactccggccccaacccgccgctcaggtggcgcgcgatgcggacgcgctccgtggccatccgcgtcttgcgcacctcgggcgggtaccccgcctcgccgccgtccggctccggttcaggctccggctccggctgcggctgcggatgctgatgctgatgcatcggcggcgccattggcccgtgcggcccgtgcaccgccggcggcatcatcgggccgtgcgggccgtgcatcggcggcatcatcgggtgatgcatcggcggcggcgcctcttccacgatgatgacagggggatgcaccggcggctgctgcacctcgacggcggcctcggtcggcgcggggatgtccgggaggtccctgggcgcctcaggcgggacctcaggcggcggcgcgttgtcaccaccaccaccctccggcggcctatcctccggcggcggcggcgcctcgtcgtagtagtaaatcttgaggccaacctcgccgcggatccagctgagcaagctccgcttctcgagcgggaagtacacgatcccctcctcccctcgccgcgagaactgcgacccgtagatgcgcacgcggccgaggaagtggttcttcccgccaccgccgccgccgccgccggaagggttgaagcggcggtcgtggtagagcgagacgtcgagcgcctcggcgtgcatggcggccgggtcgtgcacggcgaactcgagccgctcgtgccactgcgggctgaggtcgcgcggcacggtgcgcgtccgcttccgctgcccgtcgaagtccacgacggcgaaggcactcgacgtgccgagcccgtccttgggcaccaggtcccgcgcgtccaccacctccaccgccagcctccgcgccacccgcatcgcccccggcggccccggcggcggcggcccagactccggcgggggcgcaccggccgccatggaaacagagtggaggtgggaaaggaggtaagcgaacgagagagaggggagagagtggcgaatggaatagggttcgcttatgatgtgaggctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatctttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttgaatcgaaaaatagacgtccga

SEQ ID NO: 64867 - DNA, 793 bp, Oryza sativa
ggtggtggagttgcttagagcggacgaaaacactggctaactttgattatggaccaccctatactactgatcagtgtgttacgtgcgcgagggactaaatctgaacgcaaccgatcagaaccagacttcacccgtatctgcggatatcaagctgatgtatatcttgcttgtgaaaccctttaccttctcgagccactccaatccgatctacgctggttattgtatgattgcggtggaaaataatttgttttagatccagtgtactgagcaagcaatgatgatttggctacgtatccattgcgtggccctgttgatgagtggctggatcattatcgcatgagcagatgcgaatgacaaccgattagtcgcgctaaggacgacgaaacgtatcccacgacacacataccttgagcgagtcgatgctctaaagacagccggagacaaagggtctgaagacagaggatcatgatgtccggcgatatctagctgaggtcaatggtgaggaacgatgtggtgccgacgatgttcttactgatcacgacacgtaatggaagttgtggtcaggtgtgagggaatgaactagacagttgcgcggatgtcccatgagattgcctgattatggaggcaatgcttgtacaaaggagtcccacttggatacgaggaacaagcatagtgcgtgagttggggcggacaatgaatgatgaccaggaggctctaggtagtagcttgaagcgacagaacctgcctctccaaatagagaatcttcttgcgattgacaagacagtttcagaag

SEQ ID NO: 64868 - DNA, 11797 bp, Oryza sativa
  unsure (1)..(11797): unsure at all n locations
tggtgtagcgttggacagtgattggttaatattgattaattactacagctgttttactgctttcaactactgctttgaaatgcctgctttatgcaaaagaatccctagcttcctttggttatatcctgcatcatacctcctcttccggtatgacttgttgagtacagtgggtagtactcagtcttgctctcttttcccccacaccagagttgaagttcttctcagtggagccgtctcagagaggttggcttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctagacaggaatttaatgcacattcagcttagaaattctggttcgagaattttctgagtgtgacaagttggtatcagagccgaccttgaccgtaggacaagccaactagaaacctaagagccctctgaacccttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcggaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgccccgaccttcttagtctgtttgcttgccagttttcgtgtttaggtttgttgcttgtggattagtcggcggtcgatatcatatgtcagtggtatgactgcctcaattaggagttacgtgcctctttttcagtgttttaatcaagattaagataattacacttaaatttataagaaagattagtttctgagccccctgtttttcttccttttctcatatttctacctatccccttcagatggagacaaggaatggttcacgcgactccaacaacgccagtggcagcgaagagccgatcaatggagcacgtgccaacagtgcatctgacaacagtccgtccccaccgcccaggtgttggacaatcagactcagatgatgacaatgatgatgtaacagatgcagcaacagtaccatcaggtgttgcagcaggtgcagcagcaagcacagcagcagcagcagaacctgcagtttggtcctccacctcctcagtccaaactgttagaatttctttgtgtcaagccgcccactttctgaagcaccaccaaccaaatcgaggcccacgactagcttcatgccattgagaagaagctgaatcttttgcaatgcaacgagcaagagaaggttgcttttgctacacaccagctgcaaggtcctgcttctgtttggtgggacaactacatggtgacccgtccaactggggcagaggttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcacgctacgcccctgaggacgtgcgtaccgatgacgggaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggaagcttcaacaagaaccaccatagtggcagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgtcaatcatgcatctgcagaggaggcgcagtcagcaacagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttgacaaggcacagaggagtgattgattgcgccagccgcaccatcaagttgaccaatgcaaaagaagaggtggtaaccttccagtctccagtgccgcagaagccagggattagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgctccaatccacaagaggccttacagaatgggagccaacgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctactgtgttctctaagatagacctgcgatcaggctatcactagttgaggatccgcgaagaggatattccacagacaacattcaccactcggtacgggttgttcgaatgcacagttatgtctttcggactcactaatgcacctgccttcttcatgaatttgatgaacaaggtgtttatggaatttctagacaagtttgtcatggttttcatcgatgacatacttatctactccaagtccgaggaagaacatgagcagcatctccggctggtacttgaaaagttaaaaaagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggtttggagtttcttaggacttgagggctattaccgccggttcattgagaacttctctaaaattgctaagccaatgacacaactattgaagaaggaagaaaagtttatctggtctgctgaatgcaataggagttttgaagaactcaaacgacggttggtgtctgcaccagtcttaatcctgcctgatcagacgaaagatttccagtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctgatcggtaaccgttgtgaggtatatacagatcacaaaagtctaaagtacatcttcactcaacctgatttgaatctcagatagcgaagatggttggagctgatcaaggattatgatatgggaatacattatcatcccggcaaggctaatgtggttgcagatgccttgagcaggaagagctactgcaatgttgtatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttttgttgaggatgaataaggaacaatctggatgggagaaagattgtatgtacccgaaaacaaggaattaaaagacttgatactaaccgaggctcatcaaactcagtattccattcatcccggtagtactaagatgtaccaagacctcaaagaaaagttctggtgggtcaacatgagaagggagatagctgaattcgtagcactctgtgacgtctgtcaacgagtaagggcagaacaccaaaggccagcaggtttgctacagccacttcagattccagaatggaagtgggaagaaatcggaatggatttcatcaccggtttgcccaggacgtcatcagggcatgattctatttgggtagtcgttgaccgactcaccaaagtggctcacttcattccggtgcacactacctactcagggaagaaattagcagaactctatatggcaagaattatgtgtttacatgatgtacctaagaagatcgtgtctgattgaggaagccaattcacttcaaagttctggcagaaattacaagaagaattgggaacccggttgaatttcagcactgcttaccatccacaaacagatggccagaccgagcgagtcaatcaaatactagaggatatgttgagagcctgtgcgcttgactttggtggagcatgggacaaaagcttgccgtatgctgagttctcttacaacaacagttactaagctagtctgcagatggcaccgtttgaagcactgtatagacgaaggtgtcgtactccgctcttctgggatcagacaggggaacgccagttgtttggtacagaagttttaaatgaggcagaagagaaagtcagagctgtcagggaaagattgagaatcgcgcaatctcggcagaaaagctatgcagacaaccgccgaagggagctcgctttcgaaacaggggattatgtgtatctccgtgtcactccgctcaggggagtacatcacttccaaaccaaaggaaagttggcaccacgctttgtgggaccatacaggatcttggaacgtagaggtgaagctgcttaccagcttgagcttccctccaacatgcttggcatccacaacgtgttccacgtctctaagttgaagaaatgtttgagagttcctgaggaacaggcaagtccagatcacatcgaaattcaggaagatctgacgtatgtggagaagccgactcgtatcctcgaaaccagcgagagaaggaccagaaacaaagtaatcagattctgcaaggttcagtggagtcatcactcagaagaagtggccacttgggaaagagaagatgagttgaaggccacccacccgcacctcttcgccagccattccgaatctcgaggtcgagattccgtttaaggggggtaggtttgtcacaccctgaagtttcccccccccccttttcttgctttaaaaattggttaaataaattgcccgaagaaattatcttaattaacctagagctaaatccctagttaataaatgcaattaataatcggaattagcgtggtggaattttttcttgagttccccatgctccagtgcattaacaagatttttagtggaattttcagagccttggaaataattttaaccaactaaaaatcaccaaagtgcaattttaaatcccaggaaaaatcctttcttctttttctttttcttttccttcatttttccctattggaccgtcggcccactccctcccgcgctcggcctccttcctttgggccggcccgttcccctttcccctctctccgggacgctgacaagtggggcccacctgtcaagtcgtccccttcctccagccgcccgctccacgacggcaaccgccgccgaaaccgtccgcgccgccgccttctccgctccgcgccgcgcccctactccgcgtccccacgtcgccgccctccccgccattcccgcccgcacgcgcgcccgcaaatgggcgggattcgatttgaatcccccccactctctctctcttcccccacgtcgccggccaaatcggggggtttcccggccatgtccacccctctcgagcccctataaagcttccccgcatctccctctcccttttcctcttttcgccgcgctctcccgtgccacctaccgccgccgcgccgctcgccactagcgccgccgcttgccgccacctccggtcgcgcgccgggccgctagagccgccgccgcgccaagccgccgccgccattagcattgccgccgcgtgagccacctcggccgccgctcggtttccgctaaaccccaccggagcccggttctcctcgcacaccggtgagctatccattctccttcgtctcccggccaacaatggtggccgccgtggtcactctctctactcctaatccttctcaactccctccgtaggtgccgccgccgcccgtccgcccctcctcatcgccaggtcgtcgccgccaccttcatcctccgctccggccgccatactcgccggtgaggatccccccttctccctcttcccctctctctcgtttgcgccgcctctctccacgcgctcgccgttgcctttggtcgacgccgccgtcctgtaccccgtccgccgtcgtttcccgcgccgccgattgccgtcgccggcgaccgtgcgcgtcaccgccggttgccatggccggtcggccagttttgaagctgagccgagccatgcctagccgccgccgtgccgtccgatcggcctcccagccgatccggaccgtcggtcctgtggaccggcggtggaccacccgcgtggtctcggtccacggtagaccggccaccttgagccactgcccgtggggcccacatgccggcgcccccttcctctcccctttgagccgctgacccatgggctccgcctatcggcgccgccccccccttggatgacgtcagccctgggtattattgcgcaataatttattaaggactttttctttattagtaaaaacacagtttatcttctaaaattcataagtaattcatccgaggtccgtttaagtccattcaagtctcagtaaatcaagaaaaatgcaaagaatccattaaaaatggttttgtttcctgtttcagtagtcttatagcatgttttgcctgtgtgctttgtttgtcgtgtaggtttcggccgtttcgtcgatccgcggtttctcgaagacgttgctgaggtctcatcagttcgagagcaaggcaagtcatgcaatacgtttgatcatattgtacccaatttaccaatatcccgcatttttctattaaatgttgtattcttttacaatgtaatgtgggatgggtcctgttccttagccacatattggttaccttatgccattgataacttgggtatcaaaatactagatgttggcttaggaaatgcttagccatgcttagttcaactagtacacaaatgggggtcacattattacatatactctgactattggcatagctttagattggtgccaccgcaagggtgtcagtaaattaaaaaattctgaatggcgggctgtgagtgcatggttttgctggacgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagtgttatgtggagggtcttgtcacgatttccccctttgcagtatcatggtgatacttcggggcatggcgacatgtgtggaatcgtatcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacttggtgtaacgttggacagtgattggttaatattgattaattactacagctgttttactgctttcaactactgctttgaaatgcctgctttatacaaaagaacccctagcttcctttggttatatcttgcatcatacttcctcttccggtatgacttgctgagtacagtgggtagtactcagtcttgctctcttttcccccacaccagagttgaagttcttctcagtggagccgtctcagagagattggtttcgttgctgccgtcaaggtttgcctgtggagtggactcgcccgctgctgaagtcaagcttcccggtttagctcgctttaatctttcctgctgcatttgtaatcttttatatttttgtaagacgtgggtctgtatgtcaacaattgtcatttgtctaccctggctggttctggacagggatttaatgcacattcagcttagaaattctggttcgagaattttctgagtgtgacatttcccaagtaatgccaaaatcaaagtttcttcagaatgttgaccttgagtcaaccgcaccaaagagaagcggcaaaggtgttgtcgttgcacgggttcaagagcttgaagctgaacttgaggtagagatgtaagacgcatcaaatcttagaggtacgcttgatggtcagcaggaggagttggattccttaaagaaaaaggtagctgattcagaagaagcaagggagctgaagttgcaagagattgaaagtttgaagaagtcatcagaggagaccgattcccttctccgttgtttgattggtctgaataccccatcttttggccctctcccctcccacccccctagtaaggtttgcctatttcttcatgttgccttaccaattcataatgtgagatggctgctgccaaaagtgtcacttggagatgtaactttgatatggtcagcgaatgtgaacttttggacatctgagtttgttttggtcagttacttgtggctcgactttgtagatatggtcagtgatgtctttagtttgctatctaggatatggtggtgctgttgtggttgtttgctcattgactaaacctatcttttcaaatagacttgtggttgtttgctcttcgatttgtggctgaatttggtcaagatgtacacacttgtttgtttaactgatgtaagtaagcctgttgtggttactaaggtctagactatgaatttgtgcgtatatcattgagcttgagttatatgggatgttgggcttgtgccatattgtatattggatttatgctattggatgttatctgggcttgtataagcttgggcctatatgggcttttgaaatggggttcaaccatttgttatttcacacaaaaaaaattggataaaatataattgggatgaaaatagtgaataaaatacttctttttatataggttaggcccaaaatctaattgggcttgcaattgggctgaggcccataaacatgttgcatactacatggaccttggtaggcacaagagattttgtgttttttttgcaagataatgcagagttaatgacgagagaagaatcatcactagattaatgacaaaaaagtatgtttcgtcgtagagcctgattcgagacgcatgatctgtgacgaacggattttcatcacatgagagtcacaggtttcaaaacatgacataactctttgttattatgacataaataaaatgtcacctatcataagatctcttgtagtgcctgacgactatccccactgttcaacatgccatgtggacagtcatagtgctggaatatgttggtggcacacattgataccagcaaaatctttcgtggtaaaatgtgatttgcagtatatgtattgcaagattcctatttggcacagctgcaccacaggtgcatgtttagagcccatctagcccatcggggtggggggcagaggagtatgatccctcttcttattccttcgttcgctgctttccttctctcttcaatgtttccaatcgacagcatcagtagagctgctcgtcgttgcccttcaatctgcgcttgtgtcaggccatgatccttgtccacgttcccagccgcgcttcatccctgggtcaactcctttggccatatcgtacccccattgatgagggacattagacgaccaattcaaaaagtataagtgttacgagcaaaatatgatttttgactaagaacaagaaggcaatttgagttttgcatctatagtacatgcttcatgaaggcttaacaataattacgatgtcattgcatatgtccttatactgctagaactagaagatatatgtcctttgagttgtgttcttggtgtcattgagtaatagatggattgttttgagtaacatcctacttatcaaataggttgtcatctagttatcatatagttgtttatgagttgtacatggggttttgaagcctataaattgaggcgatgccctcaagtttgtagcttacttccgtttaccaacttaccaatacaactggatgttcctatttcacaacttggattaaatcttcttggagctttggactaagctcttgctgtctgtggattcgagatctttcacaattgcccttacggcattatctactagcatgttgaagttgttccttcaacattttgtgccatatctacatatcaacagattggagaagttcgcctaatatattgtgctgcaccacccatgccatagctcctcaactctagccaccaggggcagcattgtagttgctagccgccacatggagacaccaccctcgccactgctgccacacaccgtgcaggagcggcaatagcaggaatgaacaacttggtcataattgcggtcgttattacaaggatgacgatcgttgaggaggaagagggattttgagtacagcatgaaaatttttggatttttcaattgaaaattttatgaagtttgcctagaagtttttaatttgaatcattagtttgtgcaatttcgagatgacagttttatagttgaattgaaagttgttatgatttgttagataaaagttttagatacggttggaaagtaatgtgattttcagatgaatgttttcatatgtttgaagagaaagttttgtgattttggagatggaagttcaggaaaactgaaagttctgatatgtagagatctttgaacgggaggctaaagatgccacgtgaagcaaaaccaaaacctgcatgggaagcgcaaccatgcacgtctagtgtcgctatagcaactacgcccactannnnnnnnnnnnnnnnnnnnnnnnnnnnnnnnnnnnn

SEQ ID NO: 64869 - DNA, 713 bp, Oryza sativa
gtgtgacttgctttgagcttccgcaaacacttccgaaccttgctcaacgaaaccgctctcctccggaacgtcggaaactaaagcgaaagaataaaaatcaacaaaacagtcaaaaaaaagcataaacagtatatgtggatatttttaacatgtagatcttgattttagaaaaatttagcaacttgaaccactcgaaacggatctacagttatttagttatgattttccgaagatttaatctattagaaaaacgggaaaaagaaaaaaccgatgatgacatgatgacatcaccaaaggtggccggctaggatggcaagctcgccggagattggatgatcggctgcgaatttggaggacatgtacgcgtagaggacgatgagacgaacccaacggtactcaccctcgagccaaacgacaaacgacgacggccggcgacgaaggggcggcgacggcggctcgggataaccggcgacggcgagctacggcggccggagacgaaggaggaggtgcggccgagcttctcgtcgctcccacgcacctaatggcggtggcggcaagcggcggcgacggcggagacggctgctcggcgcggctgcaacccggccggcagtagatcttgattttagaaaaatttagcaacttgaaccactcgaatcggatctacagttatttagttatgattttcagaagatttaatctattagaaaaacggg

SEQ ID NO: 64870 - DNA, 12165 bp, Oryza sativa
cccgatttggccggcgacgtgggggaagagagagagagagtacggggggggggattcaaatcgaatcccgcccatttgcgggcacgcatgctggcgggaatggcggggagggcggcgacgtggggacgcggagtggaggcgtggcgtggagcggagaaggcggcggcgcggacggtttcggcggcggttgccgtcgtggagcgggcggctagaggaaggggacgacctgacaggtgggccccacctgtcagcgtcccggagagaggggaaaggggaacggaccggcccaaaggaaggaggccaagcgcgggagggagtgggccgacggcccaatagagaaaaaagaaggaaaagaaaaagaaaaggaagaaaagatttttcctgggatttaaaattgcactttggtgatttttaattggttaaaattatttccaaggctctgaaaattccactaaaaatcttcttaatgcactggagcatggggaactcaagaaaaaattccaccacgctaattccaattattaattgcatttattaactagggattttgctctaggttaattaagataatttcttcgggcaatttatttaaccaaaaaagggggggaaacttcagggtgtgacaggaaacaacttcagtatgagtctttggttcttgcccttcttgtgaaggatcatcaatgatagcttccatctcaggctagcaatataaagataagaaatcacaaatcacattacattcacataaatatgtaagtgcaaaagataaaagaaaaatataactcacaataacattctttacaggctcactaaaacccatcttgctgttgcaatggcactccttgaaaacataaattgtagtgggtggcagtgtggcacgtccttatacttagtttgcttctaaaattacatgcaaacagtttgtaaataaagatgccatcactttctgaaagttttttcatatgcatatttagagtgctaaatataacatgccattagtgtaacgttttcttatccataatatgtcatccaatgttttaacaacctatggctgctaggtgcttatatccaccatgttagaaccacagcaacagattatgtagttaaagtgcagttggctagataaaaatatttagggtgattgtacataagtattactaactcctagaaaatgcatgtctagtttctgtggatcacacatgacacatacaaactcaaaatctgaaaaaaaaatcaacttattatacacataacacataattaagttacaaataagagtacaaaagaaccgacacattttattttgtatcttaccacatggcattgtgcaatgtagctccgagagcatgtcctttgctagtactgagcattctcatggttgttatgtttgttttacagacacttctcctatagaaagggaaacactagtaagacaagtagcttatttctatcacatatagataagacaactgtacacaatattttgatagtacgttgtattggtcaatcacatatggtttgactggtcagaagtaaaaacatatttagattcagatcagaaaataatatacgcgtgttagttgtaccacgaaaattgccagtttttacaaatatgacatgcatgtgagcttcaggtacaaacaatatgctagcttcctcttgcttttaaatgtttttcattaccatatatatgatttattcacttgtttctcttggaatgtaaacaaatatagagaaaagacatactatgattttttttactagaatatgagacttgacaagttaacagcaggttctgaatttgaagtcaacaataggtaactagttgtcattaaaccatggtcatagtttttgtaccagcaaattaacccaagatacaaaacaagtagatgcggcatcatgattcatgtagccaacactgtgtaagatttttgaaataatgccatgatttccaataacattcaagtctataccttatgctttggatctgaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcatatatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcagaaatactcctggtatattatggttacagagttcatccgcaagcgcacggatataccattgtagcatttcacccgagagtattccaagggtatcgtatttattttatctcgtgggaagatcatgtagagagaacttgactaataatttatatattacttgtgataatcatattctaagcaggggttaagataatccaagggtagagtaacacacaagcactaactactcattcttatgatatattatctaagctaagtggaaagaaaagaggaagaaaatctattcctatacttctaatatacatagtatacatacattctagttaaccgacatactagctaataccctctatccgatgccctcctggtacttcgagaagccaccccagactgccgagttccgtacgacagcccgttatgaccatataatcggggctaaatacggaggaataccctccccaggaaattaacttaggattatatacagacgcggaggaatacccgtactgagctgtcaccatcagcggcccacctctcatccgcagcatataaccccaaataatgatatcccgtaatctagacaacacgtctaaacgaccagatcctactctaatatcatcgtcatgacatagagtaattgcataagcaaacattatacccacaccaaagcatctcccagataagctagccgtatatccagtataacaagaacataatgtaaagtagatattcatatacttggaaagtatttcaataccataaatgtatatagaagagtattctaacaaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggtgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgattctcgacatcgtctgattgatttatcgtttgatttgatgtcgattctcctctactttatggttattctctgcaaaaggttagtaaacctaatactagtggaatattattattctaacatgtttaagcattgcaagcatcactagttctcctctattttggaaatattgacggtcgaaactgatcgataacgaacatcaacaaaaccccccaagcttgaacctttgctcgtcccgagtgaaggatgaaaggaaacaatgacttggttgttgatcaggagttgctactatgctgcatatctcaatgatataggtgcaaggtatatgtaccctctctcagattaaataatcttttgcacggtggcttactcttacccctgattcccacgagacactgcttctccttgccttgggtggttgaaagaaagaacagcaattagagcaccaatcacccaacattcattcaactcttattccggaagttttgaaatgatttttgtaaaagaaagccaagttcctcaagtgattcgctcagactctctaagtgtatcaatatgacttcctcaccagattttgcctttttgattcctactttaaggttttaatatgtggagctcggtagagatcaaacatggcatacttgcattcacatttattactaagtcaaaaacttaaactaaagtagataattaaaacatactaaagatcaagatcgtgcaatgtgtgtgtggtatatcgtggaaatggcacacgaggaaaaataaagaaaatgcttctcctttgtgcttactttcttctcccaaaaaatccttcttttattgattaggagagggcatggctatttatttattttttttcaacatcatgctcatgcttgatggagcataactttattttttttcttttcataaccatgccttttccttcttctctttttttttcaaatggatttttctttttaggagaagaaagcatatgaaaacatggagaatttattttgttggtaacatggaaatggaatggaatatttgcttacctcccagtgtaggagtttggcatgtgtgtcgacgggggatacccgtagaccggatatagagggtattggtgtccgttggtacaaggatctacgtagtacgacatcaagcaaacaaaagaaggattatactggttcagggcccttggtaggtaatagccctaatccagttgatatgagattatatgatggaaaacacagattacaaagggaataacagaactcgatgataccgatgagaccgtagtcgagttggtccgactagatctcccggcgacttggctcctgcatgctccggctctgtaggctatagtgggtgtgttggcggtgatattcgatgccttaggtcctgcccagggggttccttatataccgcgggtcagttgatctctaagtaggactcggagatatcgaacccctcatgatatggtaaaaacccagtcttgtccgagtagaactccttccatccgtagataccatccctatcccgtgatagatttccttaatgtatacggaaactatctgtatacgcgtgggtatattgtatcagtatacaacgtacatccaaggatagagggtataacttatccgtaaccctgacaatgtgcatatatgtgggtgtatgatcttgatcatagagcatgagaagtatctacacaagtcacaagagtttgacaaagttcaatggaatggcaagtaaccaaaatgtatatggtttaatcatgatagcacattttttgctctggtaggaatttatatcaaatgaggaactttcaattttatcattttgaaaaacagaacattcggaatgtaagtcaaactaggatcatgatcatagtaacacttatttactatctcatatcttgcaacaacttagactcagattagcaagtgcagctcatttacctcaggttcctagataattgttggctacttatatttaacctttgagagagcacttaccatgaacccatatataagagatataaaacagagcaactattcatcatttcaacaaagagaactggcttgtcttatctagcatgactcaaacctgtcgtatccttttggtattttctactttgcaaatttttatattgttttcaagtttataagatgcaattggaaagcaaacatgcaattgaaaagggaaatatgcaatgtgatacaagttaccgcagtggggggagagacatctctccccccaagcttggctttcgctcagggtccttgacaaggattgaaccgttgaaagcggtagtacatttgaaggtcatcgtgctgttgctgcatcatgttgttgaagtttgcgaactgagcatcagcagattgttgccattcttgcgtttgtgctatgtgttccgtgaggttgtactggatctcccccgtctgcatataaagggtgtccattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatcatacatttcacaggagcaattttgatctttctaaccatggcaaacatgataatcaattcatcccccataatgggtctaagatcacctctaggaaacaaagtcatagcaatccatttgtgcctaagcctaagtgtaggattatggatatcattctttccaagtttcttgcaaattggagcaccagaaatatcttcccaaaacctatttttctcgaacccagaaattcctttctggagatcgattttacaggaatcgtgaaaaccaagagatgtgcttaagcctttccatgtgagtgtatactccttatggaaaaagcaaaaggaaatttcatcttctatttctttcaaagtgcatagaaattgcaaagaaagcaaacgagaaccaggctcatctaccacagcaaatctctgccaaccaacagctttccaaatagcacgaaattcaacatccatacttatctttttaagtagttccagtgagtattctcgcgtgtgagcatactcccggtcgctcagcatgtagtaggcttgtttctcccgatcactgacaaggtcgaggtcggtgttgttcaggagtcatcgcggagcttcggcgtcttccatcaagacatcggttgatgaacgagccctagactcatcatgacgacttgattaagagccggaccccttgaacagacgagacagtcgcctcctcattctgcacaatggagcaagagtggactaactcggcgggggttaggaatgacaaaaatttcacccgacggttagtttcaccaaagcaacttgtatatatgcaactaagtatttgaatttgagggaaactatcaaagcttgaatgaacttgagagcaaactttgaagaaggaatgaaaatgtgttgaaatggggtggaattccctctctcggccggctggcttttatagggtacccacaacggtcagaaatgacatgtgggtcccactagccgttaccctgccaaaagtggcaggtaaccgttgcctggccggttcggccgaacccctggtgggcccaatcggccccactttcggctgttggattccaacggtcagtgcggtcgtggcacagtgaattttcgttaaaaattttatgttggtttgcactgaacaattcatttgaaaaattttctcaaaattcaaagaatcctaaatgcagttttgaaatgcaaacatgtgttgatgcagaaattcaaattggtgaaaataaatatgcgcatacataccaatttaccggttggcgaaggtcacgtcatttaaagtccgacgtgcaagtctgtacctccttccgattcagtgcgtggattttccacccatctccgaaggtgatggagcgggcgtctttcgcttctccttccacaccttccttggctttgatgcggacggcggcttcctctgagccgactgctctagctttttggccgatagggttggttttaccggcttcctccaataacggttcctgggcatcgttgtttccttctccaggaaattctgcatgaacttcaccaggctgtccgtcttgggtagctccatttcgaccacttgaatgttctgtgggtttggcccgtacttgattctgaccatggagcattgttccgtccttggttgaaactcaaactttttctccttcccgttgatatgaaaacggatactccctgttcccacgtcaatgttggctcccgcggtgctaaaaaacggataccctaggatgagcggcgtctccttccccatgtccatgtataacaccacgaaatcaaccgggatgaagaaatctcgtatcttgactggcacgtcttccgctatccctgacgggtaacggactgacaagtcagctagttgtaggcacatcggtgttggtgccaacactgtgaagttgagcttgtcaaagacgtcctttggcatgacgctgacactggctccaagatcgcacaaggcctggtcgaactgctgtgccccgatcgaacaggtgatcataggagcttgtggagtatgacattgctgcagtgctccatcagcttgaccacctccgttgttgggagcggtctcttgttgttgagtatgtccttgagataacgggcatatgttggtacttgcatagcgtccaacaacagcatgttgatgtggatcttctggattacttcaacaaaacaagcgaattgctcgtccactgacagtttcctactccgttgaggaaacgacagcagccgtgtgtcgcagtactcctgcggcacggtcttttctggctgatcttccttgtcagccgagtcactagatggcgcttcttttgcaatcttgttaattcctacaggattaggatacggcggatcacaagtggacttaccttccctcgtcgtgatcgctttaacattttcaaggaaggagccgggttgcctcggaatcctcccagtttcattttcaaggactaaggatgctaactgagctagctgggtttctattatttcgttaaagctcagctgattttgaaaagcagaagcacaaccatctaacttgacatttatgttttctaggatcttgtcattggcagcaagctttttgcttagcgcatcagtggttttagcttttgcaaaaactagatccttcaaggagggctggttagaaaagttaccgttgttgttacctccttgataatatgggcgtggctggctccatccctgacctccttgtggacagtacccgttgtttttgttgcccatgtacatcgcctcctcacgggtttccaggcagtcattcccagaatgacccgtgttgccacagacctcacacgtaatgtgcgaatccaaggccttgatggtgccttgtggtcttttctcgtggtcgtccaatcgcttcatgaggaggtctagcttggcagcaagcagttccgtctccttgacggtgtgcatgcctcgctgacgggtctggattcgttcctcgctccaacccatattggagaccatcttctccatgaaccgttttagagaagaacactcctctagctgccgcgtctaggtgatcgcgggacgtgggcgtgagtccattgtaaaagttctgcaggattagcgagtcgtccatcccatgatgacgacaggcggccacatattcctgcagacgttcccatgcttcaggaatagactcgtaccttgtctgctggaaactggaaatccttccacgaagggcattggttttgcccatcgggaagaatttcgagaggaatgccatagaacatttgacccaggtattgacagtagcacggttggcatagaaccactgcttcgctctcccgagaagggagaacagaaacagtcttaacttgacggcgttgggactgacgcccttgatggtgtacgtgctacagatctctaggaactgttgcagatgagcattggcatcctcattaggcttgccatagaacgggctagcctgcgccatagtgatgaggctggacttcaagtcgaaatccacgactcccatgttgatttgcggcccaatggccacattgtcagcagagggagcagcgaattcacagagagtcttgttagccatagtcttgaaggtcggtggcgctggtatggctagtttctctgacggtagagttttctatggagcagcgactcgcggcctaacgctccggaagaaagctactggatttttctttgaagttttccggcaagttgaaaccagttatgcactaccctgttttcacaacaaaagttaaaacaaccaaggttagactgcaaaggaaaatgattatacagaggtaaatataaaatattagttcaggtaatctctactatgaatcttccctggcaacggcgccagaaatgtccattggtatttcttaacgacattactagaaatataattcccagcagtggcgcagaaatactcctggtatattatggttacagagttcatccgcaagcgcacggatataccattctaacatttcacccgagagtattccaagggtatcgtatttattttatcccgtgggaagatcatgtagagataacttgactaataatttatatattacttgtgataatcatattctaagcaggggttaagataatccaagggtagagtgacacacaagcactaactactcattctcatgatatattatctaagctaagtggaaagaaaagaagaagaaaatctattcctatacttctaatatacatagtatacatacattctaattaaccgacatacaagctaataacctctatccgatgccctcctattacttcaggaagccacccatgactactgagttccttacgacagcccgtcatgaccatacaaccggggctaaatacggaggaataccctccccaggaaattaacttaggattatatacaggcgcggaggaatacctgtactgagctgtcaccttcagcggcccacctctcatccgcagcatataaccccaaataatgatatcccgtaatctagacaccacgtctaaactaccagatactactctaatatcatcgtcatgacatagagtaattgcataagca

SEQ ID NO: 64871 - DNA, 19292 bp, Oryza sativa
agttggttgcaaaaggggttattgctgacagcggcgacatggaggaacaaatggggggcgacattggcgacggcgaggcaagggcgacggtgagcttcctgatctagaatcctatctcattcttgtccatcctcccgctattctccttcttcccgaatctggctgaggccaagtccggcgatgagcagtgcagtagcaacaaacccatgccttttcgttttgggggagaaatgagaaagggacaggatggtgaccactgaccccttcgcacctcttgcacgcgcgggtgcaacgcgtgcacgcgcgggtgcagtgttgctgcacgcgttgggccaggacaagcagcgaagctcgattcggccattcctgctcagcctggctgagggggctcttttgcatctgctcggcctggctctagcacatctgcaggcaaccaaacaggctgcaagttgcatccggagatacgaaccaggctgatacagccaaccaaacacgcccttagtgcataaacctcggattatcctatccagatatcttcccatacttcttcccctattccattgatcaatcatgccttttggttcacctgaaaatcatgaaattttcaaagttataggaaataatcaacattttttatgcaaatgtataaaccatattcactacaacaaagtgccaataccaatacatgcattctccagatttgataattgagttgatgctttgtggaccactgcagttctatccataccaatgcgatacaacacttgttctagaagagtatccattaagggtggtcccatgcatatttaataatatttttttgttattaaaattgcttatctgataatacatgatagtatctactcatgttcagacacaatggcccaatacacgcatgcaatctatgatatttaaaaatatatatagttatatcatccagtctacagaacagtcaagattattggaattatagttactactggtgaacttacatttcaatataattatataaaatattgctaccagaatacaaattatgccttcttctacactgatatatttattaagaccagtgagtcctcctatacaggcttccaggctatattcaactcatctaactatgggttgccttctagcttattttgatatattagttgtgtttaaactttaataaaaaaatatttatttagatgcaaaagcaagggtaacttggtaaaataatacgatgttcagatgtaaatgttgtcaataaagcaagtgttggcggttattaaaatgccgattctataccaccaacatcttcataaagtccagataataaaacatccaacatagtgatagttgttaaatctcacatactccacgagtattggtgtatatttgtatgaagatgataaacccagaagttgggaggaaaatcagactaaagtgaagaaggaaatatatccatacaaggatgggctttgaactttatcaaaatactggagaatcagcccaaaactccgagaaatggatgaagtaggactaggggaggagacgggccaaaggccaagctagcagggccagtccaggtttggccgaaccctgaccaccaccgttgatactgggatttggtagggacggtccagatgcactcctgatggcagttgcatggcatttcggacaattccccttgtcataaccgttgtacctgtcctataaatagacttcactttcttcacttttacacacacacttcaaagcttgagctgaattataagaggctctattgtactccctccatttcacaatgtaagactttctagtattgcccacattcatatagatgctaatgaatctagacattattatatatatggattcattagcatcgatatgaatatagacaatgctagaaattaaagtcctacattgtgaaacggaggaagtactatttgtatactagaattaggacgagaatagagtagaagaagtcagaggaattccggagttgtcggtaatcttgtctcatttcttttatcttcccgagtaatttagatttatcttgtgagaattatctattggctagttcctaactagcatacgagattattgttcactataatcaactaaaatatagtgattgctttggtgagttataaacactaaaatagatattaattgcttagacgtggtgtttaggtaattgttatccattaattgctgtgtatcccacggtacgtttgaggtaggtgtagaggtggtgacagtcctcgagatcagttaagtcctccctatccgggtatgtagtagagcgacatctgggaacagcgggttgccagtgcctgaagtattgcgttaggattaaacttaagcttgccctagacacagtttctcactagtaaatcctctctgtcctagcctatcctttgcttggtgcccttggatgaaccgaagggagatctgatcacacacgttcccttcgattcgatacccttggaatactccgtaggggaagtgctacatcggtatatccgtgcgcttgcggatcttatctttgaccgtaagaataaccaacgcatttctggcgccgttgccggggaacggttgttgataatttccgaacctagttcatccgtctatctcttttcattttttattctaccttcacccctgctgccaagagaagtattccttttaaattcttctcgaccatggagcaacctctctttgagctgtctgctcctaagggcgaattctatgagccacctccttcatcggagccaatttatacaactggctatgaaattcgccccaaactaattagtatggttaggaagaatccttcttctggtcttgatctagaaaacccctaccatcatctgcgggactttgagcaagtctactcatgacttaacattcgtggcatgaagcaagaaactgtacgatggaaattgtttccgttctcccttcaagagagagcgaagcaatggtacacatctaccgtaggatgtgtaaacggtagttgggaaaagccgcgagacaaattctgtcttgccttcttcctagttactcgtattactgcccttcaagtataaatcctcagtttccagcagatcaataacgaatcaatcgttgcagcttggtccagattcactaatttagtgcattcaggacaaaccttgtccttacccgagtatgtgcatctgcaacattttcatacgggtctggataaggagtctgcattctatctggacataaccgccggaggatcattcgtgcaaaaaacaacgtcagaaggaaaagtaattctagaccgcattctagaaaataattacttcatgatgcaatgcgatgaaccccagctggaggcatctgtatccaagataaaggagccttcaaccatcgagtcacaatctgaaacatccacttcgaccaactcgattgatgaaaaagttaccgaggcaccataagttgagaatgaagaaattcagactctggatcgtgccacaattctgttcagggatggttttgacgaagactacgccaacaccctgaactatttcagtaaaaagaaaccaatcgtccccttgccacctcgcgatcctatggaactttggttcctaagggaaaccgtttgggagctgacatccataattgtaacgccccgattttcgtttgggattaaaaatcatttcataatgcatttcctagaaattaaataaaaatttaagctatttattcaagtgaattaatgggagaattaaaattctcccttaaaaatcattgtccgagaatattttgtaatattctctgtgccctaaaatactctccggatttttccgtgaattttcggagctcaagaaataattttaaagtcacaaagttcattaaactaatttaaataaaaagaaaacaaattaaaatcatccttcctctctttgggcccctttcggcccaatccctcctttcccttcctcgccccgcttgcccctctccccttcccctccttccccctcccgggccgtcggcccagctcgctcccgttttcccctccctctctctctccgacaggtgggacccgaggccccacctgtcatccccttcctccggctccaaccggcggcatggccgcccgagccaccccacgatgccgctgtttccgcccttctcctccaccccacgcgcgtgcccgccggccgtgggaccccgccgccccacgtcctccttatcccccacctttcccctccaaaaccgccgcccacaccccacgctgccggcggttgccgtccacgctgccggcagttgccgccctgactccgcctctcccgggctcggtccgacctctcctcccctataaaaacactccccgcccttccttctctcatttcccccaactcccgagcttccccgcgcccgaaatcgcgctcacgacgcaagtccgagctccgccgctcatcgccgtgctccggccgccccttgcggccagtcctggccacctcacgccgcgcctctgcatccactgcgttcgccgcaccgcgtggaacctcggccgccactcctttttcccccttccaccccgaaacaccgttcccaccgtgcacccgagccgccaccaccttaaaccgcctcaagccgctcactgccgtcgcctcagccatcgccgcactgcgccgccgccaccaatagcttcgctgcgtcatgccgcacccggtccaccgctccccttccctaatccattgccgaaacgccgccgctacattcaccatctctctccgccaccgtcgccaactccaaccgcttcccgtcggcgagcaccgctttgcccgggtgcgccactgcctcctccacattcgccgcgccccaccgcacctcggccgccgcttttcatgccgttatcccaccggaacacggtattcacgccgctgggagcctcctcaccccctcctaacctctacctcatcctccccaggtccttccggccgccgtcagccggttcgcgctcgcggaacgccgccgggccgccgttccacctttgtcccgaggagcgccgctgctgagctcctctcgtcgccgcgtccttggtgagcaccgctctcccttctgccgtttcccgcgccgccgctcgccgtcaatggccgctggccgtgcgccgccgcctctcagccgtccagctgtgagccgccgctgcccctttggcagtgcaccaccaccgtggactcagtccatggtggaccaactcctttgacccgctgatgagtaggccccacgctttgtggacgtggtccgcacccctcctcttgctgacgtcagcaaccccttttcctttggaaaaataattaataattgcgtcataaatagtatttaattatagaaattcatttaaatggctcaaaacttctaaaattcatatctaattcatatgaactccaaattgggccattcaacttgcaaaattcatctaaaattgagctttacatgtttgtttacttttgatgcactgtttgcttggtctttattagagtttttccttgttttgcgtgccagcgtgtagaatccgtcgtttcggaagtccgcggtcgcgaggaaaagagttcggaagattgtttgaagaagcaaggcaagtcacacattcccgttgagcattttgatcctactttacaagtttttaccgtttgcaaataaatatgcatcgtttgctaattacatgggaatagagtttccctatctgctcgcttgtgccatgtttacttcatatttgttctttgtcaaccgtgggtgaaaattcgactagcttgtgtcacttgtgttgatctagctagaactatatgcttagccatgcttaattaccactatctcagttgatgggataattgcagtattagaccttttagtatcattacaagctgcgtgctcgagacacccgaacatgtttcattggtcgtaattatccaactaaaatgcgactgaatggtgggctgtgggtgcatggttttgcgagtcgtacccatggcaattaaggtccggttcacgggaaaccatagaaccggtggcgagagtgggcgtgatggagttgggtcggccggggtgtccggttgtccagctgctggattcaccacggtgcacgaggggactgcctgctgccttgcgaggagtgggggtgaaaccttagcgtggtgtggatggttaggggagagttatatgaagggtcttgtcacaatcactcgacgtggtgacgtgttcatcatgggtgcatgatgacgcggtgacatgccggtgaattgtgtcttgtgggtacggttgtgcacctctggccagagtaaaactatttgaatagccgtgcccacggttatgggcgatcgaccagatttaccgtgattactctcacacttaataaatcgactcaatgcactgtagttcaggtgggttggctgggcctgttcaacatggtgtagtgttgatcagtggagatttaatattaccttaattactcaactgttttactgttttgctcaataaaatgttttacaactgcctttaagcaaatagccacaagccattcttgtatccccttgcacgtctgcatcgttggtgtggcttgctgagtacggtggttgtactcagccttgctatttcccccttttcagaagtgttgtgcttctgagctgaagacggagttagaggaccaaggctcagacctcagttgagttttgcctgtggagtggagctgaagccccgctaggatcgccttttgccgctgctgctgctttcatttcggtgtgaggactaagtgcctcttctgtaagtattttatgctttatttacgtttggaactgtttattacttatcgttttgtgtaccctggttggtcctggacagggatttaatacacaaaatagtctagacatttgggctaaatttttgggcgtgacaataatgagtgacgaatgatcaaggtaagcagagatttcatccgaagtaattctaataaataccgctccccgagttattccttgtcacctagaagggaacaacgttggtattctatacagtccaactgtcggggttaatctcgtctcggagtcatttgcattcgcttacctgggcaataaagctataaccctagcaaacaaattcttcaagcacccgaatggaactatcattgaaggatttgggattgtgcaagacgtacctgtctgctttgaaatccaagattttgacattctaattgggcctccaattgagcaactcctcataaatacacctcgattggacagcctcaagataactttgggagggaacgaattctcagttccattctcacgggcaaggatcaccttgaccgacactctcccagagaacgagtttgcagaggaggttatggcagttccccctcacgagtctcccgagacccttctggaaaatgaagtccccaacttcatcaaacaagaaccggagcccggtgagactgacgaacttccaatcatggaactgccgcctcgacctccacttgagcttaaacctctacctgaaggcctatgctatgctttcttgcacaatgacaaagaagcccctatcatcataagttacaagctttctgaagaggagactcaacgtcttctgtctgtgttagaaaagcatcgcgctgttcttggctattccctctagggtctcagagggattaatcccgcactttgcactcatcgtatccctattaagcccgagagcactccctccaaggaacctcaacgacggctcaataatgcgatgcgtgaagtcataaagaaagaggttctgaaactcctgcatgctgcgattatttatcccgtttcatatagtgagtgggttagcccggtccaggttgtgccgaaaaagggaggaatgacggtcgttgcaaatgctcgaaatgaacttatcccgcaacgaacagtaaccggatggaggatgtgcatagattgcaggaagcttaacaaggcagaaaaaaaagatcattttccgctacccttcattgacgaaatgttggaacggctagcgaatcattctttttctctgtttcctggatgggtattccgggtatcgtcaaattcccatccatccggaggaccagaccaagactacgttcacatgtccgtacgacacctatgcttatcgtaggatgtccttcggactgcgcaatgctcccgcatcttttcaaagatgtatgatgtccattttttcaaacataatcgaggacattatggaagtattcatggacgacttttccgtctatggaaagaccttcggtcattgtctactaaatttggacaaagtctttcaacgatgccaagaaaaagacctggtactcaattgggaaaaatgccattttatggtccgcgaagggattgttcttggtcatcgagtgtctgagcgaggaatcgaggttgatcgtgcaaaaattgatgtgattgatcaacttcctcctcctgtgaacatcaaggggatccacagcttcttgggacacgctggcttttatagaaggttcatcaaggacttctctacaatcgcccgacctttgaccaacctgcttgccaaggacgctccctttgggttcgacgatgcgtgcctaaaatcctttgaaattctcaaaaaggcactcgtctctgctccaatcatccaaccccctgattggacactacccttcgagattatgtgtgatgcaagcgactttgctgtcggcgcggtcttgggccaaaccaaggattaaaagcatcatgcaatctgttgtgctagcaaaactctacccggagcttagttgaattatgcaactgctgaaaaagagctgctcgcggttatttttgctatcgataagtttagatcttacttggtgggagcaaaggtgataatctacactgatcatgttactctgaaatacctgctcactaagaaagatgctaaagcacgtcccttgagatggattttgctgctccaagaatttaacttagaaattaaggataaaaagggagtagaaaattccgtagcagatcatttgtctaggctgcagattactggcacacaggaacaaccaataaatgatttctcgagagatgacatgctgatgacggtgcgcgactccatcccgtggtatgccaacatagtgaactacatggtatcaaagtacataccaccgggagaaaatcaaaggaagctgaaatatgtgagccgccatcatatatgggatgagccatacctatacggggtctgctctgatggactgttaagaagatgtgtgccaactgaagagggacttaagatcatagaatgatgccatgcctcgccttatggtggacattatggtgcattccacacccaggcaaagatttagcaatgtgatttcttctagctgacgatgtacaaagattcaaaggaactcgtcagaagatgcccaagctgccagaggcaaggaggaatcactgctcgcgatgcaatgcccctcacatacaacctacaagtcgagatatttgatgtttggggtattgactttatgggaccctttcccaagtcccgtaattgcgagtatattgtggtgatagtcgactatgtctccaagtgagttgaggctatgtcgtgcagcgccgcagatgcgaagcatgccaagaagatgttcacataaatcatcttcccaagatttggtaccccaaggatggtcataagtgacggaggttcgcactttatcgacaaaaccattcgagacctcctgggagacatcgcagccaaacacaacgtggccacaccttaccatccacagatcagcggtcaagcagaaacatcgaaccaacaaatcaagaacattctgtaaaagacggtcaacaaaatgggaacaggatggaaggagaaattgccagacgcactgtgggcataccagacagcatacaagacacccattggaatgtccccctatcagatcgtctaccggaagtcatgctgactccccgtagagcttgagcgtagagcatactgggccatcaggaattggaacatggattttgagggagtaggagaatggagaaaaatgcagttagcagaactagaagagtggagagaaaaagcatatcacaactccaagatctagaaagaaaggatgaagcgctgccatgatgaaaggataaaaattaagaaattcaagccaggaggcaaggtactgatgttcaactccagggttaagctgttcggccatggaaaatgacgaagcaaatgggaaggaccgttcaatgtcatcaacactgcttcgcacggagcaatcacacttcgtgatgactcaggtaacatatttatggtaaacggtcaacgtttaaagactttccttgagccgaatgaaactttagatgaagaagtggttattattgaattaattgattatgattgatttcctgtatgaaactttaaagactttctcatctaaagcatgcttaatttcctgtatagttgtcatttttgtgcttagcttaggattgtgtggggccagaagaaaattggtggccagccggactcgtctggttctgccaaaccagggtggcgcccgtttggtcccattttcgacaggttgtttccaacgcgcacttgtagtctattgtgaggcgcattcggaggtacatcgactgtatcaaagctcagaacaccttcttcctcctttcctccacctttgcaaattcccttctccaccctagctcaattccttgagttccactctcaactcactaatggctggcaaatctttgatgccctatattggctcttcttccaattccacttataacctcaacggagagcccactccggccaacaactcatccccatcgaagattacaccatggaaggattgaatgctgtctggacacaacccctcgcgatagtgctgggctcccctgcaaatttgtagcccattggcgagcttcctgcaaatttgtagcccattggcgggcttcctgtgggcataccggcagcttcttcgtgagggggattgtttgtgccatctgggcccgtcgggtcaggcttattgaacatcggttctgtgcccgagggagctttcttgttcatcatctttttctttgcgcgttcttcaaatggaacaatttgaaactcattttataattgatatttcatacaaatccactaaaccaacgtaacgccacattaacttcgtattctgtgatggtttgctagacctctatctcgtacctacgtttgcctcgtggacagacacatccacgttcaacaaggctagagctgatgaggtctcgacctcaacgttaatatcccacgcgaacgggctatcgttgtcgctatctgaagatacttaaaatgatagccagttcgagtgggatactgatggtgaggccgggacctcatctgccccggcctagaggaacgtggatgctacacatctgtcgatgaggccgacgcaggtagaagacacgggcaaccaaacccccaaggtatcttatttgattatagacaattgcactgaacccctaacgataacaatattttagacatatctgatctgaacgaaatgttctagtttccaatgtgtaattaccgcctcctaaaatgcacctacttgtattcaccgaattagcctaatttaataaattgcatcaataataaaatttcatcacaaattgcatctcactaattaaatcctattcaaccacatgtgtaactcagatcccctaacatcacaattccatctcatatactgtaaattaacaaagtccaattaattacatcataaatactctaaaatgtagcactcacaattccatcacaaattccctaatttaacaaagtccatttatttactctaaaagcacatccttaatatcatcatcatcttaacattacaaattaacattcaaaatcgcatctcgcacaaataacacatatatcacacattgcatatttcacatattacatattgaataattttaaaaagccaaaaaaggcttaccggcggccggcggcttggggataaggtggctggcggcttggggaggaggtgaccggccgctgcttgaggccgatgtggccggccgttgcttgggggcgaggtggccgacagcaggttggggatgaggtcggtggcggcttgggggagttggtcggtgccagcttgggggagtaggctgtcgtgctcagtgaaaaggccggtggggtcgtggaggtcggcggcgcgggggacgtggtcggtggcagttcagggagtagatccgcggtagagaagacggcggcagaggcggcgagggggatggaggagagggaggcggcagcggcgagagggagagagaagagggaggtggctgacggtggcggggaggggggtgaggaggcgcacggcggcggtggaggaggtcgacgagtggaggaggtggcagtggatgccggggaggaggcggaggagaggacaaaggccggggagggggaggaggccgagagttggcggcgggatggatctggccggcgtcgagcaggtggcagccgggaacaaggaggagagtaggcagcggcagcgtgggcgagaggaggcgacgagggggtgaggagaggaggtggcagcagcaatggatttgggcagcctggtggcatggctccgaaaaatttcaccaggacttaaaaattttcggagcccgcccaagcatatgtagggcgaggaggggatttttccgtgtgcgcgacatagccaacccacacggaaagatattttcccatgcgggccatttatcccacccgcacgggataatatgttgccctaaaaagtaattatttaaaaaattattcaatcatacttttataataaaaaatcacaacttaatcacacttgattttaaattgttccaccatatgattaattaaagaattagttaaaaaattgttcaaccatatgggtaattagtttactaaatatatttatagttaattaaagcacaacttaatcacacttgattttaaatcgcatctaactaaatataatcacaaataattaaccacatatgatttttaatcgcatataattcaatcgcttgcatattgattaaaccaaaacttgaaaaatcaatataattattcacccatataaattgagaccgacatatattagggataaacatgcatggaaccgcgcattcattcggaaagaccataagtttgttccattaatcgtttacaaaataagttgtacacaccaacatatgtactaatgtttaacaattttggaaacatcatccgtccgcacagtcgagaacttctcttcgtcaagggttgtctcaactcgcttgatccggttaggaagatctatgaacaatgggacatcgtcgtattggttgtaatctgacgtgtcttcaatgttatcaatgccaatgatgtgttgctttcccggtacagcaatgaccatcttatcatcagatgggtccttcacatagaaaacctatgcaacacgctcagcaagaacccatggatcatccttgtgtcctagcttgctacgttctacaaccgtaaggctgtagttatcgatggatacgcctgttgtgtctcttacccattggcatcgtagcaccggggtctagatgttaaggccatagtcaggctcctaatgtcttttatgatcccatagtaagacttcttctagcctgatgcgtcaaacgcctccacccgaactccgctattctgagctacgcttttcttgtccttacatatcgtgtaaaacctatatccgccaatatcataccattgccatgaggtcacaaggctagttgggccatttgctagcatgtgcaatgttttttcctcgagcaattcaccgaacgacagctctttctccttcaaccatttaggaaatttacatttctattccttagagatccaagtggccgtccttctagggttgcaggctcttatctcgttcatgtcttcctcaatgtacggctcgacgatggtgagctattgcaacacgctgctatgtgcttccactacagcattgtagtcctcatcatagaaccttttcttgcctacaaacctcgtcccagctaaccgaccgtcatgtacaggggggttataccaatgggttcagcgtccttcatgtagtatatgcagcattcaaccacctcctcagttgtgtaccccaccatcttttttcctaccctcttgttgccatctcatcaactcggcatctgtacggttcgaaaatagccacttcaggcaatctttcacaggcgggtaccacatcaccattctaggaatctttttttttcatccaccgatgcatcttggtcgaccacctctccatcggaggctccgttgcccgtcttgtaccgactcgtctcacatgttgggcaagagtctaaatccgcgtattccttgttgtacagtatgcaatgattttcacatgcatggatcttctgaacacctagagataatggacatatcaatttcttcgcttgatatgtgttccttggcaggaggttcggcttaggaagcataactctcagaagatccatcaaatcattgaagctagtgtccgaccattcatgtatggccttcaatctgagaagttgtcacgcccagaaatttagcccaaatttccagattattttgtgtattaaatccctgtccaggaccagccagggtacacaaaacgacaagtaatatacagttccaaacataaataaagcgtaaaatacttacagaagaggctcttagtcctcgcaccaaaaagaaacgacagcagcggaaaaaggcgatcctagcggggctacagctccactccacaggcaacactcaactggggtctgagccttggtcttctaacttcgtcttgagctcagaagcactacacttctgaaaagggggaaataatagcaaggcttagtacaaccaccatactcggcaagccacaccaacgatgcaggcgtgcatggggattcaagaatggcttgaagctatttgcataaaggcagttgtaaaacattttattgagcacaatagtaaaacacttgagtaattaaaataacattaaatctccactgatcaacgctacaccatgttgaacaggcccaaccaacacacctgaactacagtgcattgggtcgatttattaagtgtgaaactaatcacggtgaatctggtcgatcgcccataaccgcgggcacgactattctgccagaggtgcacaactgtacccacaagacaatccaccggcatgtcaccgtgcccggccggacacgtcaccatgtcaagtgattgtgacaagacccttcatctaaccccctctaaccaagcataccacacctcaggtttcatccccgcccccaacaggcagcgggcagtcccctctcgtgcctaggcgaatcagaaagccgcataggccgtcgcagggcccatccgaactccatcacgctcacccttgcctggatgcgtcagccagagaaaagctatacttcaagtcatgcaattacccattcccgcttgtggcaagcgttgtatgtcttctagtgcatcccgcgaaccggtccttaattgccatgggtgcgactagcaaaaccatgcacccacagcccaccattcagtcgtattttagttagataattacaaccatgaaacatggccagatgtctcgagcacgcagctcatcatgatactaaaaggtctaatactgcaattatcccatcaactaagctagtggtaattaagcatggctcagcatatagttctagctaggtcacataagtaacataagctagtcgatttattacccaatgttgacaaaggacagatatcaagtaaacatggcacaagcgagcagataggtaatccctgatcccatgtaattagcaaaacatgcatatttatttgcaaacggtaaaacatttataaattgggatcaacatgctcaaaggggaatgcgtgacttgccttgctccttcaaacaatattctgaactcttttcctcgcgaccgcggacttccgacacgacggaaactacacgctggcacgcaaaacgaggaaaaactctaataaaaaccaaggaaacagtacataaaaagtaaacaaatatgtagagctcaactttagatgaattttgcaagttgaatggcccaattcggagttcgaatgaattagatatgaattttagaagttttgagccatttaaatgaatttctagaattattatcgaattattgcgcaattattaattgttttttcaagggaaaaagcactgctgacgacattaaaggggaagtgcgcgccgacagtggaccgggaccaccgaggcggtccactggtcagcgacacaagggcgccggtccacgggaaccgacggcccagatcggtccaaagacgatcgggcggccacgaggcggcgtggttggggcacagcacggctcaggccggcctagccgagcgacggtgcgctgcagcgtggccaccgacggcgacggccgccgacggcgcgggaagcggcgacgcacacaggcggcggcggcgcacatgcccagcgaagaggagggaggaggggctcaccgagcgtgcgggctgacgaggcggagcgggaggtggccggtgacggggagaggcggcggcgctagtcggggaggcaacggcgacggcggtctggcggcgttccgcgagcgggaaccggcagacggcggctgcaaggacatggggaatgcaatagtatggttaggaggatgggagaatgcatgagacaacgggaaacaccggccgaaggcgaaggaattaggagagctcaccgacgcgcgaggggagtggagccgaggacctcctcatccttgtggagccgagggaggcaacggcgcgggtcggcgtcgaccgaggtggcggcgcgacgcggctggagtcggcggcgacggcatatggtggaggtggcttgggatgcacggtggaagggtggttgcggtgatgaaatggggaaacggagcggaggccggggtgcggcgaggcacggcgaagccggcagtgcaagcggcgcgacgcagcggtggctagggtggcagctagaggcggccggaggaggcaaaagcagcggcggctcgggctgcacgtggacacggcatcacggcggtggttaggggaaataaagtggatgccggggtggagcttgggacggcgaggctagaggtggtggcggcgcagcgcggcgtcgtctggagcggcgatggcgtgcggctggaagcaaggcggcgagcggtggagctcgggctcgcgcggagagagcaggagaaggcgcgatgggctcgggaaagagggcgaaacggaagaggagagcatggggagggtttatataggctcgggagggtgaaatcgttgccgagaggggtgggatcgggcggcaaccggccagcgacgtgggacgccgacatgggcaaagtggagctcaatttgactccaaaaattgggggaaaagtgggggaaaatgtggaggagttggtggggaaccggtttcactcggtttgggtgcgagggcgcgagcgggagggcgccggatttggcgggacgtgggcggcaaccgccggccatggcggcttcggcctgggaagctgaaggtaggaggagggcctgacaggtggggtcgccgggcccacctgtcggggagggagagagggaggagaacccagggggttatttagactttgcgcgaggggaaggaagatgggtcgacagcccaaggaggaaggaaggaataggggaggggacgggccgaggggagggaaggagggctttgggccggaagtggcccaaagtgaaggaggcgagatttaattgtttttctttttattaaattggttaaatgaactttgtgctatttaaattatttcttgagctccgaaaattcgcgggaaatttcagagagtattttagggcacaaagaatattacaaaatattctcggccaatgatttttttaaaggaaattttaattctctcattatttcacttgattaaattgctttaacatttatttaatttctagaaaatgcattatttaatgatttttaatcccgaacgaaaatcggggccttacagaagttcaagcacagagcgcaacaccatatagttcttgtcgcatcctttcgcttcgtcgtgaagaagttccttcactattttttccagcgcttcctaattgtccaaccctcgtcttctaccagttaggacctctggttcaacatgacgcaacatatgttccagatcaaaatcaatatttgtatcgtctataccagagccaccacattccaggatcgttccctgtgatatgtcttcgattataaattttctgcatcatcaaagcaggaatcttcagcctctttgttatgaccggcgacttccccatgaagagtccatatcttgtaacccttcttaaatcctcgctctacgatgtgcgacaatacatctttcggtatttgcagcaacatttcgttcttgcaatctttgcatgggcctcacagcatgtgcctttgccagcttaacaaatttggctgcttccttcaagaacgtcggatgagctctttttgtgttgtacatccatgcccgatccatgacctagaatatatcttgtcatgaatacatctgtgcccgattcaaaaacgagtgtatttaaatggagggaattaagcaaatagtaaattaaagttttacggacaatttaaacaagcgtacacgatttttaatcattaataaaatattgtccatttctaaacaatgaaaaaattcatccttttatccgaaggaaaataaatttaatggaggcaaacccaacttttcaatttgggtactaaatacttttaagaacatgtaatggaaacattatatattagctaaaaaataaaaaaacacaaaatgcatacactgttccatttaaaaagtggaaatttctacgcattgcaccgatgaaaactgacaaaaatggaagcaaatgaaggaggagaacaagctctacaccttttatacagaacccaatcaaaaattcgagatccttccccctaatttgtgtatgtttaggagagagaaaacgccggaaaaaatgggattgtgtcgggttgagggctatatagcccaacgaccatcgcatgcggtcggcttatgttgcccgcacaggataatgcattatccagtgcggccgacagcccgacgccgatccacggattttactaggcagagccagttcgcctggaaactaccggggccagtgtccaggaaaatcaattctgtagtagaggtagatatattcttgggtttttttttttttgtcaagttcttgtcgaatcc

SEQ ID NO: 64872 - DNA, 6303 bp, Oryza sativa
  unsure (1)..(6303): unsure at all n locations
tttatacaccaacagtattgtacgaactctcatgtattattatacagttgagtgaacacttatatgcctaaattttatccttttcatatatgtgcatgtatggcatcctagttagcatctatctccccaggattagccatagcttatcatgcatgttgggcttttgtttgcatatggtgcacaagttcatgcaatggaaatctagagactacaacagatgtgggctttctggatggatgccctatgacaaacatgaaatatgccattgatctataatgaattcataaaaaaaatcatcgtaaaattcaccctcggccaattctaatgataactggatatcttgggcataagatatgttcactgtgacaaacatgatcgtcataaccgcaaggattttatcgttagcagttggtaatgaagaatttatgaagaattctaaaatttatgtcacaggtaatcacgcggtaatgaagaacttatgtcgcagataaaaagggcattgtgatgttggcctaagtgtttagactagtgagatttggggcgttacatatatgtcgtggatcctgatcggtacattataatgttggatgataatgcggctgataaatttatttaatacaacaatttctctaaggatattattacagcatagttttcatgggcttgtttcgatctttttttaaaaaacaaattaccatttgttggtaagacgaaatttggcaattctaaaattttggtaagatcaagatatgaaggatgtgtttagtttgatactagttttatgagtacgagtttctgtaattaccaaatgttgggggggatttgaaatgttgtgatggtgacgtctcgtttagtatattgccttactaaatattggcaatgtgaaaatttgatatggttgaatttagcaacaaactgaacaagccatatattaaaatatttggcaagatgctatgcatggctgcctacatgattaatattgaaggggtccagcaccacaataatgcgtctatgtatattaatgcaaaaataaatatttaacaaataactaaaattaaccatggaaatatatatatttttctcgctcttatctaaattgctaaatattttatttgcatatcaataccaatttttagctataaaaggatcaaatttctctctttttcctctcctaagtaaatgttggaattaaaagttaagccaatctatgtctttttttcctcccctattatttataaaaacatcatatttatactagtaagggatgagtgcacacattcaacaaggatgccctatacaaatgtgatccaaattgtgctctaagttacaaaaacgaagatagctagaaaaccatggctacatagatccttcacatcgaaccatagctagaaaactacataaccaaggtagcaaagtatagatgtaattttggaaaccaaaagccaccaaaagtttcaagttcaaaacattactagtatattttgcttattttagaatagagaatgttcaagcgaaatgaacagctatcagggaaagaagaagaatttatgggtctattttagtaggtgatcagcttaagacgccgcatgcggtatctgatcttcttaggtggtcggtttaaggtgacacctatcgtaatgtatcttcataggcggcaccttaagtaggccacctatggtaatttatcttcagaggtgtctccttagacatatcttggcagttggcctgctataggatcccccgtccacaactacatagacatgcgtttgttgctggcctgccttagaaaaatagatctcgcggtcaaaaattattttcctattagaggttataactttatgagatccaaacacgtatnnnatctcagtgtatcaaagtcatgccatcagtatatataatatgcaagcaggatcctacgtataaaaatttccagagttcaggctatgattcaatgccatgtgtgtatcgggttgtgtcaggtgaatgggacatttcgatgtcggcctaaatgtttaggctagcaagatatctaggagttgatcatgattttggtacattgtgatgttggacagggatgtggtgataaatttaatacagctatttcttaagacaattattggagacaatatatctttatgttaaaaaaaatggtaggatgcatggcagcctagctagatgattaatagtgaaggggtccagcaccacaataatgcgtctctacatattaatgcaaaaatatgtacactactaagggattagtgcacaccttttaacaaggattacctaaacaaatattatccaaattgtgctctaagtagcaaaaatgaaaattttttatatgtgtacatacatatgtaacatattttttacggtaaatacatatgtagcatacatagatccatcaaatccaaagcataaaaatgctagaaaactacaaaagcagggtaggaaagtatggatattatctttgacgtcaaaagacactacatattcgagttcaaaaagttcctcctatatattgcttattttataagagagaaagctcaagctaaatgagcagctctcgaggaaagaaaaaggcatcatagatcctttttagcatgcagccagccaccataagccgccgcctacagtaactgatcttcaaaggtgactggtttaaggtgatgcctgcggtaatgtatcttcgtagggagcacctcaattaatccacctacggtaatttatctttagaggcgaaacttcaaatgtatcttcccaggtggcccttgtccacaactacgtagacgggcgtttgcggccgaaaatttgaccagtcatgctgagtaaaatagctcacctagtcgaaaatcatttttctatcggtggttgttactcctcggagatccaaacatgcataaaagtctgtgtctgaaagtcatgtcatcacgtatatatcacgtatacatatatatatgacatgcaagcagaacacggggtatacaatttagtgttgtgatcaaacatatacgaggcactagctagttagatcataaggacgacagaatgtttgcccctactagaatatatgatctcgcctcatcttttatttgcaccatgatactgccggtatagagcatgatctatttttgaaaaaccatgtattcctgtctttctgaacatcccaactgatcaacatgatcgccaatgttaagtccttctgacattctatctcagctaattgagtcatcactatccaccatttgaaaaacatagtgtgtgtatgctaattacctgtttcaggcgttgttagactatacaattgtttttccatactatatatatacactacggttgacaaagacatcccaacaactaaagataaatgacaaagtttttttccacaatcattactctctgtatatggcatcccaacaattgaagataaatgacaaaccaataaaccatttgtttttttccaccaatcattactctctgtatatatatagccttagtccgtatggagcacttgataagcttgtatgctaaatctccttcctcttccaacatgactcttgccaacattcctgagataatggaatctcttcccgtagagacgaggttcacagagtttcccttgcgacaatatggtggattttggttattggaggtcatgctcaatggcgttgctgcagctgaaactagctttcaaccgagaccatccgacatcctcctttcaagctttcctaagtgtggtaccacctggctcaaagccctcgcctttgcaaccctgaaccgttcgacttacccaccatcggatgaacatcacccgctcctcgaacacaacccccatgaccttgttgggtttcttgagatttaccccaagctcgagttgtacgagtcactcccatctccacggctgctctcaacccacctgccatattcgatgctgcctcatcgcatcagggaacaagaaacggggtgtcggctagtctacatctaccgggacccaaaggatgccatggtctccatgtggcaccagaacaagaaggagaagaagaataggttgacgttcgaggagatgttcgacatgttctgtgaaggacggtgtgttgtcggcccgcagtggtgccatgccggtgagtactgggatgagagccaggcgagacctgagaaggtgcttttcctcatgtatgaggatcttctgcaagatactgtgggcaacctaaggacgctggcggagttcatgggctgtgggttctctcgccaggaagaagatgacggtatcgtgcaacaaattgtagaactgtgcagcttgaacaacctgaagaacttgaacgtgaacaagagtggaactacccttctagggatctccaaagatggcttcttcaggaagggaggaaccggtgactggagcaatcacatgtcaccagagatggcagcgaggctggacaagatcgttaaggagaggctggagggttctggacatccaattatttccaggatcaatgcgaaagcaacaacttcgatcggttcatccaaccatggtgcttctgaagccaaatacattaaggagtaacaactcggctggctaattaccgtggctcatggtgctgtggattctgtgaagaccaggatctgattgctttttcattatcatttcagtcctttgtattccttgtgtttcaagtgtaatatgcccttcttttgggagcttctttgcaaaatcaactgtaccctcagttgctacttgctatcagggtttcccaaaccgctggggccagggttaccgtgtcccggcggtaagcacggttaccgcgcggtaatcgtggtaaccgtgaaaaaccgtacaaaaccgtgtaaaatttatcaaaaattcaaattattttttaaatttatttgaatttaaggaggttaccgcggtatttatattaccgtacccccgtggtaagcccggtaaccgcggtaaccgcacgtttaccggcggtaaaggaaaccctgcttgctatcgaataaatgtactgctgaggctgttgcctcagtttatgcttcaagaaaaaaaaaagaagtggaggtgaccggatgagtcaaccggttactgtacttgtgttttatagtactctctccgtttcacaatgtaagactttttagcatttttcatatttatatagatgctaatgaatctatacatacatatagtctagattccttaccatctatatgaatgtgagtaatgctagaaaatcttatattataaaatggtggaagtatgtaataagtgtcggactatagctatttatgtaagaataaattaaaatacctcaaataaaaaaacaattatctcaatgttgctttgttagaatggtttgtactcttgaaaggagactatgagaatgcgaaacttttacgaagtgtacaagaacagtgactacgtaaaaatttcacgttttgagtaacctgttccatcaaatttaaaaactgtttaatcagccttccgagctaaagaactgggggaatatgtggaaaattgctatgggcctatgtgcaatatatatccctatatacatgatgattgataggcaatccacaaagcctatcaatcatcagtgcaaatatatcatggtttaaatcaatagtttttcattttaaaatatatcatggtattaattgttagacacgacgtgaccatttgtcaacttaaaaaaattagtgcaaacttgtgcttaacccatcttcaatgataaaacaagtccaaacaaaataactgacacttatattgttttcttaaaagaaacaaatggttaacgtcgttaaacttcattaattactttaaaagcgtagtcattcttcttcactacctttagggatggcaatttcccccgcagggccgggtcccctgcggggacccgcccctacgggggcgggggcgggggcgatttttgacccgtgggtgcgtcggggacggggccccgcatttgggcggggaggggacgggggactgatttcacctgcgggtgacccgcggggccccggggagtacatatagacctcaaaatatagatcaaagaaagcccaaaaagcccagcccactaaaaaaatccttaaccctagcagcactgcagcagtgcagcacatccctcagtctctctcctccccacatccattcccctcccctcccgtcatccactcatcccgtgcggctgtggcgtgagccgcgtgacctaggcggcggcgcgcgctcgtgggcggctcgccggctcgcctctggatctcgccctctcggcgtcgccggcgcctgccagccgccaggccaccatctcctct

SEQ ID NO: 64873 - DNA, 3089 bp, Oryza sativa
ggcggcgcacagggcggcggcggcggcgcacagggcgcggccggcggcgaggttgcagcacatcacaaagagtgagaggtattgctccatctccaatactccaaatgtgcctggtgatttgtgaatgaaattatgaaacagaagattgtgatctatttcagtgtatatttcagtgtatatttggtagatttggtagtacatagcacatagcagcagattgtgatctattattgaattatgttatttgtggacagaatgtcgaaccctgctgccaccgttgagtcacaagttgcattgacaccatcttccactcccactccaaccaatgctccaagcgtcgaaataaatgattcacaaggtacagaagtagaacatgataataagagactgaaatctgcagcatggcaagattttgttaagaagaaaataaatggtgcgtggaaagctgaatgcaaatggtgtcacaacaagcttggagctgaaagtagaaatgggactaaacatttgttagaccatattaaaacttgcaagtctaggcaggctagaaaaggtctaacacaatccaatttgaagatgggaatagatgcagaagggagggttaccgtagggaaatatgtctttgatcaagaggttgctaggaaagaacttgcactgatgatatgcctccatgagtacccactttctattgtagaccatgttggttttcgtaggttctgtggtgcattgcaacctttgttcaaggttatgaccagaaacacaattaggaaggatattattgacttgtttggggttaacaagatttctatcagtaattattttcacaagcttcagagccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttagaagagaaaccgttgcctaggacacaagattttgatattatcaattggtggaagtttgggggcattaggtacccaactttgagacagattgcccggtacattttggcaatccctattacaacagtagcatctgaatcagcatttagtactggttggagggtgataactccaaatcgtaatcagcttaggcctaatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataatatacaatgcttagttgcttcctctaattttgatttcaggaagcatctactgtcactgaagcttgaggtggagatttcataagtgaaggatgggctagaaagcctgcaattgcaaactatctacctatatattttattatgtcggcaatgtaatagtatattaagacttctatatttctgtgagactgaatttgcttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttctttttgatgaaatgatgattgtgttgtattttttgagctgattggattgagatgctacccaatgcggggccccggtcgggttgcggggccccgcaggggtcgggggcgggggatgttttcaacccgcatcactggtcggggccgggggcggggggtgaagtcgggggtcagggtcgggggcgttccagcccaacccatccccaccccgcccggtggccatccctaactacctttccactattcgcacgaggtgcactactacaacaaaacaacccaacggagacatcttatttgtacgataaagacgttttatctcgtctcctacagataactgagacgcttttataaatcgtcgtaggaacgtctccgtttgcaccgtctcaaaattatggaaacgctttttaaagcgcacctatattatttaagacgttgctagagacatgtaaattgcatctctataaaatatagagatgcttttatagaagcattaatataggcacgcacatcaagcattaatatttgcagattgcaaagttcatgcactaaccaagtcattaacgtgaacaatcttaaaggtaaatagatagttttttttatattgcaactctgcaaacatgcgtcctatagcagatactcttcttttttaatctgagactgaatattaaatattcatttttttttctaaataattataatattattataatggtatttaatgatgacgattaggaacagtgtgtttttttcttctttctctatataaataattatatattatctaataacgatgacacggatataataaaaacgtctcaaaactcatttctacacatgagacgttccaaaacgtctcaatattcctctctaaacgatttagttttgtgctaacctgtaaagcgtcttaaactatgtcctcaactaataaagcgtctcaaatatcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagaccatttggcatgcattatataacta

SEQ ID NO: 64874 - DNA, 3063 bp, Oryza sativa
attacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgagccatgaaaacatcagaccgagcagccccggatgacacctatccaaaccatgtaagcccaactaggccacggtagtacagtgcacatcctatattcagttaataaaggcgacagttgcggctcggcaacagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctgaggctgccggatctggcgccgttgacctcatggctaaccactggatttggtgttccatccgtgacaaagggacggtggtggccatgaggagaatttgttggccaacgaggagggagacgctggctggcggtgatgtaggcggcaacaccgtggcgcggtaggaggtgatgccagctcgttatcctaagccggctcggtatccaccctagtttaaggtgatgccggctctaatgcatcttcgttgggagcacctttattaagccacctgtggtaattttatatcagaggcgaaacctcaaatgtatcttcgcatggtggcctgctatcaaatcccttgtccacaaattacgtagacgggtgtttgcgccgaaattttggcctgccttaataaaatagctcgcgtagtcgaaactcatgtaacacacactggtggagaaaccatctttcgtcggtcggccgatttccacaatagtcccggatgcaataaaaaccggtgctaaagatgatctttagtcccagttcaaaagggtaacgggcatatttgatctttagtcccggttggtaataccaaccgggactaaatatcatctttagtcccggttcgaatgctgtcagggcatgtcgggccccccgggatctttagtcccggttggtcgtaactttagtcccggttggtattaccaaccggggctaaagatcctggtgatctttagccccggttggtgctaccaatcgggactaaagtcccacccctatatatatgtcttcttcctcctccagctgcccgagcaagcttcaaaatttcttcaaaaaagaggggaggtcatgccaaaatttttattgaatttattttgatgattacatacaaatcggaggtgcctaaaaggtttgcaacttcatcgtccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattattgtaagaataattatttgtgtacggtttttttttactcatgtagatggatcggcaatggatgtacactgaccggcggtccaaagagtttattgacggcatgcactattttttgagagtggccgaagctaacaggcaaaggggttttatttgttgtccatgcaataagtgtaagaatcagaaggagtattctgcatccaggactattcatttccactttattgagtcggggttcatgccaagctataattgttggacatcccacggagagcaaggtgttaaaatggaagaagatgaagtggaagacgacaatattccggactttgctcagtatgttggatttgaagaaaatcaaacgggtgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatagggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgatcgattgtatcctatatcgcggtgaggagtatgagaacctagaagcatgccctgtatgcaaagcactacgatacaagattagacgagatgatccaggagaagttgacgggcagct

SEQ ID NO: 64875 - DNA, 1919 bp, Oryza sativa
acataaagtacgtatcttaagcactgtaggaaggttgtatacatgggtcatcgtcgattccttgcagcaaactacctggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaagaaagtatgtttgaatgcttggagagtataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatatattagaagcccttcagaataaagtggtgcaatgtctcgtcagttttgagttgatatttccaccttcatttttcaatataatgacgcatctgctttatcaccttgtgaaagagatccgtattctcgggcatgtgtacctacacaacatgtttcctttcgagaggtacatgggcgttctgaagaagtatgtttgtaaccgtgctcgtccagaggcaagcatcgccaagggttatggaacagaggaggtcatcgaattttgcatagaatttatcgaagaccttcgcccaatcggggtacgtgaatcacgccatgaagggagactacggggaaagggaactctcggaagaaaagcaataatgacggtagacaacaatttattccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttatcccaggcaaaagaaaaatcatcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgcggtcaaccgtcaccgccgatgtaatgccgtaattattgtgtacacgatataaactattttggatgtattgattatccatataaatcaattgatgtatggcataatttactatcattcatatgctacatttaattgaatatcattcatatgctaatcataattaactagagaa

SEQ ID NO: 64876 - DNA, 15800 bp, Oryza sativa
tcctgcagcccggcatttacagatgttaattagagtttttcacaatttaatttactatctttcataggctacttatatatgactattcgaatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtaatttaaataatgttaatgcattaacttctattttagaaacacatatgtaagcgaaaataatatgcagtgctataatctttagtgccggttcttaaccctaaccgggtttaaaaagaatttagaaatagtgggaaaatatctttagtcccggttgatgattactcccggttgttctcatcaaccgggactaaagatcgagggctatatatattcctgatgcgcgccctcgtcttctccaccaacacttaacgttttcggccgatcgatctctctcagcctctctccttcgctgccactgcctagggcaaatccccgcgccgacgccgccatatctcgctgtcgtctcgagctcgtcgtcctcgccgccgcctccgcctcctcctccgccgccgcatctctggggtgagagccgccaccacctctcccttcatccatctctatctcgatctctctctcctcacgccacccaccacaaaacatccaaagcccggacgccgcgccacgccgacgccgcgccacgccgccgccggcacgccacgccgcgccttcgccgccgcgcgcgcaacgccgccgccgccacgccacgccgcgccgccgccttcgccgccgcgcaacgccgccgccgccgccgccgccacgccgccgcgccaagcgccggcccgatgccaccacaccgccgttaacgacacgtgaacgagaacgaacacgtcaatgtacgttgccgcgagaacgtgaacgagaacgagaacgatcgaaagaacgagagtgagaacgagaacgatcgaacgaattaacgtgaacgagaacgacaacgaacgtgaacgagaacgaacgtgaatgagaacgagcgaacgaacgtgaacgtgaaatgcaatatatatatgttacttcgcatttatcctaatacatattttttgtatcttgcagaaaagacgtgttgtcggagtcgtccctcaagccggagtggaagagctagccctagaaggaattcgtgcaggcaagtgaagtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagaacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttaacaaacatttgagaatttaataaagcagttaagtattaaacaatattaatccaacgctatacaacataccctattgtataggcccaaccattctgaacaaccatcccggctacacagttctatctccaaaccaggattgtaccattccaaaccaggagctaatcaaattattaccaattatagcatcatttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtataacacaatccaccgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaagaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcgacggtgctccggtggtctacaacgacggcgaaggggcggacgaggacggagacgcgacggcgaccacgatggcagccttcccgagtgacgacgacggctgaaacggcggcggcgcacggctggagcgacggcggcgacggcggcgctagggcacacggtgctagagctcttccggcgacgagaggcgaaggcgagggtggcggcgggtagaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcggacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccattttatattggaatttattaattaaaattagatcttctcttctaggcttttaaaattatttctaaaaattccatttaaacaacaatttatatattttgaattttcagggtgtgacaggaaataaaatttcctaaatataaagcatggatggatttaatttttattaaattctccatgattaagtctactctctgaaattttctcggatttttcggagctcaattcctaaatgatacaaagaacagttcagtaattagttaatcaattaatgatctaattataagtgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaatagaaaaatgtttttaaatcctccttttggctttgggccgaaagccggcccaaaacccctctctctttctctctccctccccggcccagtccgcccagtccgccgcgccccttcctcctctctctcagccgctgagaggtgggccctacctgtcaggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccatctcgccgccggtcgccgtgggcctccgtcgccgctcgctagcccctttaaaagcacccccgagctctcctctatccgccgccacctttgtcttagcccgccgtcgcgtctagcgccgcctccgcgtagccctagccgtcgctgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcatggccggcgccgtccgttgctcttccgccgtggttttggtcaccggtgagttcgccgtgttgtcctctacccgttggtgtcctccgtttgcgtcgtcgcgctgtcgttcgccggcgagcgtgcgaggccgagccgtcgtcggtgatgacgtcatcgctgacgtcaccgctgacgtcatcgtcgccttgtcccgtgaaccgcggtagatcaagttgatctcggccgtccgttttggataggatcgatctcggccgtttgtttccttagaccgtcccgtgcacccggactgcctttgatgacgcaataatcctccttttccttttgaaaaatagttcattattgcgtaataattcaattaaaatccatataaatgctttaatccggtttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatcttgtaaaattcgtaataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgtagaccgaatattgcaagtcaagtcacacagatcctaaacacaatcctttgagcattttgatcctatatttaaattctctatttatttcaactgtgcatttattttcgaatgtcactgggtggtgtgaatctattcctttgttatggcctgtttgcattgattactttattccttgataccttgggttattataactagactagttgagctttatacattggttcagctagatattagatgtaattgcttagccatgcttagaaacattagcacactattgggataacttatgacttattattatttaatgatggcttaatgatagtttacgatggtcaatcgtgattggttaattaattacttgccaactaaaacttgataatggtgggttgtgagcacatggctttgagagtcgtgctcatgacaattaaggaccggttcacgagctactattgtgaaacattaaccgtgccaaccacaagccagcgtgggcaacggctttaccttttgtatagcatgattcattgcggagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacatatcacaccctgaaaaattcaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaagagtctcttttggctctgggccgaaagtcggcccaaaaaccgttctctctctcctcggcccaagtcggcccagtccagtccgcagccgcccacgcgcgcgcgcccccgcctgtcaggtcgtcgtcttcctcgcgtcggccgcctcccgaaaccctagcgctgcgccgccgccgtctccttccaaatccggccgctcctttccttctccggccgaattgatagaggggaaatgatcctcgggatctcctctaccttttcccttttggaaacatcggctaaatcggcttggaaagcgtttgattcgaggtcgaatcggatcggcttttctctctccgagcccgacctttccttctcgtcgccggccgccgtgggccttcgccgtcgccctccaacccctttaaaaggacccccgagctcttctctacccgccgctaccctcgccttcgcctctcgtcgtccgtagcgccctagcgccgagtagcctcgagccgccgtcgccgccgtcgctccagccgtgcgccgccgccgttccggtcatcgccgtcgctcgggaagaccaccgtcgtggtcgccaagtcgccgccgtcctcgtccgccccttcgccgtcgccgaagaccgccggagcaccgtcgccgtcgtcaagccgaagagctccgccgtttcaacctcgtcgccgtcgccgtccgttggtcttccgccgctcctttggtcatcggtgagttcgccgcgtcgcgctctacccgttggtgccctccgttcgtgccgaagtgccgccgttcgcaggcgagcatgcgcgtccgagccgccgagccgccgccgccggtggtgacgtcatcgctgacgtcatcgttgtcacatcctgatttttgtttcaggatttatagattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattgttaattttaatcatacaaagagcagttcagcaattgtttaaatattaaattaatcattaaatggtctgattataattttgttaagtactttgagtgtccaagtattttcaagatttttcttgaaattatttgagcattggaagtatttttaacaattcaaagatcatttcagtgattaatttaattggaaaagtaattaaagttcaccttttccttttcgggccgaattaggaaaagtcctctcactctcggcccagtctcctctcagcctgcagcccttttcctctctttcccgaagtctgctttatttccctcctttaatcagtccttggaagtagaagcccagccgaaagtctagtttgcctccctggcactattcatcttcaagcttggacagagccgagccgccggtgctgtgccctgtgcagccgccgcttcctccgttaaatccgccacatcccgagctccgtttgcaaaatttgttgaggggaaatattcctcttatcctcctctatcctctcccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgttttccccctctcccgtcctctcccgtgcaccgtagcccgccgtcgacgccgcatagtccgccgccgccgccggccgggttgcagccgcgccgagtcgccgtcttcgccgtcgccgccgcttgccgccgccgcctttaggtgcgccaaggtgaagagaagcccggccgcacctcctccttcgtcgccggccgccgtagctcgccgttgccggtcaagccgagccgccgccgccgttcatctcgtcgccggccgtcgtcgttcgtcgtttggctcaagggtgagtaccgttgggttcgtctcgtcgttctccacgtgtacatgtcctccaaatttgcagccgaccatccaatctccggcgaggtcgccaacccgggccggccattgatgatgtcatcatgacgtcatcattggttttttctttttcccgtttttctaatagattaaatcttctgaaaatcataactaaataactgtagatccgattcgagtggttcaagttgctaaatttttctaaaatcaagatctactgccggccgggttgcagccgcgccgagcagccgtctccgccgtcgccgccgcttgccgccaccgccattaggtgcgtgggagcgacgagaagctcggccgcacctcctccttcgtctccggccgccgtagctcgccgtcgccggttatcccgagccgccgtcgccgccccttcgtcgccggccgtcgtcgtttgtcgtttggctcgagggtgagtaccgttgggttcgtctcatcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttttttttgtactgttttgttgatttttattctttcgctttagtttccgacgttccggaggagagcgttttcgttgagcaaggttcggaagtgtttgcggaagctcaaggcaagtcacacagatcccaaacaaccctttgagcatgttgaacccgtttaaagctattattttattttaactatgcattatttttgaatgtcatcgggtggtgaacctttccccgttaattaatggccgaagatgatcttattttcctatgggttataatttgattagcatgaaccttatatattggtttggttcagttaaatgctatatgtatgtttgcttagccatgcttagaaacattagctaattaaaggggattaaatataaattatattatattattcttattaattatggttatatttaatggtagctcacgatgattaatcgtgtgatgttaattaattgataattaaaacctggttaaggtgggttgtgagtatatggttttgatggttgtgctcatgacaattaaggaccggttcgcgagctactgttgtgaaacatttatcgtgccaaccacaagccagcgtgggcaacggctttatcttttgtatagcatgattcattatggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatcctttggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagacagttaattccgctgctattttcttttctttgtaagtatgtaacgttattattaagatggatttgtatattaaattgtcagtttgtgtacctcggctgattcctggacgaggattttatgcacaaattagttcggaaattactagtgaattttcgggcgtgacaagttggtatcagagccatctcgactgtaggataagccaaatggtcaaactttaaggacgaatttttccaacaaaaatgatttgtgaaaatttctcctttcttccttatctagaattctttgcaaattgtttcattgtctactctcctctctcgttcaacttgagtagttctgaaactagttgttgaaactagaagatgttgatgaggtcaacttatagaggtcagtaaagtggatcgaggaagaaccgaagtgccaagtggtcaagatggaatgaagtttggatcctaccttagaacctatgccgctaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaaactggttaaggtcttgtctttagtgtaacccctctccttctatcttctctaatatgcaacagatggtgaacacgcgcaccagaagtggaagtggaagtggaggtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagagcagaaggacaaccaatcacttgggctaagttcacggaagcattcaagaagacacacatacctgtaggagttgttgctttgaagaagcgtgagtttagggctttgaagcaaaaggatcataccgtggcagagtatcttcatgagttcaatcgtctggcacgttatgctccagaagatgtgcgtactgacgaggaaaggcaggagaagttcttgtaaggtctgaaggatgaactgtcagttacgttgatctcccatgactatgttgattttcagcagctggttgacaaagcaattcgacttgaagacaagaagaacaggatggataaccgaaaaaggaaaatgactgttttccaggaggcacaaggtagtagccagaggcagcgtatcatgccactccaaattagtgaatcttcttccgctggtcaaggacagtcgcaacagttgaacatcggtggtgagatcaaatcagagactaaggaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagacaaagcatcagcagccgcaagtcaacaacattgtcgtcacaggagccaatgcagtgccagttgcgtcttcaagagttgcgtcttcaagtgttacagctcagccaccagtttcaaagcagcagtagttttctttaaagccttagaataattatctgagttatggaataataagatagaatgcagtttacctatgcccttttctttctagccgttccgaatctcgggacgagattctttgtaaggggggtagatttgtcacaccctgattttcgttttaggatttataaattatttaataaattattattagaatttatattaaatgttcattaatttacaagtgaagttaaatgtgggaaataaaatttcctaaatataaagcatggatggatttttttttttaaattctccatggttaattatactctctggaatattctcggatttttcggagctcaattcctaattttaataatacaaagaacatttcagtaataatccacatattaaattaatcattaaatggtctgattataattttgttaagtactttgagtgtccaagtattttcaagatttttcttggaattatttgggcataggaagtatttttaacaattcaaagatcatttcattgattaatttaattggaaaagtaataaaaatcctcctactcagcttgggccgaatccagcccattctgtcccttcctctcagcccgcatagaagtctgtttgtcctccctctcgctacagtgttgtcttcaacccctggacagagccgagccgtcccgagcctgtgcagccgtgccgctcctccttccaaatccggcctcctcgttgctcctctttccaaattagttgaggggaaatattcctcttatcctcctctatctttacccccaaaaatcggagctaatcgttgagtattttatccgaatcgaactcgtttttgagtttatctccaaaaccgagtttttgatttcccggatcgatttcttgtaggaggagtccgatctcttcaatccaaggctataactaggaccccctagtcctcctctttcgtttgccccaactcccgtcctctcccgtgcctcctagccgccgcgccgccgctgcttagcctcgccgccgtcgccggccatctccggcgccgccgcgcagccgtctccgccgtcgccgccgcttgccgccaccgccattaggtgcgtgggagcgacgagaagctcggccgcacctcctccttcgtcgccggccgccgtagctcgccgtcgccggttatcccgagccgccgtcgccgccccttcgtcgccggccgtcgtcgtttgtcgtttggctcgagggtgagtaccgttgggttcgtctcgtcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttgtttttgtactgttttgttgatttttattctttcgctttagtttccgacgttccggaggagagcgttttcgttgagcaaggttccgaagtgtttgcggaagctcaaggcaagtcacacag

SEQ ID NO: 64877 - DNA, 6015 bp, Oryza sativa
  unsure (1)..(6015): unsure at all n locations
ctattcgaatagccgtgcccgcggttatggcgagttgaccgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatccttcggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacagtttagtggtgtgagagtcttcagttttgtaataatgaaactcagttaagatcaataaaagttaaagtaattctctgtcctaagtagtttcccccggtttctcttcttgtgccctgtccatgccagatggtgctcactcgcagcaacgggaatggccccaacaacaacaataacaataacaatggagagaatcccacacttgcccaagttcttgctcaacagactcagttaatgaacatgatgatgcagcaacttcagaaccagcaaaaccagggaaataactatgcgcctccccaaaacaagttagcagaatttcttcgtgtgaggccgcctattttctctagcaccactaatcctgttgaagctggtgattggctccatgccatagagaagaagttggatttgcttcaatgcactgatcaggagaaggtctcatttgcatcccatcagttgcatggccctgcctctgaatggtgggatcacttccgtctgaataggactactgctgaacctatcacttggcttgaattcaccgctgctttccggaagacgcatataccatcgggagtggtgtctctcaagaagaaggaattcaggtcgctcactcagggatctcgctctgttacggagtatctgcacgagttcaatcgtcttgctcgttatgctccggaagatgtacgcactgatgaagagcgccaggaaaagttcttggcaggacttaatgatgagctttcttacccactcatgactggggattatcctgatttctagaagttagtggataaggctattcgccaggaggacaagtacaatcgcatcgagcagaagaaacgtcggattgctcaattcaagacacaacaggggaatagtcagaggccgcgtcttactttaggaccccagtccatgccacagggaggttcttcgtctgttgttcgtccgcagcgtcagttcttcaacaacaatgctggcaacaacatccgcaatcaagctctacgccctgttgcagcctcgacacagcaacaacctgccaagagggagcaaggcagaaagcccgtggtgtgtttcaactgtggagacccaggacattacgctgacaagtgtccgaagccccgacgcgtgaaggttgtccctgctcagagcaactctaccgcaccagcgccaaaggcccgtgttaatcatgtcgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcctctctgtcagaatagaaattcaaggagtaccatttctggccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtccttaaggtcaagactgaaccaaataactttggaagagattcctatagtccgggagtatcccgatgtgttcccagatgatttacctggtatgccgcctaaaagggatatagagttcagaatagatttgggaccaggaacaactccgatccataagagaccttatagaatggcagccaatgagttggcagaagtcaaaaggcaagtagacgatttgcttcagaaaggatacatcagaccgagttcatctccatggggagctccggttatttttgtggaaaagaaagaccatacccagaggatgtgtgtggactatcgtgcactaaatgatgtgactatcaagaataagtatccgctgcccagaattgatgatttgtttgatcagcttaaaggtgccactgttttctccaagatagatcttcgatcagggtatcaccagttgagaatcaaagaggaagatatacctaagacagcttttaccactagatatgggttgttcgaatgtactgttatgtcttttggacttaccaatgcccctgctttcttcatgaacttgatgaataaggtgtttatggaatacctagacaagttcgtggtggtctttattgatgacattcttatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcacaatgcttgaccaatatccacaagaaacagaggacaatctcgtccatctcctgaaggcgcagcattacaagacgttcatactgttgccgtacaacatagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgacttaatggataaaaaagagtctacgtttgactattttttcgaacttatagacaggtaccgtcataagttcctctgttaattaagaaaatcttgttatgttaattgctactacgaatcatagctttaaactccatgtagggcttggtatcgattccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaactaacttgtgcagctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactacgtcgaaatcgtagctatctaggacatataatggattgtaattaatacatgactacatatgtttctatatgcatgtgtacacattttctataatgtaaatatattttggtcatatatatatatatatatatagtaaatttgtttgtatatatacatatgcatttgcataacatatatatgtataagtacacagggccatgcaaaaaaaaaaaggtcagctcgatctttagtcccggttggtaagatcgatctttagtaccggttatttcacccgggactaaagataaagatagcgatctttagtcccggattggtactcccggtttggaaaccgggactaaaggggggttataaaccgggactacaaagggtttctccaccattgacagactcaaattttcagggaaaatgttttgcaaaatattttagttgcactcttctcgattcttctgttgaagtgatgttgccttctcttaatttcttttaacttggatttaaactttatttgcaaagttaatcgctctcttttaaaatgtaaacctctctatcactactaggaaaatgatttgttgctacgaaaaaaatcgtggcaacaatgctaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64878 - DNA, 1988 bp, Oryza sativa
tttgtgggggctcggtgctttcggccttgtggctgccgcggtttgaagatgattttgtttggctccgactgtgtgcctgtgtgtgctcgccatatgcacgtcgtgcctgccagagtctcgattaggattttgttcacgggggttcccatttcaacgaggggaaataaatggttctggagatgtccatttctactagagttacttcctccgatcataatatctggcgttcatgatagcatttgattatacttatttaaatactaaccgctcctttattataaggtgccaagtgatcagtagtgctagttatctcaattaggattctttatttcccggaaaaaaaaggattctttattaagctgaacaaacatcgaacaattagggcctgtttagttccccaaaattttttcccaaaaacatcacatcgaatctttggacatatgcatgaagcattaaatatagataaaaagaaaaactaattgcacagttatgggggaaatcgcgagacgaatcttttaagcctaattagtccgtgattagccataatgctacagtaacccacatgtgctaatgacggcttaattagtatcaaaagattcgtctcgcggtttccaggcgagttctaaaattagttttttcattcgtgtccgaaaaccccttccaacatctggtcaaacgtccgatatgacacccaaaaatttccttttccccaactaaacacacccttaatccactatttcacacagtagcgtagtaccacacccgttctgcgcctgcacgctacgcgaaacctgaagcccccgcgcgcataccagctgggtcgtgttattcgatctcacaaacacaagaactcaagaagtaccaataacatttcatccatggactgtacggttcgcaaggctgtctcgcgaggtttcgctctagcagcagagccgagctgccgatgggtgggtggcatctgaaatcgatgcacttcagtggcttcaaccgagcgctatctgtggatctctcagctggagtaatactggagcccatggacacttgtgcccgctccgcgtatttcctgatgccacccatttctacccgggcacactagctactggaaaatttaaccgccgtgaggcgaaaccagatggccaatataccagaggaagtggcgatgtgtgagaagaaaagaagactcgccatatatatgcaaaatctcgtttaggatttgtttactgtgttctcattccaacaagggaaagagaatagataaagctctagttatatggttgttgccaaaagatatttcgatcattattttaatgccagcctctttcgaagaagagataaagctttacaaaagacggttcaacacttgtccactgtgcgggataaatctgaacaaatttactcgaattcaaacatttagaagactcacactttgctcgaaattgccaaaacagaaattgccagaaaaaattaaaaactaaacagattttgctaaacttaaacaaccatttgcaattttttttgatttgtataattggtgacaagtcatgaattttgtcaagcatgctgaaattcaacaaatattggattgcattagagtcttgcacatggtcgcccaagggtaaaattatcctttgcaaaatttccaagatatattaaaatagtggttggaatgtcttttgccaaacaactattcaactcctttaaaaaagagtaacgatggtgtcagcaaatatgccaccccatctattccaatgtagatttggtgctaccccttaaacttcttgatattaaaaataactaaatataaatggatgatcacaaataataatattacatcgaggtgaatttctatgacaaaaagataggtaacacattaatgtattttctcttatccgtatccaagcacgtcattcaactagtaaaactagaacatcagcaaattttacctttctctttcttagtaacatgttaacttagaattcaactgccct

SEQ ID NO: 64879 - DNA, 1075 bp, Oryza sativa
taactttctaaaagaaacattcaggttactaccatgggcaaaccgatctctagtccacactccacggccgttttgtttcgttatagcagcacagtcgatggacgggtgaggcctcaaatcgatgaagaaatccgacagccgttagcacaccccttgtggagtctccgtggtcatcaggaatacttgagctcatggacaatggcagatggacgatggccaccgcctgctccgcgtgcgcatgccgcccatttctacctcgactccccacactcgacgcacgcattgcattgtttaaccgccgtggaggcaaagctggatggttaatatatatactccctccgtttcataatacaatagattttggtttgatgtgacacatcctaaagtgtatgcccagattcactatactataatatgttacatccacctaaaatcccttacattataggacagagggagtagatcgaaggaagcggcaaacgagaggatgcatgcatctcaattaattactacctcaatcccaaaataagtgcagccatgggtatatatccgtgtctaatatttaaccgtccatcttatttgtaaaatttatgaaaaaaactaaaaaaatagccacacataagttacttttcatgttttatcatctaataataataaaaatactgatcatacaaaattttcaactaaggcgaacggttaaacgttagacatgaacaatgaaaaactacacttattttaggacggatgaaatacttcatatggtttggagtgcactaaagttattaattactaattaatttgtagtcctctccatccagatgtaatttgttcttttgctctgtcgtaaacctcttttgaatatgttattatggaattgtatcgtgaatttgtgaattgaaaactataaatggacctgattggtgtttttttttcatttttttttgccaaaaaaatcttttcacatgcggtcccataaaagagactatcctataaaaatcgagaatttccaacaaacctgcaaaacttgaggttttccacatgcctctaagttagagacggttcatccatccgcatg

SEQ ID NO: 64880 - DNA, 1035 bp, Oryza sativa
aggatctccctcatggcttccccctccttcgccgcccgggatcgcgccgccgctcgccggaaaccggagccggagccggagacgacgaggagagtagcgaagcggaggagacggggttgcttgcttgggtgagaattcgaaatggtttttttcgccgtctttataccgccggacgcctccgtgggtggagaggcgcgtgacttcggtgggacccagcatccagttgacgtggggcccacgggcaggcgacaccagctgtgccgtggctgtgttattgatctcgaccgtgcgtttcgccatcggacggtcggggacctgaagtttctggaagcggatcagaggtatcgctccccccggttccagcctggcgcaaccgaagatgaatatggggggcccacctgcagcggcagatggaagtgggtcccgcttgccaggatggcataagccagagaggacggatgtggtggggtcgtactacacaccctgtgagatagggtgtgtagctgaaggaaggatgattagatatcgaattgtgacggcaatttaagaggatcatggatgatagcgatgcttgactggtaatccaagcaacgcatggatcatggatgtcaaaggatgtagtaatagctgttgctaagaaagatgaaagggaccaatcaacagcagcaaccacacggatacgggtctatcaggaaacaaaagcaagcaacgataacatctggggccgaattggccgaaagtacaaaccaaacttatttattcttattcatgaaaaaaaaacataagccgaattcgctacaacaggatgagtttgcggttggaagtttgcacaaaaaggcaaagtacatcagcatcaaccggttgaggcaaatcatgggatagcttcccctctagcaaaactgaagttaaagcacaatcgatcatgtcgttgcgatggtaaacggatggtgatgctaccgaccgatgaaacagcatgccaggttcatcaagcagacgagctgttcttgaaaatcattgatcaggtaaggggtgcag

SEQ ID NO: 64881 - DNA, 1567 bp, Oryza sativa
tcaatgtctacatgtcaatgctgtctacctccgtacggatgcgcctcgtcgattcagtgaaatagaaagaacaaaaattaagatgaagaatgcacagtcatatattaatacacgttgagaaaatacaattaggctgcgtttgactgttgcggttaggaacaaatccctcttaaacgcgtaaaacagagcgatccatcaatatgtgattaattaattattagcatttttttaaaaaatagattgatatgattttttaaaacaattttcgcgcgcgtgtatatacatatacatatatatacacacaccgtttagttgtttgaaaaactcgtcaggttctgatttactgtgtaggaggaatccaattcggttgcggttcgtgcagactgagactcaaaatccgactccgacggctggggctgtttgtactcggcttcgttcttcctgcccatgcactcttcgcctacataagagatagatagccacaggactaatttcttcaccaacaaacatcgatctgatccagcgaacgtgtgcgtggaattcacacagcttttttggtgctcagagtacggtatttttggtattttgatggatccgctcccttttccctgcctcgccctgtacgaagacgcggacacgccaaagccgacattcttcgacatattcgaggaggcgaagatcgagtgcgccatcgacagcctgaccaacaacaagaaaaaactatggtagacgcctcagggatggatcctagtccgcgacgccgccgccgccaccacgttcctgcagaatcctcgtgatcccggcgacaagattcacctgccacatctgcccgaggacctgccgagcaagtccacctgcgtcctctccggcaagccgacgatccctggttgcgtcgcgctgctcgtcgagccattcgccaccgtcatctggtaccttcacgtcggcgaggaagacggcgagtggacgaggcacgagtacgacatcggaacgcagccactggacccgcccatcgacggcgaggaccacgagaaggtgccgatatgctcgatcgccgcttgccggggcaagttctacttcaacggtacactctccgacatcggcgtgctcgagttctctccctccgccgctgcgacatcgacatcgccggtgttcagctccctcgagctcgccggagagttcgaggtcgtgtacagggcgaaggtattcctagtggaatccggcgaggatctgtacatggttatgctggtgtaccgcggctttcgctgcgacaagacgggctacgagacccgggtctacaggatggatttctccgagcagccgccgcggtggcgcacgggcgggtgacctcgccgtcggcgcgttcttgctgtctccgtggtatttcggcgcgacgtgttcggcccgtgagcttgggctgcacgaggattgtgtctacgcgttcgttcctggggatgatgaggtgcctacgtgcttgaagatgtccagcgtgaaagatggatgggatgatttcgttgatgttccagcggtacacagggcattgtggattctgcccactgatccatatata

SEQ ID NO: 64882 - DNA, 3279 bp, Oryza sativa
tgtccctgatatggattttcacatgctaaggagaagaatcaggagcttcatgaattggtgtgattcatggctccacttagcacaatctgaacagtttagcaatcctttagttgaaattgtttctcaaaattttcaaactcaattaagaactactgaaaattttcaaactgagtgcaccttggccccattatctcaacaagctttgctggtttagcatgagatgagactctgtaaagtttatatgtcctaagtagtgcatgtccctagtcatgcatgtttccaatatcagctacctgtgtggatgaaattatctgccaatatcagctgattcaactgaactttcattgagtccttacatcttttctcgtccttttctctagcaaatcacataggattagttatctagccgggagagcaaacgaatggcaacccttggaccaagcttgattgctcccctgctgtggctccatgatctcagacttcgtcagagtatacagtaatgcactttcttcagaaattttcttgacagaataagctcaagtcacttaactcgatgttaaagccctgtagcgtatcatgtaaagctcatgattttgatctcttgagatgacatagggctccgttcgttaccagggattcccaacctccctcccgcgttttccacgcgcacgctttttaaactgttaaacggtatgttttttgtaaaaaaaaattctatacgaaagttgcttaaaaaaatcatattaatccatttttttaaaaaatagcaaatacttaattaatcaaccgctaatcgctgctccgttttccgtgctgtaggaaaccgttcccaacagtgagtatcgaacagagccatactgtatgttcatacatcgttgcctagttgatgactaaaaaaacataaatattaaggaatgacataatattaaataattaaaagaggtaaggcttcgaaccacaccttgtggagctcatcaactgagcttgtccagttgatgactgaagtgctgaaaattttcctggtctgaattaaaatacagtagtactgatatagtagtacatttcatatatgctgcagaccattgccttttacaaacaacaactgtgaattgtattattagagcattgagttctccggaaaaaaagagtaatgcaagataatggcaaaagtcacaaagaagagtgtagataattatagaagcatcattcgcagtttgaaaagaaaggaggaagaaccacttggttgattacgcgtgtatacataatctaccttttaaaagcaacgaacaaatgcttaattattttgagggaatcagattcttaattagaccaaaaaagcaaaaaaaaaaacaaaaaaaactgtttactgcttggagatcttgaagtgtccaccctgaacttttgactgcaaggttaatccattttgtccaccgtcatttcccaaccaaagttctctttcccctaaagaaaaacacacacaaaaaaaaaatttctctaagaaaaacacacgaaaatactattattttcaagtagtagaagtcaagcttccttgctttgctttgcatccgaccgttgggccagaggctccaagccaacggtcaccagaggaagaggtacactgtcacagtagcaaactccacaagcttccatctgccttcttccataggattcttcaacctctgctgcaccccgcagattaccagcttccatccatggctggtctcccctatttatacaccaactccttcccctgccagcttcgtctcccaaggcaagagcaacgcaaagcaaagaacagatacttcttctctccacctgcctcgcaagcttcttctgtttcttggatctcacctcgccacgccattgacgccataaggagcttgtgagaggtggtagccaagaaggaggaggaggagatggggttcgtgctggtgatctcgctgcccttcatcttcttctccatcctgctcggcttcggctgctacttcctcggcaagcacaagggccgcgaggagatgcgcaccggcgtcggcgcccaggtctacggcacgccgctgccgccgcccggcgtcggagcgccgccgccggagccgttcacggcgaagaaggacggccccgagaatctcgtctgatcagcctcggctgctgctgctgctgaatcggctcatttctttttcttgctatactgtactgttcgtgccgcggtggtgtacatgaagtggttaatttggttgttcttcatgttgagttcagtgtgataatttgtaatcacaatctatgtgtttctttttttcttttggtaaaatgggttcgaatccaaaatttgtaatcacaaattcgcaattagcgcccagacaagtgatttgattgattggctattggattgatccatttgaataggttctcttacttgttgctgatcgtggagacgaactcgaaaacgagttgtactctggttgcttccgcatatatgcgagaattcaacaaggtcaatttctccatccattgatctgccacaagagagagagagagagagagagagagagagagagagagagagagagatttccacctcaccctcgagcattttcagacaataattttgatttgatggatccgcttcagccttgcctcgtcttgcagcaagataaaaaccgagaattttcagcatctccgatgagaaggaaatcgaaggtggccgcgacattgccgccctgacgagcagcaaatcgtgggtgacgccgcaggggcggattcttgttcgcgacaccgccgccgcaaccacgttcctgcagcagaatcctcatggctcagtgctacttcgcggcgtcgtgctcggcggatgagagccggtttgtgtatagcaaatgtcaatgtttgtagtgtcattattgcaaatctccctgttcttcccaggccatgatggcgacgcgttcgtctaagatttccaacgtgagagatggcaatggtggagttcttgtagcttccagcggcccacagagtaattgtggatcctgcctactgattgagtagttgtttaggatttgtagtcacagcaaaaatgttcaggttttagcaaatcaacattgggggttgatacatttgacatttttttttgggtcaaatttgataaaaatatcttcctttgttaccagtatcttgttttcggactgtttcgatgtgtcattttgcatcaaacagtctattgtagcccaattatctacagtgcacaaatagcatctgaagaaattttgttagaaagaaaaagtatgcttcagg

SEQ ID NO: 64883 - DNA, 2755 bp, Oryza sativa
  unsure (1)..(2755): unsure at all n locations
caactccactccagacctaacttagggcctgtttggtacagctccagctccagctccacccctcctggagctggagctcagccaaacagtttcagctccaccaaaactgggagtggagctggatgaagctctctcacaaaatgaactagagttgtggagctagatttagacagcaccataactccactccagactgtcctgtcacgccccgaactagtaccgactggaactagcccgtgacgctccaaattaacctgttaatcgataccagtcccaggaaacagtgctggtatcacaggaagacagattatcacagcaacagaggtctctttattatagagtagaggtacagtcatgttgggctgcggacagatcccgagctcacaactgcattacaaaaggggaatggaagccaggacttggatcaaacaatacaggcgtgacttgggaactaggccgaaaccctaaaactcatcgtagccggcttgctcctggaagaactcctcatcagcaggattcgcttcatcttcttcagcaactgggggagattatttatatagagcaagggtgagtacgggagtactcagcaagccatgggaaataagtgtttaatgcaggctttaagggaagggctgttgtttttgcaattgattttatttgaactcctttctgaaaacaactaggtgagtgcttctcaaacgacacggatgagacagtgcgtctcgtccggtcggagtatgtgcaatgtatcaatctttagaaatgacacaagattggcacctggccaacagcttttcaaccggccacccgggccaacaactttcaaacggacacccgggcctagctgatcccatcagctgctgaatctttcaaacatcgaacccctttccacaacagcaatttcacaagcggtaatcaaagaaaactacactangaatcacctcacatccgcccataatgcagggcatggctgttcnaacagtttgttaacctctgcagaggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccagcccggcgaatccacatgtctctcggcatcaaggctcccctggtaagctagttactccgccaggggtgtcccattccacccatgtggtcgtacttgtcttatgtttggatgaaattccaaggaaatggtccttaagtgcgagagcgggaaaccgtacacccggtacgttccccggtccgcggttttggaaattcatttagttcgcaagcaccgacccaggtgtcgggttttccaagtcttttgtaaacccaagttttacccaagaagtttttcagattttaagtttgaaggcgtccgtcgatactcgcgcaggatgcacggatatcgagacgcaactagatggttacaaggggacatgatataacaattaacaaagggaggatcaaatgcagcaaattatgtaagtccgccaatctgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaagaaaatagggagggattatagacttttcctcgggcggctagggcgcggcccaagggaaaaggagcggaccggacgagctaaatgggccggccggcccaaggcggcccaagtgcgcgcgcgcgggaggggaggagagagagggccggtagaccaggctcaccgtgcgcggtcccgagtgggacccgcttgtcagcggctcggctcaccgtgcggagggagcacgcggcgcacgcgcgcgggcgggggagggacgcggtgcacacgcgcggtctgcggaggaacggatgcagcgggcccacgcgcagcctcacggcttgcggtggaacgcgcgctcgggaggggctgaccggggtcggcccgtcctgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtggttgcacgagataaggggagacgagccaacggctcggattcgccggaggaagcttgacggcggcgaatcgcggcggcggcaaccggcggggagggaagaggaaaacggcgacgaggtcacgaggggccgattcccggcggcgagagcatctacgcggctacgggaatccgatgctagcgtcggattggcggagctacccgagcgaggctg

SEQ ID NO: 64884 - DNA, 709 bp, Oryza sativa
ttatctgtgcctctttcaggtattaagaaattgaaggatatgttatggggatcactgttaaacaaagacaattacatcagaaaacaaaaacttgagaatgaaaacagatttcgtcattagttccatatcattaacagtgcaaatgaacactgaataataatatccaatagcaaaagagtttatccttttgctatcactatagttatttgaaatatgcattagttacaaatgctgaaatcaaacagaaccttgagctggatatggtggaatttgtcagcacagcaagagtccgaagatccagacagcttatccaagaaaagacattaacgcttccaacctcatcgggcaaatcctgcaaaaggaaccatcagtacatcaagaaatttgtcttttcccctaactctgaccaaaacaataccgtctcctgagatatctagcatgacacagcaatcccagtttaagtcacgctgccaccaactactccctccgtccccaaatataacggattttgacattttgcttgcactgtttgaccactcgtcttattcaaaaaatttgtgtaaatataaaaaacaaaaagttgtgcttaaagtactttggataataaagtaagtcacaaataaaataaataataattctaaattttttaataagacgaatagtcaaacagtgcaagcaaatgccaaaatctcttatattagggggacgg

SEQ ID NO: 64885 - DNA, 1213 bp, Oryza sativa
agcatatcagtactttctcatagtccttgccattcatgggtggatccaagtgctgcgtgccaatatcgtactcgtgcctaacccactcctcatcttctccgacgtgacagtaccagatgatggtgtcttcgggctcgacgaggagcacgatgcagccggggatcgtcggcttgtcggagagcgagcacgcaagcacatctgctgtgcaggacttccggtaggtgcggcagatgaatcttttcgtcaggatcctgtgggttctgcagaaacatggtggcgtcgtcgcggatcaggatccatccctgctgcgtcggccaggcgttgctgttcgtcatcccgggtatgtaggcatcgatggcctttttctccgagatgctgaatagcgccggcttgtctgaatcggcgccgtgcttcagggcgttgcaaggcacagggacatgtctcgtcttgtccatcatggtgatcgatgtgagtatgcggcgttggatctctgcaggtagcaacgcttttggctctcttacatacatactctaggcgaagactccgattcagtgccgtgttgcagacgacgagacgagtcggcttcagagtcggttcacaactcacaactagtcacaagaagatcgatcgccttcctatagcagcggtcatgtggttcagtttttggtaacaaggaaacggatttgatgtcttctgttccttttctgattttgattgtgatcgcaagagaggaaagtctctaaaagtatggttaatatagttttacagataatcacagtaatagcgacgggtgtgagtttctcctaaatctccaatccctccaaagaactgccccttttcagaggttttttttttttgactgataactttacagagtttcagtatttaaaatatttggtgcattagacatctttgagacaaataagtaatttatgttttgtgataagtaatttataaaccattaaaattcagataactggtgttcactcttcagaagttctggttgcaatgcgctgctactatcaggttcttgcgttctcttcttttccaagtccaattctgaattctgaattctgaagcgacttgttctgatgtcctcacctctcggtgctgatcatcaacaagtaggttgcagctctcccatcaagtaggacagctaatgctctaatctttcggcttcagggtggaaacaagaacaaattaacatacataa

SEQ ID NO: 64886 - DNA, 1136 bp, Oryza sativa
tcctgcagcccagctagaaaaaacgcacggcctcataggctctgcgccattgcaagctcaagaaatccatcctatgaacggccatatcgtatatggcgaagtcgtggtcaagccgcagacagatcatgtacaattcgtcctcggattctaccaagaacacgaccgccgcgcctatcacccctaatcctccggggataggatcgacgatctcaatggtgctgaacaccggcgtgggggtaaactccagtactccgatgctctcgaagaagcagttgaagtagaacttgccccggcaagcggcgatctcgcatatcggcaccttctcgtggtccttgccatccatgggtggatccaatggctgggttccaatgtcgtcgtcgtgtctcgtccactcttcatcgtcgccgatgcgacagtaccatatgttggtggcgacgggctcaacgaggaggacgatgcagccagggagagatggcttgccggagagctggcaggagcatctggttgacagaccttctgggagatggatcttgtcttggggatcctgagggttctgcaggaaggtggcggtgctctggcgtagtaggatccacccctgcggggtgaaccaggcgttggtgttggtcagcccagggatgtcaccgtcgatggccttcttgtctgagatgctgaacagcgccggcttatctgcagcagactcgtcgtgttgctccatggagaggcaaggcacggagacgcggccgctcggcttgtccatggccggcgtggtgttgtcaaccttgtattcctctcttcttagttggatctgcaaatcgtgctctgtgctcctcttatatgggcgaagctgctacctaagcagggttgattccgactcagagtcagtcacggccggcgatccctcatcagagatcagacatctgaagtaatcggaattggaggcaaaaggccaattttcgtggtgaggtaaaagagacaagaaacagggatgtgttgttgttcgtcagggcatcgatgtcgcaggcgatgtcctgtccctcgaagatgttgaacagtgtcgtctttactgattccaggccgtgctgctgctgctgctgcaaggcgagacagggcacagggagaggatccatcccaaatat

SEQ ID NO: 64887 - DNA, 2790 bp, Oryza sativa
aaaacacttatccagtgcatacgaggcatacacagaatccttctcgagcccgtactcatcagccgaacatgaagcgccaaaatagaacggagctagaaagaatgcacgacccccaatctcatacactctgcgccattgatggctgaagaaatccatcctgtggacggtcatatcgtagatggtgaagtcatggtcaagccgcaggcagaccatgtatagttcatcctcagactcaacaaggtacacatacgccccgccaatcacccctaatcctccggcaatagagtccgcgatctcaatggagctgaacgtcggcgtgggggttaactccaacacttcgattttctcaaagttgctgttgaagtagaacttgccccggcaagcggcgatctggcatatcggcaccttctcatggtccttgccttcgaagggcggatccaatggctggattccaatgtcgtattcgtatctcatccactcatcgtcgccaatgcgacaataccaaatcacagtggcgatgggctcgatgaggaggacgcacaaccggggagagatggcttgctggagagacggcatgagcatatggtcgacaagcctccttctagcagatgaggtagacggatcttatcttggggatcctgtgggttctgcaagaacatggtggtgctctggcgaagtaggatccatccctgtggcgtgaaccatgcgttggtgttggtcagccctgggatgccgccgtcgatggccttcttgtccgagatgctgaacaacgccggcttatccgcggagtcgtcgcgttgctccaaggagaggcaaggcacggagacgcgctcgtgttgtccatgattgggtgatgttcttcttcctcttcttcttctttcgtttgttgtgatgttgtcaacctctattcctctcttcttcgttggatttgcaaactgtacccagcatgcactaatataggcaaaactgcaggctgagcaaggttagttcgtgtcggtgatggcgatccttggtagccttcagcacgagtcagaagcaatcggaatcggagacagaaatcaattatgcgattcccgcaccagccgtcttggcaaagatctgcacggcgcgcggcaactggcaaatcggaaccaaaaatcttccagacctttgggcttgcatatattagttttatcggcagagaaacaagggctaagatatacatagtccttacgacaaaaaaaataaaacactagtacaacagtaacatggatatatagatggcacattaaagcaaaatcactgcgtgcagcatttgtcctcctactggctattatgaacctacttctcccagtaggttaaacatggataaatattgaggaccaatcgatgacctcagagcacgaacatgatgtaagtcatgatacatttggacttgtgcttgatcataaggagcccctgttcactgcttgttggcaacacctccacgccggtgaagacagtcactgggttaaagtcacactcgtaccgctcgttttcaatggtgtagccattgacaatgcaaaacctcagtgatccaaggttcaccaggtcacggtacacctgagaccagttctccggcagctcaaactccatcccgacatgccgcaccaccggcggaggagagcctgcggcggtggagaggttgtccaagatgcacaggtcaaaggggccgccatccgacatgccgaggcagtggcccagctcagggacatactcggcattgaagggcagcacccaatcacccaccttattccaatctctcgtcaccatgtcaaaggagtaggtcgccgtggtggtagacacgcatatcttggtgctatcgaccaccatgaagcgaggcttaagggggaccttatactctcggtcctgaaagaatggcggctgcgggagtggcccccagcaccaacactcctccacaggatcataggcaagcacctcagaactacaccagtaggtaggatcgatatccatgatgtacaggctgtggtctgtgtcgatgtcaaagttggacatggcatgggcagaagcacctgggatggagacagccacacaactattgtatctcttgggcgaattcagatcaggcattctcatgaatgagcgcaactcggggttgtagatgctggtgtggcctgccatgtccgtgcagaggatcttgttcttgctcctctcaccaaagagagcaagtgcacacagtgaactgtagggattagacgcagaccacgtatatggctggtagtgtatgctcggtgttggcaaacggccgatgctcccaattttgttggtgccattcttcttcttcttagctttagcctctgcttccagtgcttctgccgttgatgggtagaagagctttgatacgtccatgtgccttagcgagaacaagccgcgaccctctttcaacaccaaatgcagagactgacggctcaacttctcgcagctcatcttcaacactcacgcttccttgacctgaaggtccaatcaagggatagagaaatcattccacaagtcaacaaaccggatgagcgacttaaattaattttctcttcgttggtagcctgactgacactcaaaaaggagaagtagagattcaatggagaagggtgagaaatctggattatttttgagcaatcgcatacagcaaggagcgagcgagcaatgactagagagggtataacgaagaatttatagtcttgtttgcccgttgcctgtacagagttttttcgtttgggaaatgaaattcatccccggcccaccggtgaaaattca

SEQ ID NO: 64888 - DNA, 4114 bp, Oryza sativa
aacatatactaatattgttctttattccatcacagatctgaaacaagctagccaggcacacgattctagcacaaatcaaagagcatgtcagttatggcaagcgacacacagtttgtgatcacagcggcaggcaaagagaaaagcttccaagatctagaagagaagctagggctaacgcaaattcgagaaaggaacgtaataagtagagagagatgagaaagaagggatggatgatcatgagactcaccagccaaccagcgagagagacgccgcggacgccggcggcgatggatggagatcgacgcaggcgaggcgtccgggagtcgagggctcgaggcctcaccgaccaaaccaagtatgggctttcacttctcacatggttcacttcgccggcccaagagtgagtgaaccggtgttttggaataggaataagtttactttaggtccctcctcttgacatcgagtttgaaatcgtatccttggaccacgataccagaaattttgacccccaaacttgcaaaactgggatagattaggccctcccgcagcatagatggttgttttctactgacgtggcaagttgatccgatccacttgtgctgactacgcgcttacatggcaaaaacaaaccgggcctcacatatcatcctcactctcctcccatgctcctgttctcggtctctcctcccaaatcaagtgaggcatccacgttgagatagctgagcggcacggcaacggggatggcgaggtgatgttagctatttttttttaatctgaacacatgcaaaccactaattacaatttgggtttagtaatacttattattttgaacaaaaatattgttaaacttttacaactttgactaaaataacatctcagaatgttagattagtcctaaaagtacttcaataaattatatatttattgatgttgttatatatattgtaataaaaaatagttgttgaaatcgttttttaaccgcgtgtcgttgtttaaaataataagttttactaagccggagggagtacgaaattagccagtcaaatcaaattgatattacaaactaatgacggccgtattagccaagcaaactaccaaagcagatagtgagacgaaacaccatcggtccatcgatctaatatcttgtgctggtttttctctcctaataacatctagtgctccaagactccaactactcatggggaaatggaaaccaacaactaacaatttggatgaaaaatttccagcctgcacatgtagctttctcatcaggtaggcacaatgctccatctttcagcttcaggttggaaacaggaacagaaaaacacatgacctggaactttacggcctatcctctgcctttgcaagttcaaatagatttaccaagtgtgtcacttccatttgaaactagggagagatttttatcctcacaggtaacttggcacatgcatgcagtgtgacattattcagctggctggccgacaaacaactcatgaatatgaactaaataatgataaaccaataaaattgagaagagtggcgccaaggttcggtactcggtttttaatacaccagaatagtcatcaatttcctgtgtgctatctctgtgcataaccctttctttccaaggaaatatcttgttatgctttcagtggacagtacgacagaaaaaaaaacttaatttcatatatagcacactcatcaagcgctacaaaaacatataataaacaatggctacactagagaaaatatttctgtacagtctttcaacgaaccctccctttctttccaacaaaaattcttgtaacactgattgatgtgtgaccaataatactgtttcatatatatagcttactaaagttggaaatacaaataattaactacggttacactggataaaaaaaacatgtttctttccatgcaaaaaagatgataaaattcccaattgtgaaactagacggtgggcaaaatccacatccctatatctgaatttggagcttcgatgagatcatactcttcggtttctccatcctctaccttggatacctcaaaatatttataacgcacaaaaatagcgtagacacaatccttctccagcccacactcattggccgaacgtgaagcaccgaaataacatggagctatcaagaacgtacgaccaccgatgtcctcggctgtgcaccattgatgcttggagaaatccatcttatgaacagtgacatcgcagatgtactcgaggttgtagtcaaacagctggcttaccatgtatagttcgccctctgactcaccaagaatacgctagctgcgccccagaaatccaagggttccgtgattgcgatgaagctgaacgtcggctctggggtgaactccagcacgcggatgctgttgaatctgccattgaagtagaacttgccttggcaagcagcgatcgaggttatcggcgccttctcgtggcccttgccatccacgagtggaagcaagggctgtgttccaatatcatactcatgtctagcccactcctcatcttctcctccgacgtgacagtaccagatgatggtgtcttcgggctcgacgagaagcacgatgcagcctgggatcgtcggtttgccggagagcacgcatgcgcatctgttgtgcacgacttccggcaggtgcggcagctgaatctttccgtcggaatcctgtgggttctgcagaaacgtggtggtgtcgtcgcggatcaggatccatccccgcggcgtcggccaggcgttgctgttggtcacgccggcttgtctgagtcggcgccatgcttcagggcgatgcaaggcagagggacacggcctcccatagtcggcgtggtgttgtcaaacctctattcctctcttcttcgtgggcgtggtgttgtcaagcctctattcctctcttcttcgtgggatctgccaccgtagtggctcccttatataggcgaggagggggaaattgggaagggttcggatgagtccaaatcagatgccaatcggagtgccacagcgtatttcgagtcggtcatggcaacggacaaacccctggatgaaattccacgaactgcgatcgaatcagatagaacatcatagaccgaatcaagcggagaactgaaaccgaatcagatagaactgcgacgaatccgcttaccttaactgcgatgaggggatcagtaccttgttagaggggggctgtgcgtcgcgatcggcgtagggggccgcggactggacggcggagatggcgatcggcgtacggggcggcggatcggcggggacgggaaggtcccgcggggggagagagggaggagaaggccgcggcgtccccgtagtccgccgcgatccccgtccgcccgcgcggcggtggccgcttggacggaggcagtggaggcgcggaggggccgtcgacggctgtcgtgggtgacgggcaaggccggcggattgcgggtggcggatctgatgttctgggcgtttttcttttttatttgagcaaatttcgcaaaataaaaaaaaagcatgcgtaacataaaaaccccacatattttacagcgtgtttcaaggaacctggggtttagggcaaaacgtttaataaaacctacattcatatgcctaaattattcattggctattatacttacgcgtaatacatgtataagaaataatatgttgcattttctgagtagatgtagccactttctcaagagaacaccggtcatgaattatgagtttttttttttttgcttatatgtaatttgtacatgagatgctatttgcatcaacaattttcccattatgaattgtgaggtaggaaggaaatagagcgtatagtatagaaacgttcagcccttaatgcgagtatatgtgtactacaacgaagtataagtattttgaatgaatatgtggttttgtgaaacattttaccttaaaatatgtggttccttgaaacaaatggtaaaaggtggggttttgtgttattatgttttaaaacatgtgacttatgaaatgtatgccttttaaagattttaaaggattgaccattggggagtatgtacgaataattctaagagaggagcgtacagaagatctagcatttgactttgtaggttcaataaaga

SEQ ID NO: 64889 - DNA, 737 bp, Oryza sativa
  unsure (1)..(737): unsure at all n locations
atgggctgcacggcgacgctcgacgcgccggccgcaagcacggcaaggatggacagggcaagtgatatgaactgtagaacatggtgatagaaaagaattttttcagtgtaaatccatgcatatagattagggaggaatgaaatgtgtaaaagaagctcatctattatccctctantgttgagtgtaatgtggagattgcncaagtgatattgtataatctagtaagcatattattatgcaattcaaacgttgtatccttttgggattatcttattcgcatttttctcatttttttcatgtgattgtatttggacatttttactttataatatgactgtaatcaggagaattgtgcaggaacgaaggccatgttcaagatcaagcttacaggttcagagtacatccaacaaatttgattgtttttcaggtttagagtactaacacaagtggtaggaaactagtaaggaacatagatcttgacaagaatacaggtataaacacaaaaaagcactgctgatcagattgctactccagttggcttgcccttcagtgaaaccttcttggagctccttacaggtgtctttcctagcctgtgaattgttccttcccctgctccttgcaagctatgtgatgcctgcaatgtacacaaatcatattaggattaaatttgcagttagttgaagggagatgtgattgcctgttgttttgtatgaacagtcgatgatgttgctccatca

SEQ ID NO: 64890 - DNA, 705 bp, Oryza sativa
aaaaccttataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgtttcgtggagcattgatcagtgtactcgctgacaacatagtggacgtgtacatgcacatgccttctgggaaggacatgtgggatgcacttgaggccaagttcggaatttctgacgccggcagtgagctgtatgttatggagcagttctatgattacaagatggtcgatgaccgttctgtagttgaacaagctcatgagattcagatgctggctaaggaacttgagaacaacaactgtgagttgccggacaagtttgtggcaggtgacattattgccaaactaccaccttcttggtcggactttgccacttctctaaagcacaagagacaagagttcagtgttcctgatctcattggctctttgggtgttgaggagaaagcgagggcaaaggacgtccggggcaaaaaggttgagggaggttctagtgccaatatggtacagaagaaggaccctcatgcattccaccaccacaagaaagtcaagcctgatgtccaacccaa

SEQ ID NO: 64891 - DNA, 1219 bp, Oryza sativa
accactcgctgaatggtagctgcatcatgagctcgatcatagcggaggaactgtcattctctgaattttctgcatctctaaacatgcctctgaacacttcgagtttgtgacttgtgagctctttggctttaccactgacctcttcaccaacagtgcgccacttgtgctgcacttgcaagcgcgcacaagttacacaacgagtgtccgtttcagatcagatccaaactgtccatggatccagcggccggtcaaatcgaatgcacatgcacatgcaaaacggatcttcagacagaatcatgggctcatggcctcatcatcatcgttctcttaattaacttgggttaaaatttttatctctctcgcaagaatgtcccccctaagagaagaaagatatttagggtatccttgtttgctccaaaaagaattagtcgtcactaaaatttgagttttaaacataaatttggagttaattttaaggtattttgaacatagtttctttttaacattgattattaaatcgctaaggacacatcatatacaattctttatttacaaattattttttactaataaattatttttgatttataatcagcatttgatcaacacataaaggcctgtttggggagtttgctgtagcttctcccagaatcagaatctttcccaaacagtataacttttgtttcagattttgagaagctgtagttgtagaagctagaaaataaactagaagttagaagctgaaaaaccagattctcaaaggctggctaacaacagcttgtgtagaattaaatgtccttttcgaaccacacgtaccatgcctccatttgaatgcaagtgcaactatgcatgttcatgtgaagagatgcatttctctatgagtagttgtatcatttttgttttcttgtgagatgccaatcaataacaaaatcgcagtacaaatatttgctggattactgttcactactcccatcacggcacactgattcacagcacacagtacaccatcgccaagctggcaggcccgggcccaccacccccctccctccctccctgcctcctctatttgagagagccggaggggttagcgggttacagttgtagatgcacccctggaaaacccaggtaattacgaactagtccttctccagcccggcgacgcgggggaattttacagataagccctcggattccttccccctattctccgctcctcgcg

SEQ ID NO: 64892 - DNA, 3136 bp, Oryza sativa
  unsure (1)..(3136): unsure at all n locations
actgtatacttatgtttccattcaaaaattgtatccacaaaacatggtccatttaaatcgaagtggttaacggcttcccttttcagttctggaagctggtagcgttcttcgcaactccaactatcactcctgcgctatttggtggtggcctgttgggatatgtgatgtatgactgcactcactattacttgcaccatggacaaccatccaaagagccagcgaaaaatctcaaggtgacaacttagtgccacttataaagctatagattatctagctgttccaaccaaagtccatgaggcttgtattccttacaacgtttgctcgttatgcagcggtatcacctcaaccaccacttcagaatccaaaacaaaggctttggcatcacctcatcactctgggattacgtttttgggacattgcctccgtcgaagaccaccggaaagaacaactgagccactgacagaaatgtattgttttgcatgagaaattttagaggatatgtaatatatatattaagtctaggcacaactgcttgttttgtctttctgggacaacaggttcacatgcccattcagttcgaattcctgtggtttactgatgactgccttgatgtgggtgaagaagacatttcattgccttgacatccaatgttctgaattcagataataggcagttcttgatgtgatccatatgccatgttaagcttagcaattctattggcatgtccaattacaaaatgtttgtcttttcttaggattttttcccctcaatcatcaaagagtatcagatactcacagatgcgagatgccgttttctgggtccccgtcatgcctgtcatgatttttttttgatacgcctgtcatgagttgtctggcaactacatttcggtctaaaggcaaaatgatgtttatgtaatcatataagtaataaagaaatatgaagtattattttggaggaataagcatactggatagccctacagatttatacaggcgagaaagctactcagaagtcaaacagctatgacaaaatagattactagttcctgaatttctgtcatggatatgccttttctagttttcttcctttttctttgcgaggacatgcctttgtcatggatatgccttttcttcctttttctttgtgaggacatgcctttttcttattaagcgagccaagagtctaaatgcaaattctgacttttgtttcatgaaaaatatcagacatttttttttacgtaagaaggtagagcaggctctaccttatggccatttcattgatagaaatgaaggattacaagattttaacgaagcttatagaggaagaagaagaaagaggaaccagaaaaaaaaaagaganaccagccaaacaggaataagagaaagagccgggggttaggacttaggattgtagaatttacagaggtatatacaagagcctcttcctaaatctcgagcaccaagagataattttctgcttgattaactcgtttgctctttttcatgaaacgttagaacgtggcaaatacgaaagcagttcttgaagtcgcagcagatcgcacatgaaatgcagacataaatttaacacccagttcagctatcaatgagtctttgcttatcaccagatccccggttgagatgaacaataattccattcattataattccagatctacagacagttggggcgttggaagcacatgggaaccatctagttccagttcagatcttcagatgcccctcatgaaacatatttcctcagatgataaacacactacctccttttcaaatgtttggcatcattgacttccgtacaacgtttgatctttcgtcttattaaaaaaattagtacaaatatgtaaaaatataaattaagattatactttatttgatgataaaacaagtcacaacaagataaatgatatttcactccttttgttttgaataagacgaatggttaaacgttatgcgaaaaatcaacaacatcaaacattttgaaatattgaaatggagggagtagtatgttacaacagtatccaataatccagcagcaagtgaaaaaaaaatcaatttagccacagtaaaactgtgcctattcaaattgagatgtacaccaaacaaaaatgaatctgccaaattcgagacagaattgcgcttaaaggaaaagcaaacagaaactagagttttgtaaatcgacacaatgagttggcgaaacttcccaattttcattaatatataaacacaagtgtcccgcatttggctacattgcaaaagggcgaagcccacactacgaaagctgccctagatacaaggaggctaaaaggcgaagggcctcacacctctgggtgatctgggccagctgcgtcagcttcaccgtcgccagctttgggctcctccgcggcttcttccgcttcgcgttgagccttcgcgctcttctccagttggtcgcggagatagcccttagcgatggttcacccctccttctgccagtactcttttcgccaagcgcgaagagtagtagagatggggtacgacttctccggccaatctcccttgacgaactccgggaattgggcgacatgttcgcacccattttcctggagcaccccaagcacgaaagccgccgaaacccgagcacaacaatcaccataattgctgccggtctcagccacggcacctccggcttgttgtgtccattccgagaagtccagcgcggaagcatttttgcctggaacgcctttggcctgggcgcccaactcatgaagggcaagccggagagtatagctggccgacttggccgaatctgtaatctcagcaacggagcgggcagactctttcgccgtggtttcggctgcggcctttgcctagtccagctcctggcgaaggctgttcatcttcccctcggacgaattgtagtagtccaagagggtagcgttctggtgcttcgccttctccagttcctcctttagttttttgttttcggccttagcctgccttagggattcggccaccacctctcgctcctggttttttcgaccaaggtctccctcgagccgacgtagacggtccttgtacccgtcgaggcgggcccgaacggactgtccatgttgcagtgggctaaaagtgcctagcgaaga

SEQ ID NO: 64893 - DNA, 3236 bp, Oryza sativa
gccgccgcctcttcgctcgccgccacgtcgccggccgccggacgtcctcctttcccacgtcgctccggcgacctcttccccacccgccggccggctttgccacttaccgctggatagggatgatgacgtggaggaagggagaggaggggaaagaggtaaggatgatgacgtggcacgctgacatgtggggcccatgtgggtctcactaaaactaggtttaaaacctaaggatctcgggtgcactttttcctttgcaaatttcccttttcctgtactccacatgaaatggcgctaatgcttgtgctaagccggcccatatactatctgcagttgggccatactagctgtggaggggtttccggcccatatactgcctgcctagtactctcacaatcacaaaacacaagaaatttcatttgctcctctggaatctcaaatgccaaaggttcaaaggtatagttcgtgcctctgaagtctgaaccctccatcatctagaatgtgaggcgaaggttcaaattcagtcttcagatatgattgcttgtttcaattactagctagctgcagctaatcctaactcaatctaacagaaatagatgcacttggactacaattcctttattaccatcatcatacacaacaaccaatattcccttcaagacatacagatacaggtggatgagcagcattctgatcctatgatcattttaacatatgctcacaaacagctatggacgtatactacaatctgaatataaatcaactatggacaaaagcttgtgaagcagcgcaaaacggaggtaaggtcgcacctttgttacctcggtcactttactatatctttgaggagcatgtgtggaattagatctctgtggcttgagctgctcgcgatcccgctagggctcgttactacgtctggtgtggtttgatattcccaggtttccatcctagttcacgagctctttcttcccacaaagcagtcagtttcctttgttcaaccaatgcttctgatgatttttcccgggcttcttcacatgtatccatacctgaactgcatttgtcagcctccttttgatattgtgaagctaattttttcgcctccagcaattttacatctgcttgctgctgagcttgtgttgcctcttcttctctctgcttcagttcttctatgagtagctccgtgaaactcttctctgtttcttcaccagacgcacggctcttaacatccttgaattgtttggaacagtctgcaaatatcaaaagtaaccacaatcagtgaaactgcagcctctaaacaactgcaaaacatgtctataaaagataaatttcaaaaggtgattgtcatgtttattgcaagcttagatcaaatgaggtaacaatgttcattgtcaagataatgattcagggaagaattagagttgctacgatagaggctaaggtcactgaaacaattctcatgaggctgtgtttggcacagcaagttcccatctcctcccctcgttttccgcgcgcacgcttttcaaactgctaaacggtgcgttttttgcaaaaaaaaagtttctatacgaaagttgcttaaaaaatcatattgacccatttttgaaaaaaaaagctaatacttaattaataacgtgctaatggaccgctccgttttccgtgtgtagaagattggttcctatctagcccaagcgaactcagcctgttaagcctccaattctttttggactttgttatttcatactactactaggtattatgaatgagcagctaaagagtttcaaacatttgttatttcatcaagaatactcacaaaagtattaaacctttcatttgttagaggagaaacctaaaagagcactacaaaactattcttccttgtcattcatcatagcccgaatcgatgtaggagaaaaggtaaacacatcacaaaatatttcctttcgtaagcaacggcagtccatctgacgcttgtaaaaaatcataacactacaacagcagaagcaacgaaacaggtagggattggctcacgttgatcattaagtaacaatcttgtataacaaactaacacccatagtaacaaagtagtatccttttttagcatacccacgagctatatgttcaattcaatcttgtccagcatccaactttctttccaccactaaaatctaattgagctcctaagtaactccaaaattattttctccctcagttttcagcaaaatcttaaagttaagtggaacagattctgccaaacaatcactaattcagccatcacaagcccaacacaatttttttttcagacaaggaacgctaaactcaacaacatagagaagctacagatctccgaatctacacgctcatatcgtgctacttggttgccaacctatcatcaactaaactaaattcctttgcgacatgtcaatagcaaaatgtaaagctactacaagaagccgcgatgctaagctctgaatactaaagaaaagaaggaaagcacaaaaaaaaaggaatagagatatcggatccgagcagcgggcgggtaatggctggatgaatgagctcccgcatgtcaacaagatctgggaggagagtgagcaccgacacggaccttcggggagcgcgagcagcgggcgggcgtcgcagtcgcagtcgcacgcgggacacgcccccgtggagcggccgagcgcctcgctggcgtgccagtagagctgcgggccgacgatgtaggcggcgaggccgagccccagcagcgccaccaccgcggtcaccagagccgggctggggccccacgacgaggaggaggaggttgagccgcccgccatcgccgacgccgcgcgcgcgcgcgaggatggctgctgctggtatacagttgggtgtctcggcggaggggaggcggcggcgcggggaggttaaaggagtaggagtgtggggggagtggagatggaccggacgcggtcggtggaggtgggatgggagtgtggaagtggagagtgcagacgggcccgaacacgatatgagatgggatgggatcgtgggatggtggtgggttcggcggcagccggcctggacgaacgcagttgtgagttgtgtttgaccaagtcagccaaacaggtaacagggtccaaggtttaagcaaaaagcacaccgaattccgcggaaaatgagtggttttttatgctctcaagtctcaatgtcttggttaccctcaacctattcgggactataacataagtataagttat

SEQ ID NO: 64894 - DNA, 1897 bp, Oryza sativa
caaatatatagttttcttgaagtatttttttagaaattatttatagtcaactattttaaagtttgactttacccttattcgaaacggctgatattatcagctcggagggagtagttggtcacaagtgtgacatgttagctctaaattcgagattgtgatgtatgagtcccaagggtaagaaagtgtggtatgatacagttgtggtagcgaaataaacacatgcctgagaaaatgtagcatgactaaaatgtgacgtagtaaaatgaagcaatcaaccagacaccctctaatcgtgcacgtgcaatagacgtatccgcataacacatcacacgagacataaatccatttaaaatttattgtgctttttcacaatataaatcacacatgaaaaggaaatttttataaaagaacgataacaacaagcagtcaaagtgagatatgttgtaactgcagcttcatggtgagatcataagctcaaagtgttgttgtgactaggggatgcaactggtatggatacttttcgtctgtttagacttttttcgattcaaatttttttatcggaaacaaaaacgaatataataataacactatcggccggtcggaatcagaaaacactctatgtgggaccaggacatatattactattatagagctagttatatgccattcttatttagaaaatatcgtgtaaatataccatgtgacatggattatatatactgctatccagttcatcgctcaattttctacacacctttactatgacaaatttcatagacaatcattcttatgtctatgctcttatgctaacatcgaggtttcgcagtctcgacgaaatctgaatggattctgttaatttcgaatattttgaggcggctcgaaatatgcatctgataacagttttatgtgaaaatagtagaaattcgttcagaattaacaaaaaatatgaatgtctctattgggctcgaaactcacttgccaatctcgaaaacctggttaacatgcgtggaacttgggagtagattttcgacacgctaaggctctctttggcacaactcctaattcaagaatttttttagctgagaatttctggcttcataaagccatggatatccacgattgcgttgataatattttagactaatgtttctattttaggtaaaatttaaaaattttaaactactataatttagtaacatataaattttaaatcaaacacaaataagatatctatacgccatagctatatggtgaatggtcctaggcttcaacgcggcttaggctgtgtttggatccaaactttcaactttttccatcacatcaacccgtcatacacataacttttcagtcacatcgtactaatttcaaccaaaacttataactttggacacagccttggaccgtttcatcgttgccagatcaccactcgtcgatctctatgcaagtggaccccctatcctcaaaacacccgtaaaaaaaaatccaaaatcaattgaggaaaaagaggatcgcgccggccgatacctccatcgtctccaaaaactccaaacccccgcttgaaacccacgacgacgaccaccaccaccaccacggatcattccgccgccgccgtcgccgccgcgcgcctcccctccagtcaacgctagaacccgccctcgacctgccatggacccatctcccggcctccagcgccggcccgcggcggccgcggccgcggcggtgaggggggaaggcgcggagcctccccgcgggcagcgcgtcctccacggcgacatcgacccgccccccagggcgcggccggcggtgcagaagctggccatcgccgccatcgtggtgctcgggtgcctccagttcctccccgccacccacttccgcgaccccgccgatccccagcgga

SEQ ID NO: 64895 - DNA, 900 bp, Oryza sativa
atatctcagcggactcaattgtaaaggtacttacacttctctatatgtgatcatttactcaaaccctgtcattgagttctctgaaaaaattaataattcaagtattgaacctgtataaactatcatgcgagcattagtgccagggacagttccatgcaattgctgatctaattgcttgttcacctttttcaatcatttcaacttgtgatagtgaaccataattctgatttttatgtggaatacattgaatacaaatctaccaagtttcttcaaagacatcactttgcttggctagcattatcagaagttttttttataaaaaaagtcaagagtatggaactaaatctgtgattccatgactggtgcaacagttgcttcaaatagtcaattaggaaacaaaaccctgcatatgtaagtgagtagtaattgagtatattgccatggctgtgttctttgatgaaggacatagaagcttttgagcattgaaatgttgtgtatccaactcaaacatacaaaaaccatacatatgtttgggttaacttatgttaatcgtcaatctcctcccagggaaaaattgaagatcttggtcgcatcgatttaggcacttatgctattgctgctgttgaagattgtaccaagcgcattggtgactatgttagtatagatgttctgaatgccgttcagaaaacagctccgaaaaatttggtgtataccgaaccttatgacaaggatgcatgcttacttgattttgatgtgcttgtggtggagccacgcaaactacggaaggaccttattgattctatcatggtgtggttcagggctttcagtctagccaatccaaggtcagtgactcacattctgtattgggcaacatccaccattgccagatcaccatgcact

SEQ ID NO: 64896 - DNA, 2719 bp, Oryza sativa
aacgccgacgcggccggcaacctcggcgtgctcgacctcgcctccgcggcgccggcgttcgcctccctcgacatcgacgccggggagctgggcgacgtcgaccacgcgcacttcttcctggtggagtcccagggggagctgacatggtcagcctggtgtacgagctcggcggcgccgggatgacggactgcgagacgcgggtgcacaggctctccgagcacgagcagccgccgccgcggcggtggcgcagggcgcgcgacctcggcggcgggcgcgcgttcgtgatggctccgtggtatttcgcggcgtcgtgcgacgccggcgagtgcgggctggaggcggactgcgtgtacatgttctacccgggggaggacgcgtgcgtgaagatatcgagcgtgagagagcgcggcggggaggagttcgtcggacttccaccggcgaacagagcgtcgtggattctgcacgttgatccatagtttcagcttggaattattaggtggtgtttggataattttagtcactgtcgtatcagatgattgacactaattacaagtattaaacgtaaactaatgataaaactaattgcataaatgagagctaattcgcgagataaattttttaagcctaattaatccctaattagcatatgtttatataggctaatcatagaatgagttttgtcgcctacgtttaatatttctaattagtgttcaaacatccgatgtgacaataactaaaatcaaccaaacagtcgcttatacttcatttatgtttggatttggccagtttatttttcttctcctttttgatattgtagcatactagcaaacgtgcttgtgggatgcaacgggaacaagttcatggttgcaatcaattactttcttccggttgcacctgttctcgaattagttagtaggtgatgatggcaacatgatgaagagtctatttgggaaagcttgtatcagaatccgaagctccccaaacaatctaatttttagtttaaattctgataagttatagttgtagaattcaaaaaataaactaaaagccagactaaaaaatccaaccttttcatattttgacaactctatattttcagattgtagcaactctacttttccaggccttgtttgtttcaacttagaattattataatatggattattagcaataatttgaaacaaatatgtagattattatgatacattattataatctataagctagattagtataatatgataatcttctctaaatgtgccttttcagattattaggtggctaaagaccattaccttacccttaaaagttttatgcaaattacccaccactgccatcgaacccaattgatcgagcacatccgcttcctctgatcctctctccctagtgtgcgcgaatccggtgcctcccccggccgtgtgtgcatccgcttcctctctccctatcgtgcgcaaatccttcccaagtccccaccctgcgctgcgcaaatccttcccccgagcccccaccctgagcccgactccttccccaaggcgcgtcgttgtcgccgtctcatccgttggagtatataaagtgaattgatcgtctttccctatcagtttaggcttttaggtgcaactggctggtgcatgtagcttaatatggtatcagagccagaggtctcgagttcgaatcttggctggcgcgcaattaaataaaataattgcagcccactctaatattccacgcttgagacttgagaggggtctcgcgtgagggggagtgttggagtatatatcccattccgcaatagctaagggcattaaagacattagccatttaaactcaataatatatgtctccgataattcaaagaaacaaacaactcataacttattataattctgtttatactaatctggtttaataatttggattacaataatcttaattaaaacaaatatgacctcagaatgttaagctccacatactagtacatgcccaaagaagaccttagctttgcttgtcccatcccctcccaaacgaacggtcatatgcgtggaatgcaagcccaaagccgcgggcatcttctagggcaagaggtctgaagccctgagcagagaggtgcccggcggggggcggcgtcacttgccggccggcgcggccttttggaaggcaagtgctcggtactagaaggtcgattattcaactgattcgacatgttctgatgaacttctgatatctgaatatctgatggtatttcagtaatccgatttgatcgactcggagtcggattctggttctgctctccaaagggctgtttggttcgcctatttaagatatcgccacgccacaagggtagtttctcttcatcgagacagatcttgctagatccatataagaagtagtaaagggtacgatactctctaggtgtcgccacagcttgcttgggagatttagagcacgatatttgggatggctcctctccctgtgccctgcctcgccttgcagcagcagcagcacggcccggaatcagtgaagacgacactgttcaacatcttcgagggacaggacatcgcctgcgacatcgatgccctgacgaacaacagcagcaaattctgggtgacgccgcagggttggatcctagttcacgacaaaacttcgctgtccaccttcatgttcagccctctgaatcctgacgagaaggttcagatgccacatctacctgacgacttaccaa

SEQ ID NO: 64897 - DNA, 2525 bp, Oryza sativa
aaaggaaaatgttcagtgtttcaggaatccctgagacaaattttgttggaaaggaaatgttcagtgtttcaggaatccctgagacagattttcacactgataattttagttcagagattgttctgaaccaggaacttcatgaattggactgaaccatggcatcacttgtcacaatttgattagtacagcaagtttgcaactttagattagatattgtttctgaacataatgatatattttttttaaaaaaaaatactgcactcagctgaccaatttcatattgccattcaccagcaaaattttgaggaattgtattccactcttccgggtccaatctttagtgatacgatggctaaatccatcgtcaatttcataacatggacaagtacaccatattaaactttgggcaactgctcaattgaagccgaagagctctaatgatgcttttgtgaacaacagtttgacatgaacagaacaaagccacccgttggtggtgataggactgtttgagtacatgctaagaaatacaaaagtttctattacccatctaaaaattgaatttctgctaccaactttttcattcactagaaaaaaatacccgtgtgttgcaacgggaaaaattaaaattacattaaaatttgggtaattaggattttctatattcatgatctgagcattattcatgcagatgatttgttatcgttcaatagcacttacacaagcatgtgcaatgccggaggtcctgtaacctaattttatcttagctctttggatgaagcataaccgatgaagttaaacgtgtatattaagggagttgattggactttttcctaaataggctacacatgtgcatacaggctccaatatgcgtgcacgtgggctaactgggtcaagtgggccgcaacgcgttgtatgatcttttttttttcgaacgaagaagaattgatcttttgcctccgattccgattacttctgatgtctgataatgttcgtgtcggaatcaacattcctctggcagcagttttcgcctatataagcaccggttttgcagataaaacattaaaagaagagaggaatagaggttgacaacaccacgctgactatggagaacgcaagcccagtcgtcagtgtccctgtgccttgcctctccatggagcaacgcgacgagtctgcagataagcccgtgctgttcagcatctccgacaagaaggccatcatcgacggcgacatcccggggctgaccaacgccaacgcctggttcacgccgcagggatggatcctactccgcctgagcaccgccacgttcctgcagaaccctcaggattcccaagacaagatccatctccctcatctaccagaaggcttgtctaccagatgctcgtgccagctttccggcaagccttctctccccggctgcatcgtcctcgtcgtcgagcccatcgccaccgtcatatggtactgtcgcatcggcgatgacgagtggacgagacacgagtacgacattggaacgttgcccttcgatccacccatcgatggaaaggaccacgatgatgtggcgatatgccagattgccgcttgccatggcaagttctacttcaacggtttcttcgacaccatcggagtgctggagttcaccccaacaccggtgttcagctcgattgagatcgtcgacccgaccccgggaggattaggggtgacgggcgcggcgcacgtctatcttgtagagtccgaggacgaactatacatggtgtgcttgcggattgactatgagtttaccatctacgatatgacagtccacatgatggatttcttgagccgtcaatggcgcagagccgacgagattggcggccgcgcattctttctagctccgttgtacttcggcgcttcatgttcggctgatgagtacgggcttgagaaggattctgtgtatgcctcgtatgcagtggataaatgttttgaggtatccaaggtggaagatgatgaaaccgaggtgcatgatctcatcgatgctccagactcgagaagagggatgtggattttgcccgttgaaaaaaaaatagagatgttaatgtttggatacagtcggaaaactatataatctctatgaaatcgatgttgatagaaattgaaaaattcaaaatttatatatggctagaattggaagcggcatcacttgtacaaaacatacttggttggaaatttccgccaccgttttgaaccctagttgaaaggttgtaaagaagaatcattttccgaatgtaactgatttattatttgtttttgcagtgcttgatgcctgcactatatatgaaaataatatttcttttctttttggggtactttctactgagagcataaatattccgttggaaagaaagggttatgtacagagagaacacacaagaaaatgatgacctttatttttcgattattaaattgataaccaccttggcaccactcatctcggttttaatggtttattagcattatttagctcatattcgtaagttgtctgtcgaaaacaa

SEQ ID NO: 64898 - DNA, 2127 bp, Oryza sativa
cttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagttgggtgttcctacgtgatgaacaaagcacaaattactttgtcgatcagcttctgaagaggagcaaaccctgcagatccagcacatgtacttccttcagaattcagataggcctgattaggcccaaattgggaaaacgtctgtttatgcaagcccaaagcccaaattggcaaaacgtaagcatctggtctctgatttttcatgtcgtgtcaggctgcaattcgtggagcttcaggcagggattgctgtgaccgactcgtaatccaccgtttgtactccgcaacatctgaccttgtgactcgtctgcaaccagctagcaatcccctacataagagaggcttcggttcggttgcagatccaacgaagaggataggagatagatcagccttgatcaccatggacaagacgagccgtgtccccgtgccttgcctcgccctgtacctaaagcatggcgccgacacagacaagccggcgctgttcagcatctcggagaagaaggccatcaatggcggcaacatccccgggctgaccaacaccaactcctgggtgacgtcgcaggggtggatcctagtccgcgacaccgtctccgcaaccacatttttgcagaatcctcgcgatttcgacgataagattcagctaccccatctaccccaggacgtgcacatcagttccacatgtctgctctcctgcaagcccacgatgcctggctgcgtcgttctcctcgttgagccagtcggcactatcatctggtactgtcacattggagacgacgagaagtgggtggaacatgactacgacattggcacgcaggtcttggaccctcccttggatggcaaggaccacgagaaggtgccgatatgctggatcgccgcttgccagggcaagttctacttcaatggcggcttcgaaagcatcggcgtgctggagttctccccctcgccaacattcagctccatcgcaatcatcgaccccatcattggaggattaggggtgatgggcatggcaagcctgtacatggtcgagtccttggatgaactatacatggtttgccaaatgtatgactctgaaatgaagaccatctacgatgtcactgtttataggatggatttctcgaagcagcaatggtgcgtagccgaggacattggtggccgtgcgttcttgacagcttcatgctattttggtgcttcacggtcggctgatgagtatgggttggagaaggattgtgtctacgctatttttgcgcgtgataagtattacgaggtatccaaggtggaagatggagaaaccgaggagcacgagctcatcgaagctccagattcgaaaggagggacgtggattttgcccgttgaataaagtagagatgaaaattgtccaaatcagtaagaaatgacgtcgtctctatggaaacagagctgatatatattagaatgtaagtcaaaatttatatacggctagaataaaaaacttggtaagttgggaatttgtgccaccgtttcaactttcaaccccgttgaaagattgtaaatgtttttcttttcagtatagctattgtttattactccctctattctaaaatataaggtacaatcacccttaattcaaagaccaagaaacaattattaccacctctttatttgatcgatccatacatgcacccaatagaattaaacatcttgtgagtgtatgatttaaaaaataataatttaggagagaagatatgctaattaattgtcatgcatgcatgcacgccttatattatgaaacacctttaaaaagtcg

SEQ ID NO: 64899 - DNA, 797 bp, Oryza sativa
tgaccccggtcagccgcttcctccggccccgctcgcgcgcgcggtccccccgcgagccatgaggctgcgcgtgggcctgccgcatccgcgtccaccacgaaccgcgcgcatgcaccgcgcctccctccccaaaccctagcacgccccacgtgcacctcgctcacggtgagccaagttgccgacaagcgggtcccactcgggaccacgcgggatggacccgacccaccggctctctctctctctctcctccccgcccgcgcgcgcgccttgggccgccttctcgggccggccggcccattaagctcggtcgagccgcccctttctctcgggccgcgccctagccgcccgagggaagtctaattcccttccctctttcttttcttttcttttctcaaaaaggatttaaataaatcctctttctttagatcaaaaatctaataatcttagaaattcaatatctcctcaaccgtatgtccgtttgactccgttcaacttccaaaattcctcaaatcttgagatctatctaatggcacgcttagaggtcaataatagggctttattttcgctgtttgttgagttatcccgttcggcgtgtagtttcggagcctgaagacccgcagtgcgaggatttcgaggatcaagctcaagatctcgagcaaggcaagtcacctttgatcagcttgcacctataaattaaatctaagtatttctttttgcaaatattgcatgaataggattaacacaagtaattcggccgcggcttgcgagatagcccgccggcccccaaacctaaattg

SEQ ID NO: 64900 - DNA, 2906 bp, Oryza sativa
  unsure (1)..(2906): unsure at all n locations
tacaattgatgatcctattctgttgtattaaaaagtgagtagtgaaccttggtgccactcatctcaggtttaatggtttagcattatttggttcatattcataaattgtctgtcgacgaaccaagtagtggattcagcgcaaacaaaataatgaacctagcagaataatgccacattaaatggagcaccacaagaaaatttgttggaaagaaacggttcgttattatttctcatgttgccgaggcagatttttgtaggcagagggaagacaagacacatgaacttgatgaccttactcaaagcatgagtgaacctgggcgccacttatatcaagtctactgattcagcattgtttagtttgtaagttctgttagaataaccaaatgcttgattatgtggaaacaaagtactccactgtacctagcagtgtcaacttccaagtgtcgatggaattatctgtcgagatccaacttccatgttgaagtaacaaaattaacatatccacttgaacctgtactaatttgtaaacatgcataggccttaaaattatagtcatgctgctatgtgtttgttcctgttccccctgaatggtttgagcattaggacattaggtgtgtctactggacaagcaaagcagcaattttcctctttttttttttggtcatctacttcagagttcagaattcagcatatccaacttcagaattcagcacatctaatttcagaattcagacggtgacagctacaagaaatttgcactcgtcgacagcccaggtcctgaaactgattggtagtagtgcattacaatctgaagagtgaatacatattttaccagttatatatcaattttaattccgttcaaaaaaatatcaattttaacggtttaaattttgtccaaagtttgttcaagccagggttcgattcctgaactcctcaccttccgcctggattaaatgaagggttggaaatatgtgactcctcctatcttaattccattggatggctagctccttctaccatcccaaccttttgttcaagcaaaaaatccttgtcccaaggtaaataattctgaacatcactacctctgaataatggagtgattggggattggagaaattcagatgagaggctacttaaattagtgcacatttggagagtaaatttgctctctgaaataatcacaatcacaaaaagcaaaataaaatgtatcgaatccttgtccttattacaaactgaacgaagtgagtaaccaacatcaaaattcgcagaacagacagttctgcacgaacgagcagcgtgggattagatcaacgccaagaaggcgcaactgcgatccgatctcctccttcctcctcttgcggttgggtgggctaattgcagagcaagtacctggtgagcacgaggacgccgcaggcggcgctgaaaaggaggaagacggcgaggtccctgaccgcccagcgcttgggcctctcgccgccggcgccgcccttggcctcgacgagcaggctcttggcgcggcgcagcgcgtccacctccttgaggaggtcgaactcgagccccttccgcttgagctcggcaacgcacttgctgagcagcagagcgtcctcccgctcccgcgccagcagccgctccagcgccgcctcagtgtccgccttgtaccgcagcgcccacagcatggccagagacgagagcaacgtcacgaggcaggggatccacgagcgccggcacgccgcggaggtggaggcggaggcggagagtaagaggaggaggatgtaggcggcgtggaaggcgaagaaggcgcagtagaggaaggcgatctccttgcgggcgccgtcgaggcgggcctcccgcagggcgacgcggcgggcgagcaggtcctcctccttgagccactgcttcagcagcagccggtgcgtcccgctctccgcgatctggctcagcgggtgcctcgccttcgcctgccccgccacgacgagcgcgtcggccgccatggattcgtcgaggtggtttcgcgtgcgtcgtgggggtgaggggatttggttgcggttttggcgtgtttgtggggggtgtatttaatgtgggaattttggctggggngagtgaggctggnnggaaanggtnnnggtgnacatgtcggctcttcccnnngnnggangnaacggtgggaatcgaatcggtggggtgtggtggaatcattcgggcttggcggtggtcgatcgggtgcacgcgccggctaatggtacgagtatggggggggngnnnccccgggcggtttcgcgaaagaagngcgattttgggctttcggtctgcttgtcgcgttcggtgtgtgactgtgaagatgacgaggcctatggagcgcctacgagcgtcgctctgattatcagggaaaatatcagtccatgtcatcacgaggaattttactagtagatttactcacgagtaaaaattttagtgagtggtgatgtggacgaatcttagacgttcatttttcgattcaacagtaattttcactacatatatggtttgcagtatatattttcccaattatcatgacaaattccccgtctatgcttttgatgaatattgtcaaccaccaactcataatctcatttgtttgctcatgtgttctcatatcagtatgtataagtatccaatggggatttaggccatttctgtggggtcggctgaccccacagctttttgaaaaacatcttataaatcttaattttcatgtataaatccaaaagaatttagagaatgaccccacttaaatacaaaccactagtaattgacctcacagatttaaatttctggctccaccactgtaagtatccacctactcacttctatctatgtactggagtagtccttaatgcatatatatctcctcctctttggacatcaca

SEQ ID NO: 64901 - DNA, 1212 bp, Oryza sativa
catattcgttttggatgaatttcaaacgatttggtttcctaagaattaatttctataaaagccattcaattcattaaatgtagatacagaaaaataaaacaaattccttttctacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagattagagaacgtagtaaaggaggaggaggaggaggagaagaagaagttgcaccggaaacagttgttggaattttcttttctttcttttttttatgtttttgagaaggcagttattggaatgctgggtttgagtgccggggtcgacggggtttgggccgcgatggacgtcaatacacggcctgccaaatggggggggggggggggcgctaatgggcgcgtacgcgtcagcaatttagctggcgcgcgtcagctcggccgcctcccgtgcctttttttttttattttcctattcgcactttttccgatcgcctctgagcatgttttttttcctgtttctttccgatttttttcaatctttcgcacacctctttacgaatgtagaattgaaagtttttatttttgaattaaaagttattaaatctttacttgaaagttttctaattttatgttgaaagttttctaatttgagttgaaagtttttaaatttaatttgaaagttttcaaatctgggttaaaagtttttcaaatttgagatgaaagttgaaagttttcaaaatttgacttcaaaaaaaattcaaatttcgagttgaaagttttaaaaattgagttaaaatttttcaaaatctgacttgaatgttttcaaattgaattaaaaatttaaatttgtagttgaaagtttttaaaattcaagttgataggttttgaatctttaagtaaaaaaggaaaataatgttgtgtgaaaaaaagaaatatatcttgattgaccgtgattattagatctaatcacgtaaagcgcagctaatcactgttttttctcatgattcctgtgcacatgcagcgtcttcgcgaccaaaaaaagaagaggaacgacggttgccacgcgcgacgaagattaatgggctgcgcatgagggcgtgggccgca

SEQ ID NO: 64902 - DNA, 2314 bp, Oryza sativa
ttggttcaatagtgattaaaaataatttgtaggtaaaacttttatatgtgtattacgaaaagtaaattaagaagaaaaacttcaaaattcacgtgtccaattgtgtttataagccgaaggctaaacagtagatctgaatttttcgtttctttgtgctcgcaaccaaccaaattgcaacttacaagcctccaatttcgctgttgtttgactgtatcaatgttgttgtattttgtgatatagatgatcctgagccaggtaaggatatctcgggaaaagaatgggtagagtcggacgaagccatatgggccttgtacgagcgctggtgcgaggcttacgagaaagagcgtgaccatgctgagatgactcgctggttcgagatgttcaagaacaatgcagagtatatttatagtctcaacagtgagattacttcggaagcagagcaactaattttgggtccgtactgcgatgggttcaacgagaaagacaaggctgaatttctgaatgattttggccattttaacggggttcacgaatttgtagagtagcggatgatcgactcccccatgaatcgcctttgatcccccatgaactgcaaaggattgaaccacgactgtttactcgggctggcgtcaactatacattgtgattcagcattttgtataaaaaaataaactataatatactcccttcgtcccaaaaaaaaaaaactctgagtttccgtgttcaattttgattgtccgtcttatatgaaatttttttataatttgtattttcattgttgttagatgataaaacatgattaatattttatgcgtcacttgtctttttaatttttttcataattttttcaaataagacggacggtcaaacgttagacacggaaaccagagtttgtttttttaggacggagggagtacatgttggttcatcgactcttcagagtaatcaaagttcctgcagtgaaagtgacaaaactttaagcacagataccagtttacagctcaaactgtaagaagacgcatatgcataggccttcgcaggcttaggtatgtaacatgactgttgatcattagaaaccttgtgctggataacatgttcaggttctcaacaaaatttatgttcagacagtccagatccttagccccagtcacaggttcctcaaactggcgcggccgtcggcttcggatcggcgttggcggcgcgctcgtcggctccggggaggccgatcggatcagagatgcagacctctagttcaacatactttctcgacacctctcattccgagaccatcacttgatgtatgtactacctttcttagtatcgaactaatcttcctcatcgttcaagcatggctggtctgagcccgtaattgtaactatcagtttgggcaagagatctgcactactgaaatttgttagagagaagttagctcacggtggattctttatatataagtataataagtagacgagatataatgggttctaggtgatatgtaatgtcgctttattatggcccaactttttgacataaattaacttttaagccaaatttcttatttttgtacgatttataaattggtggcttttaagcctccctatgggtgaagttctagctgcaacccacctaaaaagattactcaaagtttggcttaataatacatgaatatttatagattttaagaggcttttaaaaaaaacggtttgcttgtttggttctcctcgtatattccatttttttttctaaattcaatgcaaatggtttgttaacaacgctaaaacattaataactgtaattcaatgcaaatggatttcaagtttttttattctctaagctagttgaggtacatttctattgataattgaagtgccacttttacctcaaaaaattaaagtgccacttatgctttcgcctcacggtcctgtgcttgcaggctaagcgaaatctgaagaattgcatcgatctctatccaaaaactgtaacgccagttggaacacaatggtccaagcatgccatctctggggacggggggttccagttgtgagttgactcctaattctctgttaagttgattgtttcccagtctatgataaagaaaatcataaaattaatacacagccttcaaaaaagatctaccacgcacaggcgttcaggttgatggaatttgccaaactttctatgatgaacagctcagaattcccatgtacttcggccgtctctttgcaacacaggaaatacacaataagtggctgccacaattcatccatgggtcatactatacatgcccgttttgttgtaacagcacagttgatgg

SEQ ID NO: 64903 - DNA, 1025 bp, Oryza sativa
ccctgttcctactgatcaatatctacagtcatagaatcctgttggacttggatcagccacctccatcatcctcgcaatctcttccaagtacccatccttgtagaaatccgcggcggcggcggggaagccatggtcgttttgatggaaggcgatcgtcatcgccggcgagctcagaggcttctgctccggctccggcttcggctccggcggcgccatttgtagggagccccattgactatgaagcttgtggtggctgtggctgtgatggatgccgtcgttgaagaagtagccgccgttgcagctcatcgtgctcatcatctgatgacggccgccgtgctgctgctgctgggagatggccggagtcaggccgcagttcatgaactcgtcgccgccgccgtccgactcgaagctgccggtgttggagctcgagtcccccggcggtggggccttgacggtcaccgtcgccggcggcctccaggcctgctgctgctgctgcttcctgtaggtgatgcttctcttgaagattctgcagatggtccagacctcctgcatttttttcagtcagaagtgcacaagttagaggtcaatgctattaggaggctgtactcttatcggttagaaatggcaatcggtagaatactagaaacacgtcagaacgtgagaggatgtccagtactcctttaaaacgtgggaatttcagtaggactttcacatggattagttcaatttttgtagaattttcgcaaaatttcttcgttcaaaaggaggcctgtaatctcgaaagaactgctgaacttagcttgaaaaaaaatattaagacgatttggtgatgtaaagtattgcagatgatattgtactccacactatcaaattgtacgtagttgtgatctgtcacagatgaggagaaccggatatggatatggtgtgtttggttgctcgtatccctctagtctgacccatctctctcgtccaggttgagtctgggtaattctccatctctctccaggctgagtttgggtaattct

SEQ ID NO: 64904 - DNA, 4587 bp, Oryza sativa
  unsure (1)..(4587): unsure at all n locations
catttatctactgaaacctgaaaaagtgtactccctccgtccaaaaaaaaaggtcaaaccctgagtttccgtgttcaactttgacggtccgtcttatatgaaatttttttataattcgtattttcattgttgttagatgataaaacatgattaatattttatgcgtgacttgtctttttaatttttttcataattttttaaataaaacggacggtcaaacgttgggtacggaaatcagggtttgtcttttttttttggatggagggagtagtctagtctgtgattgggacccaagcaagcatacagagagcaataaaagtataaaacacaatacaagaagtaaaaagaacaaaaaaaattccaatcaaactaaatttcatcttgagatttcgcaactcgcgctgatacttttgagaacatctagaaccttccacacacagttcattcccaattatttccccctatatcgtatttgagccactatattggcaaaattaacaccaatcataatttcataataatccatttcacaagcaacactttattaccccctaaaatcgctcccatccagtgagagagagagagagagaaaaaagagagagataaagtgataaaccccatcttgtgttaatcattcatttccaattttaaagaaaaagcccctgaaaaaggctcacgcggtcgtcgcaaactccgaaggcctcgattttcttttccctcgccgccgcctcctccgcctcgattttaaatttcaaatccccaccacctcctcctgcttaaaccttcgcctcctcctcctgcctgccacttggggcgcagttgctgctcctcctcctcctcgaggcggatgaaagcttcgccccgcgcccacgggtcggcttctcgggggagggcggcggcggcggcggcatcgcggtgaggaggaaggggaggatgatggggtgcatgctctgctgcttccgggtggccgggtacagcggcgaggggcgacgcgaacgtgaacgcgaccagctggtttcgtctacctccgtttcgccgccggtggacgctcccaaggtatgcggcggcggcggggaagctggtggtggggggtgtgttgcggggtgcttcgatttcggattttgggttgattgtttgtgttgtgtttcgtggtgaggcaggtcggggagaggaagaggccgccgtccaagaacgcgctctccgctgtattcttgcgagaaggtacatttctggagagtttttttttccctttttgcgcctctctttgaacttattatcccgatcatttttggattgtgatgtagcgattttgtcatttattcgtgctgatcttttttctttttttgggtttgtttggattttttttgttgggtgaagatgaggggtcgagggttgagcatagtacgagcttgggagcgaacgggatcactgagaggacgaaggtggatcaggagcacaagaacgaggtattccgattccgcataccgattcaccgctaatttcttcccattatttatcatgactagttcttcgcccttttgaaaatctcactcaagtatcatgccacttgagccagaatttggatgactgacaactagtatccccactgtgattcgtagtcaaccaaggaccttttgatcggttaactatattatattcgtcatttttctataaaacaacaatgatgaaggagcattgttctctaggtggtagatacttacatgttactctaacctcaaaaagaactaatatatcccttgacccttgtggctgttgtttatctgttagaattgtgcgaccagttgtgtttctanattgggaataacaacttgttccattggtcttgaatgtacgatgctgttcataggtcatacccaacctatctacatgagaatttgaatttgttgctgtacattaggcaatacagattacagagtggaggtgtaataacgatttttttatttgttattccttttccagtaggtttgattttggtagacagactgactttcaccggtgtcaacaggtccgtttgctcatacaccgtgatgcattggtggaaactacaaatgaaatcataaaagggccagaaaatactgaccaaagtcaaacacatttgacatgtcttcctgccatttctgatgacttacaattcatggaagggctgaaggctgaggcttgccccactccatcagggtctcatcagagctccattttacctgatgctatgaggtatgccaaccttgtgctattcgctactaatgccaatgccttcatcctgttaccaacttctgatgaggctggtggcttcctttttgctgcaatgactgaatagattaatttaatatttcgatggttctgcttaactatgacagttcttcttggaaagagtgcgatgcatcaaaccagaatgattctgaagctgtgtgcaagagcatagaagttgaggttgtgggcaatgatgacagtgcaatcaactgtgggaacaagttacccgccttagattcaccgtctttcacatgtagggatgatatcaacctggttgaatccaaatctttacccatttcaactccttcagaagcgactgctgagatacagacaccagctacaactcatgcacctgaccaggaagagctgagaaatgagaacaatactaggacttgttcagagcatacatatgaagctgtgagttctgttgaggcctctggaagctgtgaaaaattgagactagaatcctgtcagcccaatatatcagatgaggatttcaagtatgcaaagaatgacagtttggtttctgttgaactttcaatatctaatgaatgttccctattccagagttctgagggttcagtatcatcctgtaataagagaagagagaattcaagcacagaatctgtggagaaatgtcttaaaagtgagccgctagttcattccagcagaaagaaggtgctcaaaggaaatgattctgaggttgaattcccaagcttgtcacagtggttaaagcctccaaatccaaaggtgttcagggatgagcccttgacaagtgacagatctcattctgctaagagttcagaagaagataggcctattattggattggtcgctgctcactggagagacacagaaccagatactttcactcctaaatggtgggatggaaatggcattcccaactcaacaaacaaatacaaagaagtaaagtctgcttctgcttctcttactttctcatatgtacatataaaaatagcttatctatagtttgttacataattaggatcaaaaggtgagttggcacgcaacaccattcgaggagaggcttgagaaggctttatctgatgagaaattgctttcacaaaggttcgaatttccttcgttttatattaaattacatggtgatcgtactattttatccacatggttgtgtggtgcgattttctttctcatttgatgattttggcagaaaatgctctagtggaaacacatctcagctttctgggctggaaggagaggaaaatgatactgcgcatctacttctaactacctatgtgtcgctgctattacatgatatattcatccaccaagaggtacttaagcttctggtatggtatggttttccgctgccatcttcctaattggtgtgttttgcacagtcctgcttccctctgctgtcctccagcaggtactagcctactaggtagtccccagaaatgatgtttctgtcaatttctttgtattaagacaattgtattttaagaaaaatcagcattgctgatttcaaatatagctgaggtgtgacattctgaactatgctgctactgctgaatcatatttctctccttttgcagtggttctttttagtgtaaattgcggggtggtttctgatatttcctgttatatattcatgttttattccagctgattatttgtcatatgcggcacatcatagataaatgaacacacatacctgtttgtcttcagaatagatgcaaacagaatcaaacaacttttttatcctgctgtgtactactccattcgtttcaaaatgtttgacactgttgattttttagtatgtgtttgaccattcgtcttattcaaaaaatttaagtaattatttattcttttcatatcatttgattcattgttaaatatactttcatgtacacatatagttttacatatttcacaaatttttttgaataagacgaacggtcaaacatgtgttagaaaatcaacggtgtcaaacattttgaaacggagggagtatattcgatggtgcctttgctcaatacaaatttgtctttttaccattgtgtcaccaattctgttggttctgttttggactgtttctagtctatcactgctagctcaaaccattttattaactttacatctaaacacaactctagtttccttggtcagagaagccacaaattctggttgtccgcttccatggttatcctaacacattaaatatcacacataaatatttcgtatggctggatgttttctgttcatgtggtatggctcttagtgccattttagcttaagatggtgatataattttccgggaagtcacatgggtgcagg

SEQ ID NO: 64905 - DNA, 805 bp, Oryza sativa
ttttacggtccaacagcctgggtaggtaccaaatctacaccattcatttaacttgatcggatggctgagacagattcagtaccgggcagtaccaccgatcgattccatgcagtaccaccgcctgaagggcattttcgtaatttcgcgtagcctcagttcagatcagatcggctcagccagccgcctgcccgttctccatcccaggttctgagcttttttgcagcggcatcaacggcgtcagcccacaggatttgggccgacgacgagctacaggatttgggtcggtggtaggctgcgggatccgggtcaacggagtgcacgaagccgacggcggcggcgatgggctgcaggatgcgaagcggcagcgggctgcaggatccgttcgagggtgtgcgcgaggccggcgtcgatggcggatgggggaacctagctggcgtcgacgggctggcagggatctggccgccggcctctgtggtgcgcggcggccggcggggccggcgtcgagggcgacggcggcctgaatgttaagtcgacctgacaatgtttccaatcatgcccacggtaattgaacggtgggatttcatttggtacctgatgtaccatctgctggaccgtaacaaatctcatgaaattgacatttttatatttttttccatcgtactatctattgaaagcatgagaagatatttcgttaaaagaggggactatgtacagagagaacacacggaaaattgatgacctttattttggtttattaaaaactgagtagtgagccttggcgccactcatgtcaattgtagtaatg

SEQ ID NO: 64906 - DNA, 705 bp, Oryza sativa
cctgcagcccgagaagaaagaaaaaataacaatagaataaccagctcaaggttgataaattcttaccaataggttttggtctcaatgtggaataggaagcggtgcaaagtatactcgatcaatgtccaaatgaatattccaaatagggccattagacctacttcctgaatagtatgacccatccgaatagatttcacaagcaaccagcagacgacaggcagccatatggttggcacagcaaaccactttgtgcgcgtcaagaactggacacaaaaagttatgttatgacagctcagtttacaaaatcctaaataataattggaatgtataatacctccaggacatcatttccgaaaaagcgtggaccttccttgctcacgataggttgatgaacccattcctgataacgttcctcaagatggccaaccttcatcaaattcacaccacaaacaaatgttactccaaatgcaaagcaactgaactagttttacttagaatccagaattttacagcgcattgctagaaaatcagaatttgacatttgagcaactgaccttatggtcagaaactaagaattgtatgcaagaagctaaaaaacaataagaaggtgagcatggcaacggtatgattttcaaggacaagtgacgcaaaaaaactattcgcaaaagaccactgatagagagcaaatcaaaacctggaaaacga

SEQ ID NO: 64907 - DNA, 2123 bp, Oryza sativa
  unsure (1)..(2123): unsure at all n locations
ttacaagtgggtcttaccttatcttcttttttgagattttgcttttcaagacgtttagagcgcctttccgaaggttgctgcagtggttgccaattcatgaatataagaaaatacaacaagatggcataaatgaaatatctatgtggaaccaatatagaattaatgtatagtttgtgcagcagatgccaagaagtgtcacagaatacacagtttgttttgatattaaccccagagaagtgaacaattacattggtatgcaataaaagatttgtgtattgctaataattcctagttcagtaacaaacacaaactgtgcaaactacaaatgaagtgatagtgcattctttcaaaaaaaaaaaggaaatttatatgccagtttgcaagtgagtatatcaagtgcagtgagttgtaaactgagttgtgtgacctctaacttctgaggtactaactgctagataccagatgtgtactattttggctcttctcattggctaattaatcacgtactaaaatggaaaaaaaatacaaacagagcatcagcaatatccattagtaacatggaagggaagttaccgtcagtccttcgcttgacagaaatctacctccatcaccacgttttcgtctttcagccaaagcttgatgtgaggcgatctgaaaacgacaagcatatacttaccaagtgaaactagttaaccgatgtgcatgtaccaactactgttggtatatatccagacaattcaacacttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgaacttagttaccnaaaaaaaaattnanaccnnnttttnnccccccctctcttttatgtaaaaaactgacnaccagaaaatgtcacgtatcaagcttcttactttccatcttatcantgttcannnnngcctccttacattcaaannnnnnncggtaggtgagaggtntnnntagttgtcacagctaataactaactccaaatattttaccttggcaggccttgccgaaacaggtctgctctgtcgctttgagaggtacttactaactatcttcttcctctcctcattagtgtactgtgatgccctcaaaccgagttccctcagcacacgtgcctgcagggcattgccctcggcatctgctttcctcggccttcccctccctctcttttcctgcacttccacttgtacctcctcttccatttcctcctccccttcccctttctgctcctcaacatcatcaccatcttgcgccaccacctcgtcctccttttcggcctccaattcgacaacaggcttctcatccttctctgtaacatncctttttnnaagtcctttacccncttncttttttaaggnaanaaaaacccctattngcgcgcctttgccgttatttggactgctgtcccgacacccttctccgcagagctctccacttcgatcacctctgagttatttttcacagggttgggattcctcttattattggcgcccctcnttcctcttgcctgcagcaccatcctgcacctcctccttttcaactcatccaaaccatttgccttgttcctccgattggcgtaatttcctctggagcagaggaacctctgcatgatcatgacgccattaccaaccgatcggcgattggagcccgtgcgcgccttgaaccccaccctctcgccgtatccgtagtagaaccccttggcggcgtgcacggattcgaactccatccccatcaccggcacc

SEQ ID NO: 64908 - DNA, 1278 bp, Oryza sativa
gaggggatccgagggagaccgagaggcatctactactccgagatgcgggtacacgggctctgtgactgacagtggtggcccacaggggggtatggcccgcgtggcagtgggggtggacttgccggtgagtgtgacgttttagataggcgccggtggggctcgtggcggcgaccggaggtgggcgacagtgtggtgccagtgggggcgcgacgcgtgtcccgaggcatagtggtgtgggtttaaaaggattaggatgccggatttgtgcgggtcccaagcgtcagtgggttggggctagtgatactgtggtacaagtggacaactggatggcaattgtccgatcaaggtttatactcatgcttatcggctaaaatttgaatttttaatcttaaattttgaattgtttcaaggtttttttcattaatttttattttttatcttttacttttatatcgctaagaacacatatataaaagttttattcacaaattattttttttacaaatatgtttcgcttattcgaaatgatggctagcctagctgggctaaatataatttcgtttatttaccggatataatttcgtttatttacaaatataattatatcaggcctttagctgcctagctgggccgtcagagaattttaacgaggaaaaggtccactttgactccctttaaaataggccgaatctaattcgtacccctccaccgaaaatcagataagacaacttccctaactattgaaaccagtgcaatttgactccctcagcggttttgaagagtggttttgctgacgtggcgctgatgtgacggtgctaacctggtcttcatcccatgtggcgcctatgtggcattaaaattaaaaattatatgagggacccacttgtcattaaaataaaaaaatattgtggagcccacctatcatcctttctctctccaacccttcttcctcctccctctctctctcccccttgtctctctcttttctttcctcttccgtggtggcggcggcaggcggcgctacccttgcagagacagcgggaaatggctcccactaccgggggcggaggcggctgggcgttcggggacatcagtaccgtccgattttcttgacccactgccatccctagttgtcgtcgcgtgcttgacgtggacggtggcgacggtggacttgatggcgatggtggtcgcggcagcggcggtcgtaggtggtgacgatgaggcgtggcgcgcagtgatgcttcccgtcactagctgtgcaccctcgatcggttaggg

SEQ ID NO: 64909 - DNA, 2077 bp, Oryza sativa
tttttaaggaagttaaagtggactttttccttctaatgaaccggtgattaggccggccgtcttggctgaatcagctggcatccgtccatggcccatctgcaaatggcccaatacaagctaaaatagaggggccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaaccacaaaaccggacatttttcacccccaactatacaaaccggacgaattacccccctcgacctaaatccgcggtggttttggtctacgtggcgtacgcgtggcagtccagtcagcattctatttattaaaaaaatgtgggacccacctgtcattctcctcccactcttcctctctcctctccctcactcttcctctctctcttctctcactctctgtctcactcaacctctctctcacgcccacggcgagtagggcggaggggcggcggcagcggtgagcgcggcggcgagtgaggaagggtggagggacggcggcggcggcgaagtgagcgcggcggcggaggaggcgaggcggcggcggcgaggcgagcgtggcgg

SEQ ID NO: 64910 - DNA, 2939 bp, Oryza sativa
cgccctgctcaccgtgagcgtgagagaagagagagagaggaagagtagtgagagagagaagagagagaggggaagagtgggaggagtatgacaggttggtcccacatttttttaataaatagaatgctgactgaactgccacgtgtgcgccacgtagaccaaaaccaccgcggattggatcgaggggggtaattcgtccggtttgtaaagttgggggtgaagaatgtccggttttatggttcagggggtaattcagacgaccgcgatagtttggggggtaatttgtactttttccttatttgagggcacaaattaaatgaacaaattgaatatcaggaagttgaaaattttgttttaaaactaacgttttatatgaaatgccaatgaagaaagttctcgaataaaccataccatttagctttttaattaggaagtattcccgcgataataatccataatccacctacagttccaaacgggattagtgagtacgatcacaaaatgtacgatgatttgaacaataatacctatggagaactgactgaactgtgatgatacataattatgcttgcattactgctaccaatcagtactatatcgataatagtggcagccgtataaaaaaagctacttccctaatcataaatagttgacgtttcgaataagttttggtcaaatttcaaccatcattaacacctcaaattcttgttttttttaaaaaagactacatgtgtagatttattttcaaaagcactatcataatattttaaaccaattagatcctatgacccatctgtcaactcagactgattatcattcgatctgaaaaggactaccataatatcatacgcttattaaatgggataaaccatttctgatctaaaatagattgtcatacgtgtaacggtatgaccaaatcgtttattctacaaatcaaatacttatgatcaggaggatacgaatttcttgagataacgtcgatcaagagggagaaaggagttatatatgaagtataattctataattctataagtttcaaaaaaaaatctataattctatatttccagtgatcgatgtatcttaacctttttctgtatactcgtgtgtttcaaagacgtgcattgatttcaggaagcgtttctgtgtttagtttgacagcgcaaacaaaatcatccatcctacaaatctgaacattaagaagcattagaaagtacgtgaacatacatgagtaccgaaagttgtgtgatgagagcatttgatgtcaacgtatttttaccgggccagcccaaggagaccgaccaatttcattaagctacaaatacatcgataataagatgtcgaaaaacagggtcccaaaagtaccaacagcacctcccgcaagtaagggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatctcccatgcaccacccggcccacgggccaatccaaaatttccaccacgccgcgttggtgcacaacgcggtagccggtagggggcgctgcttccgccccggttgagcgccaccgagagagagccaggcacacgaaagtttcgtctccaacacgacaacccccacatttttcctcttccctccacttcgcccaatcccctcataaaagcgtgtgcagtccatcccactcagaatccatcgcccaccccgccattcgctgctgctgctgctgctgctaccaactactaccaccacacca

SEQ ID NO: 64911 - DNA, 1267 bp, Oryza sativa
tatctgatccgaaggttgcttgaggagcactttggtatttttcagaggtttgcttctgtttactcgagtggaacacatacattttttttacaagcatgaaattcgagattcattgtcgggtttagatgttaccagtgaacgccgccagctcgttgtcgacaatgcatcggtaatcattatgggggcgtgacttggggtaagtggaggaggttggattgggggtatagtatagggtctcaacacgctcacaatttcttctatttatttgagaaccaagttcctccttggttgccatcattttattggatgtgtgttgggggtagtagagagaatttaggggtttttatttttgaatgatccaaaaagtgcgtgacacttttttttttggaaaaaagctatatgcttgaatctgatagcgggatggtctgtttaaatttggttggtttacctgcaaatcctagaaaagtacggaataagtggaattcctcctctgtagaaaccaactggagaaacttgcttattaattgcataattgcagtaataactgtcagaaatgaaaggcaaaacattacaaagctccactaactacttcccgagaattatctgaaacagttcttgaccatttttttcttggcacttatgattttgaacatcatagtcctgttttaatttcagattaccaggttacctacataccatctagcaaataaaccaggatagaacttctgtttttccccaagtaacagaaacaccaccaaaatatggataaagcgttgttctcttgaaattctttctttgtatctgatctcaaactttgaatgttacggatgtgatagataaatgctaccatcattaatttggtctcttattgtttcttatccaaaagatctttgatggaatccatacaagatacggttcgcaaggctgtccactcagaggccagtattttggaccttattcacgtaaaatgtgtgatctatctatacatatgctttgtcttaactccttttgatatgtcatacaacagatgaaggaaagacagacaacattactttctggaggtgcttatcagcatccaaggtatctgccatttttgtatcttctcctaaaatgttgaaaactagatgggcatttaaattcctctattaaggcactttaaaagtttcttgatccatgtcatgatcctaaaaaccaagaaaatgaagtcgtgttatgcattctaacatttctttggtgcacaaatgaacctgagtgcactgcaagttct

SEQ ID NO: 64912 - DNA, 1552 bp, Oryza sativa
  unsure (1)..(1552): unsure at all n locations
ttccagaaaagattggtgaagtatactttgaactattctagaaaaagtaatgctgaaggctgttgatgtgcttgctagcagtgagtgtgtcaatggtaccatctttttttttccctaagagggggatgataattcacaaacaaactgtgaattttggattctattcttctgtcttatttgggcataatttatcggttctcatatttaggtttgatcactgtaaaggaaaatgtctctggactcaagccagtgctccatggctttcatgtgcatgcacttggtggcaccactaatggttgcatgtcaatgctacattcatttctttcccccttttctttgtcaggagaaatggattgtggtgcgcgagttggggaaattgttctaaaagtgtaggaataatatactccaatccaactaggaaggaacatggggggcacaagaaggttagaaacgtcatgctggtggcgttggaaatataatgatttgaattggagcggatgcttttttttacagctcttttattgcttacattccaaaaatattttagtacacactgtctgcattggatgaaaatttgatagcttaactacaacgctgtgctatcttaacatttattaggtgttttactcaggtaggttctacagagacctagaaatctgagggacattagtgtgtctaagttatcttgaaatgtttcacgaanaaatttttttagggtggtttttncccccaaaactcaagacatatagtgtatgcctatgcttaatgaatgtcgttatccgcttgaatgaccaangnnnnnnangnnnncttggnnnnnnnnnnnanannantaggctgttgagagncganncnnannntnacaccacttagcccaaccctgtttcatgtaatggcttcttgcttaataggccttccaagtaaagatggcataggctgagttgcaggatggaatttatcaggagtcagctccactttcagtgaatccatccttctcctggaggaagagaagatacatgatgcagtgtatgttctttttattcgtgttctgacattgcatgaagtaacgcttcttatattttatttggaaattggaacgatctctatttttttccttctctcagtgagttcagttttctgaagaaaaaatgtgttttagtttaaacacaaccatttgtttagtagttaatccattacacgtttctgtgaaattttgatcattcgtaacactgttaaattttactttgtgatttgtaataatttcttctgcttctttttctgcagtggacaagttggtgaaaaaaaaggaattgaacttttgcaagatatactgaaataaagtcagtggttaagtctgataaattatctgctgcattgaagtcccctcatgcgtttctgcgcaaggtatgtagtgcatcgtttcctctttacacgcactgaaaaaagacatgttggaaagcctacaaccatagaagtttacattgtccatttttggattatatgttaattgccggaactgatagtcttcagatataatgcataagaatttata

SEQ ID NO: 64913 - DNA, 791 bp, Oryza sativa
agcataacaaagtggatttgtgattaggaagctcaccaggcgatgaagaaaatcttgctcttttgcacattctccccagtaacaaagtcaaaatcatagagggcatatctgcagtcattttctgggagagatgccaggaaatcatcataactctcagttgttgccccggtcttctccacaacaacttgcttttgcttttcctcgattttgaagataacatagcgaaatgctttcttcatctgaagctcaaggaatgtgtccctgatgtcaggagcaacccccataccggaggatgcattggactgcaaacataattacagacacttgagaacatgatcaataaaaacaagacctaataataagagaaactgttcaaaattcaacatcacatgtcaattcagtattcaagtaaaaaaaaagtgaagtaaacctacatagaagcaaagaccattcaagataaatcttatttagtgtgatagagtggtgctaaactttcagaatcacattgtaaacttgtaagaaaccatgagattgctaacgcattctgcgcatcattgagccctgaacatccacatgtgccaatggcaaaatatgtaacactcatatttggtataacaaactacaatatcagtaatcgacttgttgtaaaattgttaacagtaacataacttggcttgcgtatatttttttatgcttggccacagctcataggcagtaaaagaacatgctcacacagaaaaaatgcacaaatatttaaatcaaatagcacagaggcccaggacccagggttg

SEQ ID NO: 64914 - DNA, 925 bp, Oryza sativa
tatgctagctggaatcaccttatggccaccaacctgcatgatactgtaattctactgaattggtcagtactcttaagaaacattcgttctcggctttttgagtgtttttgacccgtcattttcccttgtgtcgtgcggcggcggccacttggttccgtgtaaaacgccatcgctacgatctggtctacctacctggacctggctaccaaccagccaattgtttctcttgcaacgtacctggatctctcgcgtgtcgtacagaggcgtttggctgtgcacaaggccacagggggacaattttatcgaacctgttcaattcgataagatgcactctcttttgtttaaaaaaacaagacaaagcagtagtaattctgatgaagaaaatgtctgacaaaactttgtacaccgcaggctattctgtcctactccctccatcctaaaatatttgacgccgttgacttttttaaaaaatgtttgatcgtttgtcttattcaaaaaatttaagtaattattaattctttcctatcatttgatttattgttaaatatacttttatgtatatatataattttacatattgcacaaaattttttgaataagacgaacggtcaaacatatttaaaaaagtcaacggcgtcaaacatttagggaatgagggattactaacttggttctacagaacaagggttttgccctccttacatgagtgaaatctcttatagtttaggatagtttaggatagaagtgatatgcaataatcatccgaaaccgaaatcatagctcgtaacacgtgacaaaataatgcccaagaaaaactttgcacatggcaggttatcatcatattagatgactagggatcatccctgtacaagctacacaaaactcctccaacatttagtagtagctatcaatcacagttctaaac

SEQ ID NO: 64915 - DNA, 1651 bp, Oryza sativa
gaacatctcttggatggaggtggagttcccgacgaaggtcgccgccatcttcagccccctgggcggaatgtcacagacactggatttgacgttgttgggaatccactcgacaaagtatgaggagttcttgttctgaacattgagcatctgctcgtccacctccttggtgctcatcttcccacggaacatggcagaagctgtgaggtagcggccatggcggggatcagcagcgcacatcatgttcttcgcatcccacatttgctgtgtcagctcaggaacggtgagagcacggtactgctgtgatccgcgtgaagtcaatggcgcaaagccaaccatgaagaagtggagacgggggaaagggatgagattcacagcaagtttgcgcagatcagagttgagctgaccagggaacctcaagcagcatgtaacaccactcatggttgcagagataagatgattgaggtcaccaactgcattgttagaaccaagcaagctatgagtgcctacttctagttgaacagtaatttagtgatatcatggagaagtaaacaagaggagactaacttacaggtaggggtagcaagctttagtgtgcggaagcatatgtcgtagagagcttcattgtcaagcaccatacattcatcagcattctcaacaagttggtgaacagaaagggtagcattgtaaggctccacaacagtatccgagacctttggtgatgggaagacggaaaatgtcaacatcattctatccgggtactcctccctaatcttagaaataagaagggttcccatgccagatccagtgcctcctcccaatgaatggcaaacttggaatcctgcaagtaaagaatataagaccatgatgttagtcatcaatgcaaacagacttcaaacatgcatctacaaaaggcagccttgggttcaacgaatgtagcaacattcaaaaggccaagggcagctagaagtttagggtatcactgtgtcttccacgaaaccagagtttgggagcaattgatcatgttccaatagagaaggtattatatggattaaggcaaaggcaatttttcacatcttcttctaccaagctttattagtcgatgaacttgtcatggcattcaactaaggcatattacttgggtctatcatgttgaatattatacctgtacagctgtaccaaaaataaataatcataaggatgaccaaagcaataaagttttgatttcattgtaaaccatgaaagacaaggttacaattttgctatgttttgagtttttaaagaattaaatccagctatgacacaggtggacactacaggtaaagagaaaagttctgtgtaaacatctagaacagctacagtaggagctagataagatattggtgttgatgttgatgcccattccaccaacaaggcaacaacaattgatgttgatcaagctacataagacaataggagctcatatacaaaacataggttgatgattgatagagcgtcttatggagcttaaaattctcacaggcacatccctaccaagatatgaaaaattggtcacacaatggcattataagctaaatgcaaattgggccattagaatttagaacacaagtagcacagatgacagattatcatgctatacaacaaataacacgaa

SEQ ID NO: 64916 - DNA, 3260 bp, Oryza sativa
  unsure (1)..(3260): unsure at all n locations
ggagatgggttacacaaaatcagtatagcatttcaagagaaacacacatggtatcaatgctatgaacataaataatatggggaattttagatcagttcatgtactttatggactatacatcatccacgagcaaggcgtctagtgcattttcagttttattcgacctcaatgttcagttagctactagtatgccgttttggtttttactaaaaaggagacttcatttggtggtatgaacaaacgaccgattatacttggcagggacagtttggtcgcgagatgaggtaaatcgtcccttaatcttgaaaacaaaggtcaagcataacaacaatagaacattcctcgagcattgcaatctgaatttcacttgggggtgaaaatcatatgccttgaagccttatcacaacattaaaatttatcgatctctaatcccttggaatttttactatgttttagctggcagagaataagctcaaaagcagccagtactgcacgggaaataagattcatactctataaaatagggagtggaacagcttattcaccatatcttagctgtttacttctgatactaaaccttttttntnnttttcaaaattttttaaaagnaaaggggggggcggaaggagcgttaactgagcctgcagcatgtgtagtcctagaaacagggaatgtgttcattatcttctaaaaattntcctgttnaaaancatttgagccnnnaagccaaacgagcgttntnttccatttataatttaggaatatgngcaccatggagatacctctaatttgatagtctccgaacgcagcagctcatgagctgactgcaaagatgacgcaccaagatcttggaacccttgcttaacagcttgcattgtataaggaatgaacctcagcacagaacctttatcagcaactgctccaacaactccctgggcgactttaagctgagggtatcgcctaggtacctggcgtcactcccctttgtcattgcttcgagagagcccatgcctcggtattttttaacacggtggccatcctaaaagcattccaagaaccataatttcagacaggagggagtgaaacaacaggtacgtgtgataagagtaacataaatatattcgaccaaccaacacaataagcaattaaaaacccacttctacgacacagtgctagaaatgacacaggaaaatgctgaagacatcttaattataataattcaaaatattttaaggattaatgttgcccattaaattacatgatcctatcaactacatgcatcacattggcaatctaagataggacaataatagctactaatatattggcagcttatcaccccatttttactagtatattgtagtaataatcctaaagcaggtcaaatttactgaaacatctgcaaatggaaaatgctaaggtgtggtttcacccaaagcatcattgaagaataagagtggttatccaaaacaatggtttctaattaccagatatgaccttaaaacaactagctagaacaatctagccatgccactggttgcacttgcagaaataattaagaactaacatgaatacttcaggcacacagattgtgatcaccaagagtgatgtgaaagaccaatagaacacacatatatctagtatttacacttaacagaatatgtgctggcaattggttcagacagagcaatctcatacaaagcacaggaggcaaattgtctcagtgtctctcgctactaggtttgttgtgttttaaaaaactgtgattttcagcagccatgttactaatattgtcatccatgaagcaaatattcagaagcaacatatctaaacacacaatcatcttatataggaacttttatgacggcctgattagcacttttatggcatcaattagaccaaaatattgcctaaacattgatagcatgttttcattgcagtggtcacatgggatgtacatttgcatgtgcatggcatgtgggtcgtccttcaaagtatcaattcaatacgtacggttgtacagactcagacagacattgctaaagaactacaaaatagtttatgcatggtaaaagcatatcagaaataaaatcacatgctgaacctaaaaattcctgcagaagctttaaaaaattgaataccttgtactcgtaagtaccatgagcttcatggctgccagccaagaagctacccatcataacagtggatgcccccagagacaaagccttcacaatatgtccagagtttgaaattccaccatccgcaatgactggcacattgtgatctttggcataagatgcaaccttatacacgtcgctgtagcctggtcgcacgacaaatgcaagaaacaagtgtcaaacacatgcagcacacagcagtgccaaaattctttggtatacgatatataccatatatataccatatttgttgtatccctataacatttgtatccgccacatgtcccatgatccacttattatacaaacctcatttcaagtttaggtctaaaaacagcagaaaaggaatgagctggacaaggtctcaatacatcacagaacaaaatctcgtaaacaacataatgcccaggttccacgggtatgaatgggaggttgtagcaactaacacaaagttcacacttaaaatgtaacgtctggacaacccagcctaattaaacaagaagaacctaacacctactcattctcactttgtgccatctaaaaatatgaaacaggatatccatatcctcctgagtgttggtggaaatggaagacgctatagatcatccaactagtttagaactttagatgcttgtgataacaatgcagagacgaagcatccaactagtttagatgcttggatagatgcttgggataacaaggcagagaggaaggattataaattagagcaaggcatcagaatctagtttagatgcttgggatagcaaggcagagatgaaggattagaaattttagtaaggcatcagattctgggcctatttggatggctgccaagtattgtcgcacatcagttattaggtggatatgaccaaatatggctggtgcttttggtttgttactatcactacggtgtgccacactttctaaccctttagccccacttgtcatcaactctctccatagccaaaataggccacaagtgtggtgaccaattttgagacacaaaatctgcagtttgtcacactttcggcacgggattgtggaaaagtggggatacaagtaaccaaacaatgtttctgtctc

SEQ ID NO: 64917 - DNA, 4317 bp, Oryza sativa
aacccagtgatcttttacaacttacgcccgtaattatttacagcattgattgagtaaatacaggtaaataaaatgacttggggtggcccacactgcaccaaaggtaatcttacctgctccaaagtgaaaatatgatctacaaaattatacatgtgaaactttggtcatgaaaaggggaccaaagcgcaattaactctaaaacaaaagcatcatatggatctcaaaacaagaagcagcacgggcatgctggtcatcctatacatggcagaggatccacaaactagataactaataaattctccagaaggttgaatgtattgtgtaattgaatttaaaaactcaggaagaaaaaatttatgggaactttatcgagcatttacctgtcctcggcccacggcacaaacctcctgggtagtgcaaattgagccagagcccatcccaacacgcaatccatccaccccagaagcaactaaattctgtgcctgcgcaatcgtcaccacattacctccaatcaagtccacttccgggtacatcttctttgcatacttgatcatatcaatctggtagatagagttcccctgcgagctatctacaacaatcgcatttgcccctgccttaactagctgctccagccttcgcttgtcatcctcacgggtcccaatggaagccgcaacaacaaacttcccgtccgctccaagagacggcttgcctagcttcggatagctccggatgcgctccacatcattgacagtgatgaggtcgattacctcgctatcatcggatacaagaggggcataatccaaaccctcgtccgctagaaaggcggccgcctgctcgaaatcaaaagaggcggacaccgagcgcggggcggggcgcatgtactcggagacagggaggggagcctgacgagaggaggtctcggctgcaacagcgacgccgacgagcttggagagcgaatcgccgcgctccgtgaccaggccgtagtcgtggccagcgaagtcggagagggatggggtggaggcgggggagaataaggggacggaggagacgaacgggaggcggcgggacttggcggcgcggacgatgaggcctggaggtggggctcggtgttgcagtggacgacggcggcggcgccgagggatgccatggcggcggccatggcggcctcggagacggtgtccatgggggaggccacgcaggggatggagagggggatgcggcgggagaggcgggtggagaggtccacggcgtcggccgggaacccgatgtagcccgggaggaagatgacgtcgtcgtaggtgtaggagacgccctgcgagaagaggcgcggcgccggaagccgtcgtcggcgagatcggcgctgctcgccgccatgggtgaggttggaggttttagggttttagcggcggcggcggcagcggcggggggtcggcgcgggggagggtgaggatgatgagaatgggatgggaaacgtgaacggctcagggtttatggctaacatttggcgggtagcgctcggtggatgacgtacgggcccatagtaatgttaggccgtctgaatttttcgaccgacgaatgggtcccacgtaacccttttggagaggcattcggctcgccatcgggcccgcctgcgagtcttgcatcatcggagatattttcatggtaaaaacggtttacacgcttttgatttttttttttgagaacttggcttttgaattgtctgtcgctaaaggaatggagttgttttgttgctaatactcctaccttaaaattgaacttaaaattggtccggaagccataacacatactccgaaagtatatcatgacttgtatataagaaaaatataaatattaaatattatttctaagattctcttaacatgtatgtagaacaataataagtgaataataagtgagtaatgatcaaatgttggattcagtcaaaggaagtgttacgattttttggatggtttcatccatatcattagatgggattgacccagtgaataggcacctcacccttctactctaccgcaaggaaccacagcggtttagggtgtgtttgagtgtaaaatttttaaaatatacatacgcacatttaaaatatttaacgtagactagtaacaaaataaattatagattccgcatgtaaactacgagacaaatttattaaacctaattaactcaggggcgtattcacaatgggggtcttgagaccctagtaccgccccgggacagagaccccccaaagcccccactaatttttttccatatattcataggatgtgtggactgaaggttcaatttatgttgatgtagtttattcagcccccactactatttttttgagatccacccctgaattaatccgtcattagtaaatgtttactgtaacatcacattgtcaaatcatggcgtaattaggttcaaaagattcgtctcgcattttatatgtaaactgtgcaattgatttttttccccatatttaatgccctatacatatatctaaatatttgatgtgatgttttttgccaaaatttttgggatcaaggccttagtcgcacatcctcggtctctcagacactcctcacacccaaccatcacgtcctctgattgaaaccatttccctatgtataaactaaacatttgatcaatgagaattactcatctctctccctctcgtttcattctcaacaattttgttggtaatacttcattaaatcacacgggacatattgcaatcgtttttatcaaccacaaaacataatttaactaaaaaaacagtccagaaaccaaaacacatactccaggagtatattatagaagagaaatataaatattaaacgtgaataaatatatgttggatttctatacatttaaaattttgaaaatattttttaagtcataagtcaggagttcaattatatggacgcgtgtaaaaccatcaatccttctgaacaagtaatgaaacaattaacttatatatcaacaggcgtgtaaaactgtatattgaagaagttgtccctacatttctcctttccccatttttccattcgaattcctcctcattttattcttccccaaaaagtcaccctttcaaacacttcccaactcatcacgcctctggcaaagggcccacagactcagtcagagccagccaacccgaccccatcccagccgttggattagcccttcaccgccgtccaaaccccacgtctcctcaatccccccacctcctcacccaacccagccactgacaccctgcccccacattacatgaaccccacctgtcagtgacacaaacatcccacacgcgacgtgcaactccccgcctccacaactatatatgaacgcgccccttcctcgcgaatttttcctctccacaccaaaagacgccgcccaactcgcgaaggcggaaaaggaaaaaaagagagaaaaaaaaaggaagaaaaaaaaataaaactcgcgcacagcaaccgaatcatctgcctcctcctcaagtagtctagtcctcctctcttctccggagtctgcgtgcgatcgaagcagaggcgcggcgctcctcctcctcctccggctccgatccccatggcgttcatgcgttcccacgtgagttgatctcctcctcttcctcctccctattctgctctggttcgatggcggcggtccgttttggttgtggtgcctgcgggcggcggcggcgggggtggtttagatctgcgtggtctggatcgagggccccctcgtgatccttctcacggtgtgttgttcggatccggtcgaatgggtttcatctaacggctaaacgtgagatccactggcgtgggaggagtttctttgtgtgccgcgatggatttatggagatcgttttggtttcgtgtggttgatgacgtgatttgtggacggttctggctagcaggtagatgagaggttttaaggggtgattatgtgaaattgtttatggctagtttgggattagataaagttggttactgtatttgaagtttagtgttttagattcctcgtggtcacattgcatgcctaacggtttctctgttttgactgcaattatatgatttctctcattatcttagtgtatatatttgtgagatggtgcagtagggagcgatggtatgtaatgcattagaaactggtcggggaataggcaagacagaaatgaaagggactgattgggaataggcgagacttagaaatgaaagaaaacacgttgtggaaagtatccacgagataatagtttggttttgtgggcggggaatgaggcattgttcttcagcagccgcttgacttggatttatt

SEQ ID NO: 64918 - DNA, 1616 bp, Oryza sativa
  unsure (1)..(1616): unsure at all n locations
gttaagaatagtacagggtcactttatactacacaaaccgtcacgtttcttttgattcatgtattcctgtttaagagacttttaactcatatgtcgtcgtccaaaattttcagatcttttggaagcttctcacgctgtatgcgtgcaaggctctgaggatttctgattgcatccagcatcctgtccaagaattcaatgaactggcgatcttcatgagcaacctgaggatctgaaaacctatcgaagcgatactgatcctgcacgttccattacaaccataaagcttcaaaaaacagaggaactccagcactaagcaatagatacatcgtggggatatcatatactacataagtacgtcttaaatcacaggtatgtgcaaacagaaggtcagtaaacttgtagatatatatttacctcaagtttagttttatgatgattatgattactagtttaccacaatcttggaatttatttgacactgtacatgaaaagctgaacaacaacacatctacttgtctaagcacaaaccttttatttaaacggaataaccaaaccacaaacattcaacttcgatgtagaaaaaaaaaaaggcaaattttggatagaggtcgaaccttgatcgtcgtgtcgacttgcccacacgcgctgctgcagaaggattgatagctcgccggagaaagacgacggagcccctccccatggaacagctgcagctggcgatggccggagaggcggcagatcgcctgaattctcccgaggaccaactccgatgccatgtttgcccaagcaagcggntatcctttgttcccctcttctaattttcccctacttcaatctacaagcttctccagggatcgagcagtagttgtagttgtagtactatcggagtattacgcaaggtatcggcagtcatggaaagcttcgttggcctcgtttggaccggccgggtcagagattgactgagattagcagtcatcctttgacggaacgttctttggtctcgtcactgatgactagataatcgcaagtcacaacgtgtctcctgatctcatctttgatttctcctcctgtagctatcttgttgattactactaggtttgtctccgcacacctgggatgctcccagtttagttattatccctctcaggctctgccacgtagagcagaattaccatggctgtagaccccaaggcgccgtttgggcgcgtaactgaattttttagagatgtttcgttacgatccttgattgccaatttggctggaaagatatggcatctgtagcaataattttgatcgagaaaacgtgtacgcgtttcagcggaagcctggaaagatgcttcgagaagaatattttgccaattggtcatacatattacatggtcgctggccaactttcttttatgactcggctcaaacttttaatccatggtctctgaaaacttaatatagacgtgattcacaaaaaaaaaaacagaaaaattcacacgattcttcacagtaactgtagatctcgggttgtaaaattctccggtcgtgtggtggttgtcataaaccgaccggcaacaatgtcgtatggtgaaaaaaaatactgccacacgattaactccctggcattt

SEQ ID NO: 64919 - DNA, 1228 bp, Oryza sativa
ttcctgcagcccgccagttctgccttgtcattttccagaatttgaatctgcgtctccaactgagatatcttggcagcttgcactacattgattacggttaatcaagattgcaaagataacagtgtgagtcagttgagcagagtttgtgcgtaccttttgatgagccactcagttcaaaatttgattcctgcagctcagcgatccgatccctcagatcatgttcattcttcctggcaagttctttcgcttcgtgcagttgattcctggtggcttcgagggttcgagatgagggactaacctctctaaggttaccgttttggcttcgttcctaaaatgaatcctctgcaagacagtttaattagcgcatgaattaaatggcaaacaagatggttgagatcaggtaccagagggcttacatttacaatacgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatccggaggatttcttcttcatcaccaattattggccctagtgtatccatgaatgaagatgaagcagctaaataaagtctattggatcaaaatgatttcagatagcgtgtctacctgtgatgattcccggtcggggacgagtggactttggtgtcttcacaggagatctgggttctgattcactgtcagcatccttcccgagaggactgttcgtttgagcttcaacctcgggaaccttttggcttggccctgcatccgactggtttccagtcgggggctcctggttagcgccgacttcagcttcggccgactggttcccagtcgggggttcgttgctgggttctacattgttggttgccgactgcttgtcactcggatgatcctcaacagatggcccggtttctttggaagagcttgtgtctatgttggtcgggtcagagtctttcccagacggatctatatcagatggtttcctgcaaatttgattatcagtattattaccgcaatgggtgcgcatcaatgcaaggaagatcattatatgagttgcacctggaagacttcttgatctttggcacagggcgaccagattttttcttccttggagtagcttgttttggtagtttcttggttgtctctcggtctccagcccttctggtggtat

SEQ ID NO: 64920 - DNA, 5374 bp, Oryza sativa
  unsure (1)..(5374): unsure at all n locations
tgtaaccaggtatcttttggactttcgtatccttcattaaccttctcacttttgatacaccatcccatcgtccagcaactgcattgatattggacatgagcacataataaccagaattatgaggatccaacttaaataattcctgtgaagcaatctctgcaagttcgacattgcgatgcacacggcaagcatggagaagagcaccccaaataccagcatctggcttgaaaggcatatcaacaatcaattccatagctttatccaacttccctgcccgactatataggtcaaccatgcaagcaaaatgctccattcgaggtgcaatctgatattcctcggtcatacatcggaaaagtcgcaatccttcctgaacttgtccagcatgagcacaagcagaaaccaaagcgaggaacgttacatgatctgccttgaatccctcctcttgcatatggcgtaataaacttactgactccttaacaaggccataagccccataggaagcaattatgctattccatgagacttcatttttctcaggcatggactcaaaaacacgatgagcccattctaagttaccacatttgccatacatatctataagagcactctcagcaaacaagtctgctcttatggggccctttatgacgacaccatgaatctcctttccgtaatatatagctggtaagcttgcacaagctgatagcacagaagatatggtcacattactgtactttactccttccatacacatttcacggaaaaggttaagggcttcttctggttccccattttgtgcaaagcttgaaatcattgagttccatgtcacttcgtccttagcagatatcttagagaaaatataatggctcaggtcaagcctgccacatttagcatacatgtccattagtgcactctccacataacaccttccttcatatgcatttttcagagcataactatggagttcctgaccaagcttcatagctgccatgctagcacaggccggcaacacactagcaatcgctacagcatttggtctgatgccttgttccaacaaatatcggaacattttcactgcctcttgactcatcccatttagaacataaccagaaatcatagtgctgccgataaccacatcaatggctttagaagaatcatagacactttgtgccatcctcactgctctgcacttgaaatagatatccaccaaagcactaaccaagaatacatccatgtgcacacagtttctgacaatataaccatgaagctccttcccctgattgaaaccattcaagtcagtcaaagctggtagcaagctcaccagtgtaactgaatccggtcgaataccactcttctgcatatcacaaaacaaaagcaatgcctgatcaacaaaaccattttgcacacatccggatatcatcccgttccaggtcaccaagtcatcacgcggcatcaggccaaacaacttccagccatcatccaggcatttgcatttggcatacatagacaccagtgtgttcgccaccgccacctcagattctaacccatacttcacagcaagcgtgtggagctgcaccccaaagaacaagtcactctctgtggcagaaacagatagaaagcatgccaaggttgcgaaattgggttcgcaaccgctcgctctcatgtccccgaatagctccaccgcgctcgacacgctcccagctttcacatacccgtccatcatcacattccacaggacacaatcccgctccgccattccgtcgaacacctgccgcgcgtcccagaggaggccgccattggcgtacattttgatcagcgcgctgccgacgaacatgtcgccgtcgagcccgagcgttcgcgcggtgcggtgcacgaggcggccgagagcgatcgcgccaatcgcggcgcaagacttgacgacgtaggggaaggtgtggctgtccgggagcggcgcggaggggtgcgcccacatcttgaggtagaagaggagcgcggagcggtagtcccccgccatggtgagcccgcggatgagccagttccacgggagcgcgcaagcggcggcgccccgtggcagcgaggagaacaccgcgacggcgtcgcggaagcggcgcgcgaggacgtacatgccgacgaggcgggtctggagcgccgtgtcggtggcgtggagccccgcggtgacggcgcgcccgtgcacctgcagtccgagcgagaggtgcgacggggagacgcagccgcggagcacggcgaggaggcggcggtcgggggaggcggcggcggccgtggtggagaaggtggtggtgcgaaggcagcatggccgtggcggcggcgtgagctcgacgcggcggatgaggaggcggcgcagtgggaagcgcatggcagccgccgacgaggccgaggaggggaagtgaggcggcggcgactcactcgccgcgtttgatttcgaggcttcgcttcgaattttttttttctttccgaaccattgaattttgggaaaattgtaaccatgccattataattttgtaaaatttaagatatgctattctgactcatatgtcattgactcatgtgggtcctacaggtcattgagataccgatgtcatatcttaaactttaattttaaatttaaaaataaacttttcttaaaaccttcgtgtcacgccgacatgtcaaaacaatactgtcacgccagtttgaccattcaaatctagctggtttagcagcgcacgtctggtctcctccttgcttacgcatcgaccgtcgagcgtcgtctgctcccgcgaagttcttcaacgaggaacgagggaggagccactcctcacgtacgcgtcggctgtcgagcgccgcctgctcccacgaagttcttcgacgaggaacgaggaatgagccgatgtgcatggagaagacgatgctgttgggaggaaaaaaaaggcgtgcataatcaatttagttccaaatcgtgttctaacgtgtagccattgattgagaatacattttattgaatctcttttcaaaaatggtctttgagcgaaacttataatgtttgatttctccattctaaatggtgtgacaaacgtgtcactttcactatgggtacgctattttgtcacaccatataggttaacaatagtcggagattttaaagtttgaaaataagttttaaaatggttcatttttaaaattaaaatgcatttgtgttccaaggccgtgacgtcacgagcggctcacgtgccatctcatctactctatctctcacctccgcccgcctcgtcgtctctctgacaaccgtacagccgcccgccttccgctccgcgccgccgcctccgccgctgccgccgcgcgggcgtacgtgtctatggcgacgatgtctcgccgcgcactcggctctgcgttcgcgggattcacgcggacaccagctatgactccgacggccaccttgccttcctcgtgcgcgtccccggcgcgtctcctgcggtggcgccggagcgcgggtgtaggcgcccggcggttcgcgtccggccgcaacgcgcggattagcatgagcctccgcgcnnnnnnnnnnnnnnnnnnnnnnnnnnnnnnnnnnncaagtcccactcttcaatgccattgtaaggaaccttccctctgcttcttccgaagaattccgtgctgttatgaactcgtttttagctggaagcaactcgaggagaaagaaggcgatcttgattatttgtgcttttgaggagttcttctcgattcatggattggttttggtcgaggatgaagtgggtatgcggcgtcaatggaactgcgcatcaactgtttgattctttgccacacagagatgcagctctccaacgtttgactagttatgaacttatgatgcttaacttagataggactcgtcacagattttttgcactgaattttcatttccctagctgcaggagtgcttttgcagtcgtgatgattgtttgatgggaagtatagtgaatctttaacgcatgaaaatgcaactgccgtattgcacgggacatgccattcctcgcaataatgtgcatgctattgttgattacgttgtaacatgaattcttttgtcaacgttgtcaggttgaaaatgggaaggcacaagctgcaaactttcccttctgcaccataaaccccaacgttggtgttgtggctatcccagatgctcgcttgcatgtgctctcaaaattaagcaagtctaaggagacaatcccaacatccatagagcttgtggatattgcaggtctcgtcaaaggagcaagcaaaggagaggtgtttcattaatgacttcgctttatgttaggatgtcaatgtgctgttctggctgatgttgtttctgagttctgactagtttatataaccgtgatacatcagggactaggaaaccaatttctttcgaacatccgtgaggttgattccatccttcaggtcagtttcttgtcgtttttataaatcttttgccatcagatatttgtcaagttctggagactttaaccatgcatttttcgcatgcctcattccattgttcatcaagtactacatattattctgttgtatttttcatattgctaaggataactttatattattctctggtagatgttttttcaatgttcgtaaagtaccaattaagcttctatacaaaatttgaacacataatgagtgtcactttgtttttcttggcactgcaattcattatcggtattttaactttcttgtgctgtcttatgttttgcctttggggcctttgggggttttaatcgttgagttttaaggccttttcaggttgtgcgatgttttgaagatgatgatattgttcatgtgagtgggaaagttgatcccaaatcagatattgatgtaattaatctggagcttatattttctgatcttgaccaggtaattttgtaactgcattatgttatctccttgcttgctttgtggggtgaaaaaaaaacatgtatggatttaattatgtgctttcttttttgccattaacgctgacaattgtgttcgagatgcagatagagaaaagactggataagcttaaaaagagcaaaactaaagaccagcaagtaaaggtcaaggtaaggttttcaggctcttctccttattttgatggttattatagatcccaacagttctcactactcaggaacaagcagagaggactggattggaaaaaattcagactgtacttatggatggaaaacctgctagatctgttgatttggctgaccatgagaaagaagctatccaacatctttgtctactaactatgaaacctgtcatttatgttgccaacgtaactgaatctgatcttgctgaacctggtaacaaccctcatgtcaaagaggtagccaaactagcaaca

SEQ ID NO: 64921 - DNA, 1066 bp, Oryza sativa
tcatctaaagcaagaaattgatttattcaaatattatacacgtaatcgtagatccaaatccatggatgtattgtggaccttgaaatactcagctccgtaaaattttggagctctgctaaagaggaccttagctctaagaaatcttgaatattgagttgtacaaagaggaccttacctctaagaaatcttgaattttgaattttggagctctgctaaggccgtgtttagtttcaaagtttttcttcaaacttccaacttttctatcacatcaaaactttcctacacacataaatttctaatttttccgtcacatcgtttcaatttcaaccaaacttctaattttggtgtacactaaacacagcttaaagaggaccttagttcatggcaccatttgatagggagaagggcaggagattaaatttgctaaaaggcccctgcaaaaactacaaataagtactagtcctactttattacaaggcgttctctcttccttccttctcagcttctccaagctcgcgcgcaagcaagccgccgccgccgccgccgccggagagatggactcccgcggcttcgattccgaaggccgggaattctccagcgccaccgagatgtgggcgcacgaaatcggcgccgcggcggatgccccggtctccgccgcggtagccgaacccgctccggcccccgccgccggaagcaacggggtcgccggcgaggaggaggcaggcggcggcgggaagcgggaggagtggtactccaaggcaatcgcctactggcaagtaaagagcgctcactcactccctcctcctcctccctaaaccctaaacccccccaaatccgagcgcattgtctcctcgcggcgaattcggctacaagttttcttgatttgggtgtgctagggcgtggaggcgtcgaccgagggtgtccttggagggtacggatgcgtgaacgacgtggacgtcaagggcagcgacgcgttcctccgtcctctcctcgccgagcgattcggctccgcgaggcgccatctcgtcgccctcggtgagttcacttctgtggaaggatattcgtt

SEQ ID NO: 64922 - DNA, 711 bp, Oryza sativa
ttcctgcagccctactatgacaaattacatacacaattcattgcttatgctatgctcttatgctaacatcgggggttcgcattctcaccaaagcctgaatggattctggtaaattcgaatatctagaggcggatcgaactatgcatatgataacagtcctatgtgaaaatagtagatattcttcataattaacaaacaatctcaatgtgtctatggggctcgagactcacttgcccatctctaaaacctgggtaacatgcttggaacgagggagtagattttctactcgctaaggctctctttggcacaactactaattgaagaatttctttagctgagaatccctggcttcatcatgccatggatatacacgatcgcgatgatgatattatagactaatgctactattgtaggtacaatttaggagtaatatcactactataatttagtaacatataaatgttaaatcatacacatatatgatatgtatacgccatagctatatggcgaatggtcctatgctataacacggtttacgctgtgttaggatacaaactctcaacttttttcatcacatgaaccgcgtcatacacataactatgtactcacatcgtactaattacaaccaaaaactataacattggacacagacttggaccgtttcatcggtgcagaaaaccactcgatgctctctatgcaaggggaccccct

SEQ ID NO: 64923 - DNA, 716 bp, Oryza sativa
aacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatag

SEQ ID NO: 64924 - DNA, 719 bp, Oryza sativa
tacccagctgcccacgctgcaggatcgccgttgtacgggttgttggtgccggggacgaagaagcctgccgggatgccgaagtcgtaggccggcggggcctggccggccgggtcggcggtgaggtcgcgcgcggcggcggcggaggcgattatgccggcggtgaagaggacggagacgacgacgatgagcagccttggagccatggtggccattgttggtacgtggtaagagagatggatggagggagggagggaggtggtgcaatggaagctaaattggcttggagaggagaggagtctaattttagataatagaagctctattaagactgggttacgttcgtccacagatgattgtgagagaaaattcaccttgttttttcacgtgcacgttttctaaactattaaaagatgtgttgtttgtaaaaaatttagggtcacatcttttttgtcttagtataagttatatgccaataccaaaagttgattttgaggtttatttttcgtagtttctttttttagcttgaagtaaaaaaacacatatataaaagttttaacccaaattttttttcacaatagccaaacatttggcgtattatccgtaattggccaaccgatgacaaccttatatagaaaagttgcttttaaaaatcatactaatctatttttaagttaaaaataattaatactcaattaatcatgcgttaggggctgcaggaa

SEQ ID NO: 64925 - DNA, 6574 bp, Oryza sativa
atggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtgatcaaatggaataaagcagcttgataagaacctatacctagagctaacatcatataacccaattgagacattgtagaataggctaagcttcttttaatatctctctgagcaagagctaaagtggctcctaagaaaagtgttagtgtacctattaaagaaatgaaactcattatcaaaggtagggatatgaaaagaggaagaagtcgagctataagaaaaatccccgcagcaaccatagttgctgcgtgtataagagctgaaatgggggtgggtccttccatagcatcgggtaaccatacgtgaagagggaattgtgccgatttcgcaaccgcaccaaggaataataaaaaagcacacaaaatagtaagcaaggagttaatctcattattaggaatccagttattagctattttaaacaaatcccgaaactctaaactacctgttatccaaaaaaaacctagaattcctaataacagaccaaaatcccctacacgattagttacaaaagctttttgacaagcactcgctgcaattggccgtgtaaaccaaaagcctatcaataaataggaacacattcccacaagctcccaaaaaaaataaatttgtatcaaattggaactagtaaccaatccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatatttttttgtattaaaatgaagcagctcccttgtttcgtaactcaaattgattggaattcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaaaatatataatatgttaaaaaactcttgtcttatccgcattagacaaaatgaagtaaaaaagaattcagaatttcaatatcttttagtatctaagtataaatactaagaaaaagaagaaagatggattgatttgcggcaatagatgtctttcacatacaactagaaaaaagtaatttcctttttgaatggcagttccaaaaaaacgtacttcgatgtcaaaaaagcgtattcgtaaaaatctttggaagaaaaagacttatttttccatagtacaatcttattctttagcaaaatcaagatcattttctggcgtcagcgagcatccaaaaccaaagggtttttctcggcaacaaacaaataatagggttttgggataatatgaattgacctatcccccaaaaattccaattatttaatatgaataattaggaataattaggattaattaatgagtttacttttatgtgtcgaattcctcggtacaatattcttagaacaaacctctctgatatataaaaaaagggtttttggtatactgtgacctaaatattcttttcctatcaatgaacttttcgtaatagaatccgtataataaataaaaaaaggggattctattatgaaaagtagagtattcctgcaataagacttacaacttctacctatcttatcctaaattaacaaaaaaattagttctatattgcaactgagaaaaaattgttccaactctttcaaagtttctattgggcaaagcaagaatttttttgttaaaaaattcgcaacgatactaccaaacgaagtctattttaatgaagattctaatgtcctaaattctatggaatcttccaatctcgacgattcgcgagaaaataacttaatattcttttaataaacctgttatttcaacttagccgccatggtgaaattggtagacacgctgctcttaggaagcagtgctcaagcatctcggttcgagtccgagtggcggcagtctcgaaaaagaatacaatagattataaaataaaatggattcaattcgaaatttccaattttgtaatgggaccttctccttatgctatttgcaactttagaacatatactaactcatatttctttctcaacaatttcaattgtgattacgattcatttaataaccttattagttcgtgaacttgggggattgcgtgattcgtcagaaaaaggaatgatagccacttttttctgtataacaggattcttagtttctcgttgggcttcttcgggacattttccattaagtaatttatatgagtcattgatcttcctttcatgggctctgtatattcttcatatgattcctaagatacagaactctaaaaatgatttaagcacaataactacgccgagtactattttaacgcaaggctttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttaagcaaaacatttttctttaatgagattgaatatttctatgcaaaaagaagtgctttaaaaagcaccttttttcctttatttccaaattatacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatttgcaatttatttacatagtagaacaaatccaaattggaagggtacgaagtcagcatttgtagcttccataggatttcttataatttggatctgttattttggtatcaatctattaggaataggtttacatagttatggttcatttacattacccatctaaatgattacataacataaaaccttaatgaaatggaaaaaacttccatttttgtgtttgatttgagaaccccttgaacgccttctcaaagggttctcaaaaattcgagatagatctaattagactcttttacttttttctgaatttttgagtatttccactatggaatatagagcggactagtagaagaaaaaaaatcctatttaggataataattggataacagagcctctaccctgtcaacggatagcgagagaacaaaatctggataaataccgattcctattactggtaaaaagatacagattaaaagaaagagttctcgcgggccggaatcctcaaaattttcgtttggaacatgaaatagcttgtatccatagaacatctgtcgtaacatagataataaataaataggagttaatatcattccaattgccattacaaaagtaattagcatttttggcattaacagaaattttggactagtaattagtccaaaaaatactactaattccgcaacaaaaccactcattcctggtaaggcaagagaagccattgaaaagctactaaacatggtaaaaatttttggcattgggatagaaacccctcccagttcttcgagataaacaaggcgcattctatcacaagccgttcccgctaagaaaaaaagtgtagccccaataaatccatgggataatatttgtaaaatagctccattgagtccaatgttggttatggaaccaattcctataataatgaaacccatgtgagagacggaggagtaggctattctttttttgaaattgcgttggccaagagaagttgaagctgcatagattatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaatttgacagcataagcaataaggaagccaaaataaaatagtatttccaatgttgcagggtatgattgattaattaatctttccaaatctaatcttggttcgttggaaccgtataagcccatacctagaactccgattaagaaaaaaaggaaccacctgcagtatacaaaataaactttgtagctgaatagagacgcctcttccccccccacatggataaaagtaagtaaacaggaattaattctaactcccacatgataaaaaaaagtaaaaggtctcgcgaagaaaataatcctatttgaccgctatacattgctagcatcaggaaatagaataatcgggaattccgggtaaccggccaagctgctaaagtagctaaagtagtcataaatcctgtcaataaaatagatcctaatgaaagtccatcgattcccaatctccagtggaaattgaagacatctatccatttagaatcctcttttaattggattaagggatcctccaattggaaatgataacagaatgcataa

SEQ ID NO: 64926 - DNA, 11222 bp, Oryza sativa
gtttcaaattgtcaaggagcaaatgcttttttaacaggatctgattatacgttagtaaatagtaagatgaagaaaaattcgatatactaggtgcaatagtacctaagagtcccgaaaaatttcgaaagagcccccaaaattttggaataggaattctaggattcgattcttttaccccattgggattttttgaattcttaaaaaaaccaattcgagaacagttggatgccgacaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttctcccttcgttcatttcatacgcgactgcaggtcgaaccaaaacaaaatacttttccttgctcttgagaatttttttccactgaacatagacccaattttcccttttttttgattccttcgaatcttttttttctctttctagtggtatcaaactgccacctaatatcttatccgcctcttcaggaaaatgaatatctccagaaaagatttttagttccgtatggcttttttttctcttcactcgaaccaatccacccagccgacttcttgtattttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgctcaatcaaaacccccttttttaagacggaatcttcctccgggttcccatattcgtcctctgagtcttcctctgagtcttcctctaaagtcccatgttcgtcctctgagtcttcctctaaagtgccatatttatcctctcggggcctatatttgttctctggactcccatattcgtcctcggattcctcctctcgagtcctatattcgtcctctaggattccatattcatcttctagggtttcatattcgttctctgggatcccatattcatcttctagggtttcatactcctcctctcgagtcctatattcgtcttctagggttttacattcttcctctcgggtcctatattcgttttctgggctcccgtattcgttctctgagtctttctctcgagtcctatattcgtcctctagggtcctatatctaaatttaacaattcctgaaccctttttatcttttttgtatcgtgggtcgtcaaaataagcaactatagtatttctacgtaaaacacccataaagggtatttcaatcgaaatcccaaaacaggatattggttctttctcttgttcttgatgatactgtaatggaatggcgaacctatttcttcgctttttcgctaacaaatcaaaattatcttgaagaatagaaggatagacaaaattccaatgaccattggacatgattcgatccggcgttgaataatcaagaatttccctatcttttttaccaaaagtatccaacagtctatgtcttacctcatcatcagccatcgagaggccaaagatataccttccgtcaacagaaaaggaataagtattcatttgatcttgatccttgtggagcgaaaaagaagctatactagatctgcacatacttactgacaatatccataaatggcttgtttttggtaatcgacgaagattaccatattgatattcgggcgcatgataaacatcggtactccagtgcatttccccatctgattcggaataaatatgtttttgtaccttttctttaaaatgcaaagcggacgttccggcacgaatctccgcaattacttgttcggattctacatattgatcattttgcactagaatcaagctttttgaaggaatagtcacactatgtagaatatcctgactctgaatagttatatgcaagtctatataacatagaaaagcaggctgcccatgacgggtacgtgtggggtgaaccaaatccccattgaattggatttttccatttgaaggggatcgtacaaggtcggcagtaccccctgtgaataccccaccagtatgaaaagttcttaatgttagttgagtccctggctccccaatagattgacccgcaataacacctacagcttcccccaattcgaccagatcgccatgagtggaactccgaccataacataattgacagatccaagatgtgctccggcaagtaaagggggttctaatatatattggttgtgctcgaaatggctgtgctcgaaaggtggttatgaatcgattgactaacccaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgttgaactacttcaacaagtctacgtgtaagatatccagcatccgccgttcgtacagcagtatctacaacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccttttaaataccacacatgagtcacgggacatgcgagtttgatgtatcccatttgatatcttcgtatccgagaatcaacaaattctactccgcatttttggcaaaatctttcgtcttcgttttcagctccgctcgctcgagaatttccacaagcacaaattctgctttttatgggtccaaagattctttcgcaaaacaatccatctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcgttttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggattttttgtttgtttactggcttcatataattctgaaaacacaagttttcttgaagcctcttgctcatatctctcatcaaagggtgctattctataatgtttctttagcagatcccctgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtgtcttccggctactttatccccaactttgatttcgcgtttttgtaaaatatatacacgaaccattatgtcgaggggatccctctggatccatttcacatcgataacgcgtcctcttccacctatcggtagtttgagagaagtttcttttgaagtggatacctcaagaccaaatatggcccgtaataatccagcttccgcgatataggacgattcgctcgctatctgaggcgttaatttacctactaaaatatcgcctgtttctacccaggaccccaacttcacaactccatttctgtcaaattgcggagtaaatgttcttctagatgtggtatttctttagtgattttttcagcggagccttggcttgttgtatccgtctgaatttcatattttcggatgtgaaaagaagtataaatatcctcatataccaaacgttcgctaattaatactgcgtcttcaaaattgtaaccttcccatggcatataagctactaatacgttttttcctaaagcaagttccccaccaaccgtagcagccccctccgctaaaatttgtccttttttaatggatttaccccgcggaacccgaggtttttggtgcatacaagtatttttgttagagcgccgatgggtaactaaaggaatacttatagtcttcccactacttgataaaaggatcttgtgactattagtagaaatgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacccccaatagaaaaatattggaaaggaaaaatacttctaacatgaatctgttcccatgcaatagtcaggaattcttgacggtatctagctggaacaacctgttcttcctgaataccccgattcaaggacaaagaatttcctgctgctatcatataatactcatctctatttggtgataaataaaccacctgtctctctttttttttctttgctttctcagatatttcataaaaaggactctctacggatccccaccaatgatcaattctcgcatgaatagctaaagatccagtaagtccaacgttgattccttcggacgtgtcaattggacaaatacgcccatagtgactcggatggatatctcggctccgaaaacttgcagttctccccgtcaatcctccaggacccaaacaactcacttttcgcccatgaaccgtttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatgaatactctacggatagttttttgaaccgcatgttgtaaacgaccaagagccagtccgaattgatcttgtaacagatccgcaaccgaacgaatacgtttatttttcaagtgattcatatcgtcatcgtcaagtatacccgtttcaaatttcattccaatcaaatgatccgtagcggccaatacatctcgcggtaacaagaaggtgctgttctgaggtatatcaagattcagtcttcgattcatatttcgtcgaccaatccttcctaattcacatttttgttgaaaaaatttcttttgtaattcctcacataaggattccgaaaataccaggtccccacctacacaagcaaattgttgataaaactccaaaatagctttttcttttgactcaatcctcttcttctccttagcattagggaaagacaagaaaatttcagggtaggaaacattatctagaatttcttttagatttgaacccatagctgatgatagaactagaatagatatcttttgttttctactcacgcgagcccatatcctttcttttttatcaattgctaattccgatcttcctccccaatctgatattatagtcccggtgtagatagaaattcctttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatcgcgcggatacgtataattcggaagaataggtgagtgattcatacacagcatccctttcttttatcgaaggttctagcaattgatatcctttcgcaaataattgaaatgaaatttcgtgatctggatctttaattgttggaaacttctcaagttcttctgccaagccttgattaatgaacctacaaaatccctcgaattggatctgactaaatccgggtattgtggacattccctcatttccattccggagcatcttaatcttaagtttcctgtttatcgaagaaaaattcattatcagctcactcttcatcaatccctacagatcgatctagcaattatggaatctatattctgtttactaaatcacatgaaattctcgggaactccacatacgtatttcatatatgtatttcatacatatgaatagagacaatttcaacgaaagttcgaatttcccaggggtccaaatggaatgaaaatgaagtgataaaacattcctagaacctcgaaaaaaattctgccacttacagtttatgatattcttagattggacggcaaagatttctcattttttctcctttctatgaatgggataaaaccaaaatataataatttataagcactagaaagtttgactttagttcgattgagaatagcacgcttagtttaatttcaaaaaagaatttgaaggttcttttttgtttcgtagtagtagaatttctataaaatataagatataagatttcgttgtagaatcctaaaataaagtaagtacttttttaagtacatgccaatctagttctggacctccacatagcaaagtcaattttcttttttttattcaagatatttaatgcaatgaaaaattaaagaacgattctccacagagatatgtacataagggggatccatagataataatgctgttcggacctggagtttacctatatacggattaggcataaatccattgtcttttattatgacattaaatggcaggcgggagagaataccgaaattcaaaataaaaagagaattctagttaatggttccaatttgttcttaattttgtagcttgtgactagaaatccacttttctcctttttcatttcaatagaaagaaaagggaagttttctagtgttagcaatgtgtgttttaagatagaatcctttgaggagaataatcgaaactggatccaaaaaaagcatgaatagattttttgaaaaagattggaaaaaagtaagtagaattagatttaagataaaagaaagttagttttagtaagaaacgtggatgaatacttgctcttttctcgattttagatcgtattttttggcggcatggccaagcggtaaggcaggggactgcaaatcctttatccccagttcaaatctgggtgccgcctgatcaataaaatacttaggcttatagtactgatccaaatcgacaaatttgcaccccgcataagttggggcaagagaataacaaggctcggcgatactggattttgagaacccaccgttctttcctcaaactggggtttgttttagcagtagtggcccaaaccgataccaatagggatgagatagcgtttccttattcttttattaataagaaagggctatgtatcatatttatacttaatgctccccaattctaccagaaatactctaagaatttgttaagagtaaattctttgaactgattcatccatagccttaggtcagaacccctttttgactctgtacccttgattctactatgattattcatcaatagtagaataattccttcatagaaataggagacataatttacatggatatagtaagtctcgcttgggctgctttaatggtagtctttacattttctctttcactagtagtatgggggaggagtggactctagggatactactaattgattgagtagtcgaattgttgtatcaactcttttctttaattgaccgttttgcattaatcattttgccgaactttattctttctctctttctttaattttgtttcactcctgtaagaaactcttgtaagaaagagtctttctattctttctatttctatttctatatagtagaatagaaatagaaagaatagaaaatagaaatagaaagagcggtgagagcaattcataatcgctactagaagcgacccatggttaaaaaagttctatacataagaactttagattttcttccgcggagctattcccaacatatcgcacattttccatttgttttatattcttttcttattcttagttcttaaaataaattttatgctcttttgaaacatttcgcgacatgtttaagcatgaaagattcgctggttttttccttttactttttttcttttactatagtctattctcatattatttttctctccctccatggattttttcattttgacttgattgaaattaagtggatgcagtgaaaaaagaaattgaattagactactatttcaatctagtaatctattctatgtagattcaagataatataatagaaagactc

SEQ ID NO: 64927 - DNA, 3841 bp, Oryza sativa
cactttatgattccaaccggatcctttcatttaagacttggatttttattttatttaatccctttttcatttcttcaatgattaattgaacttccaattaatcattttggctgactgtttttacataaataataagtaaaaaggcagtaggaactagaatgaacaatgcagtagcaataaatgcgagaatattgacttccataacctcttttttttcgcaataactcgggatgtaatcccatggagagggaaaagggtatcctgtaaattcaaggggaggacttgcattctgataatactgaatcaattcaatattatgaatatcggatctatcaaatcaattcatggttgagagtggaatagtataacataggaggatcccttccacgtatgatatgtatgtctttcgctatcaaccagaagtagtgataaaaaaattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccgcagcttccgccttgacagggcggtgctctgaccaattgaactacaatccccgcggggcgtatggcatacttattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgtccccattaaccgctcgggcatcgacccaggaagaatttattctagggtttttgataatctatgattaacctcctttcataatactccctacccccaggggaagtcgaatccccgctgcctccttgaaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggattttttttagttgatggttaggttaattcacggatcatcccctactttttagggaaattcgtttataaaggatatggaataagaatagattaataaaagggattctatattagttcagtacgggtagtgatttgattgatctaataggaaaaagagtccaatttcttttttggaatttacacccccctgcttcgcttagtgtttaaactaaaaatgcatgcatctcgcactaagttatcaaattcaataaaaaaagagaaattttcaaaaagaaagaaagtgaatgaatttagtagaaaagtactgtatcggatttgaaccactgactcacgtcttaccgcggcattactctaccactaagtaaaaaaagccctttatcggatttgaaccgatgacttatgccttaccatggcattactctaccactgagttaaaagggcttcttattcaattccaaaattagccactttcatttcccattataggtctactccataatgtacattatatctgtatatatcgagatatataagtctattcatggtcaggttcaaaaaaatcttaagaaaatcaagaaaaataggaaaatctttcatattctctcttatcacttgcacaaagtatagggttttttatctttaggctattgacttttcacatgctcagaacggtctgaaaaattagggacttttttcttctattggctgatcttatcatgaaaactttctccatttatgttttatttcctctaattgggtggggtataaacgaattcgcgcccttcatatacccatatggctgggtattaattttcagtgatatacttcttgtctgttttggtgagaggttgaaacaatttttaacaggcatcccttggaaaaaccttcgagttcaaaactttgcaatttttcttaagcggatttgttgaagcgattttcagcaggtacctcttctcttagaaatatcttagaaatagggtacttgaatattctcaagggattctgattggtgcattttgaacaaactgtagtggagttttatcaccaattttcttgtaaaaggcgggcagtagaatttatactgctcctggttcagggttttccgtttccgaaaactagcaaaaaaggagggttctggaacccttaaggttcgatggtatatggatatggaaaatccaacatgccccatcctaataggaaaaggaagggaacagatacccaatatgattattgggaagaacttttggtaatggtctcgggcctatatgttcttttttgtgtgttcttagttctattcatcttctttgattcttttaaacaagaatctaataaactagaattgagtggaaaagaagagaagaaaaagttaaacggagagaatcgactaagcagagacattcagaatcttctttacatcaagtaaatccttcggctcctatgtgcctttttctttaagttatttattgtttctctcaagccatagggaaagtgtctatgataaataaaaaaaaacatctcactctttctctatggcccagatttcatgataagtgggggaagatgttttcttccccaaattctttgttcaattctgaacaaaaaagaaagtaaaggaaaggcccgcgatcgaagtaccaaccgctaactgtgaggaaccttctctgtttcattaactaagagggaattagcatctttctcgaatggctacccttgacaaagggtagcgttggtatcagaatttacatgtagcgggtatagtttagtggtaaaagtgtgattcgttctattaataactgaatttgaaatgatatacttaaggcgtccttaaggttttttatattccgatgaaaactttagttcttagaaaggatttactcctttttctctcaatagcatattgaggaagaatatgcattttcgcgatttgtacccaaagactaattgaaattgcatccaaaaaacaaataggatttggattatgagtacagagtcgcgaagcataattttgcattggattaaggattccaattttttaaatatgagtaaaggatctatggatgaagatacaaaaaaatttatttccaatcgtaactaaatcttcttttgttaaaaaaggaaatggaagccaaatagctaaaaaacggtagttttggtttactagaaccatcagcatattgtttcagctcggtggaaacccaattcttttcctcaggatctcttaaatgaaattagggaacgaagtaattagattagatagatttaggcaaatttctatctcctactctttagggatcatctagaaagcagagagccttggttccattcagacaaaaaagctgacttagatgttaagtggtgagaatacccataaaggagccgaatgaaatcaaaatttcatgttcggttttgaattagagacgttaataataatcaaccaacgtcgactataacccct

SEQ ID NO: 64928 - DNA, 1699 bp, Oryza sativa
gttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaacgcatagtttcccctccaaaaataacctctcccgttggggaacgcattagatatttacctaaacctgtgggtccttgggcagatcccacattagctccaagacgctgatctctaactagaaaagtaaatgcttgagcttgagaagcttctggcccagtaggtccataaaactcactcggataagctgtattattgaaccagacaaaacaacaagcgataaaaccaaagacagataaagcgcctaaactataagacaagtaagcttctccagaccatacaaatgcacggcgagcccatgcgaagggtttggttaagatatgccaaattccgccaaatacacaaatgaaacccaaccatacatgtcccccaattatatcttctaaatcatccacactaacaatccaaccctctcccccaaaaggggattttagtaaataaccaaatataacaccggggctaagggtcaaattggtaatttttcttacatctcctcccccaggagcccaggtatcatatataccgccaaaataaagagctttgagtactagaagaaaagcacctatacctaacaaaattaggtgaatacccaaaattgtagtcattttatttctatctttccacacataaccaaagaatggaaaagattcttcaagagtctccggtcccagaagcgcgtgataaatgccaccgaagcctaagactgcggaggaaattagatgaagtactccagatacaaagtacggaaaagtatctagaacttctcccccgggccctactccccaacctagagtagctaagtgcggaagtaaaatcaacccttgttcatacatgggtttttctggtacgaaatgggccacttcaaataggttcattgctccggcccagaatacgattaatcctgcatgggctacgtgagctccaagtagtttacccgacaaattgataagtctggcattcccggcccaccaagcaaaaccggtggtttcttggtcacgaccagctaaaacaaaagttccattaaagagcgtttccacgtggtagaacctcctcagggaatataagattttcatgaggctgatcctgagctgccatccacgcacgaataccctcgtttaaaagaatatttttggtgtagaaagtctcaaattcaggatcttccgctgcacggatttcctgggaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagt

SEQ ID NO: 64929 - DNA, 3932 bp, Oryza sativa
  unsure (1)..(3932): unsure at all n locations
ccctccgttttaaaagaatatttttggtgtagaaagtctcaaattcaggatcttccgctgcacggatttcctggaaaacgaagtcataggcacgtaggttcagagccaggccgactacgccaatagcactcatccataaaccggtgaccggtacaaatagcataaagaaatgtaaccaacgtttattggaaaaagcaacaccaaagatttgggaccaaaagcgattagcggtgaccattgaataagtttcttcagcttgagttgggttaaaagcgcggaaggtatttgcaccatcaccgtcctcaaatagagtgttttccacggttgccccatgaatagcgcatagcagagccgcgcctaatactccggcaactcccatcatatgaaatgggttcaacgtccaattatgaaatccttggaagaagaggatgaatcgaaatatcgctgctacgccaaaactcggcgcaaagaaccaaccggattgccccagtggataaatcaggaatacggaaacaaaaacagcgattgggccagagaatgaaattgcattataaggccgcaattgaacagaccgagcaagttcaaattgacgtaacatgaaacctattagtgcaaaagccccatggagagcaacaaaagtccacagaccacctaattgacaccaacgagtaaaatccccttgtgcttccgggccccatagtagcaacaaagagtgtgctaaactattggcaggggtggaaactgctgcggttaagaaattgcaaccttccaaataggaactcgccaatccatgggtataccaagaagttacaaaagttgtccctgtaaaccaacctcctaaagcgaaataagcacaaggaaaaagcaataggccagaccatcctacaaaaacaaaacggtcccttcgtaaccagtcgtccataatatcaaataaatcattttcttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttttagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatcgtttgggactttcgaattggaaggaattctgacccccggattttctcgtagataaatgtatgaaacaaatccaatttgtaagaaaaaattttggatttttactcgtcacgcccaggattacgtcctggatcattagataagaatccaaagataaagagggaaacaaagaatatcactactgtataaacaaaaagtttgagagtaagcattacataatctccaagatttttttttaaggaatagattacccgtttttccttaccacacaaatccactaggatgggttttgtttattttgacacctaaaaatgcaaaaatcaatttttgaaaaaaattgcaagaattgatttataataagcactcttatcaataaattaggttaggtattgtgcggttacctaaagatacctgctcaacgtagatgcagggagtagaaaggctgatccaaatttattgctgcagctatacattcaatgtagaagaatttgaattttagaatcgaaggttcataatataagacttctcggctcttatccatttttcgaatttttttagaatgaatacatgattcaatttggcagacagagtagtaaagatttcatcgaaaacttacagcagcttgccaaacaaaggctaatagaaaaaagagtacaggtatgacaggcataaaatccacgattggattgaaaatggcataagcttcgggcaatttggcgaagaaaaaactagtcggataaataacagaattaaaacaaatacaggttaaactaagtatattaggcataacaagcgtttcgttcttgtagagtagataattggattttgattgagttatttttctaagggaaaaaggaaaaggaggattcaaaatccttttttcttcggactttcccaaacacaaaatacctccttgtattcgcactctcaaatgagagtggaagaaattcgactttcatataatatcttaatagaattccatgtaatgatcaatgcattttttggattctatattattcgcatgtctagaatcctaccaagagaataccccccatttttatgtaattgaagtaggattgacgaataagaaataaacataatactgtttattagtgtcgcataaaacccgaaatggggcgtggccaagtggtaaggcagcgggttttggtcccgttactcggaggttcgaaccnnnnnnnnnnnnnnnnnnnnnnnnnnnatccttccgtcccagattttttctgatgaaacgaaagatgaaatcgtattgtattctgcacgagacataaagtttattaaagagaatttttttctcttataaactcttagattcgatgcagtcctaatgcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaattttttttatagtattttattagtaaaaaaggttccttcttctttttctttctttggttaagcaaaaacgatctcgatccgcgattttttaaatatccagaatgatccatcccggtaaagataagataagaactgctcgttagatagaatggattcaattttgatttggagttgcttcttttaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacgg

SEQ ID NO: 64930 - DNA, 884 bp, Oryza sativa
gaagaaatacgaagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgtctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatggggggctgcagga

SEQ ID NO: 64931 - DNA, 1293 bp, Oryza sativa
atttgcctctttcttaatcctatttttgactggatttatgtcgtgccaatccaacataagcctttatttttttgagtttttctatctaatttttttcttaccattgtatttccattgacaaaggtccattgaacatctagaatttgtagatggataagtctctttatcctcactccctattaggttttttgcctacactttgctcaaatggtagggttgtccctcttgtttgtactctcatacaagatttatttatttatttaaataaaaatgctaaaaaaatgacaattttacgatcgtgattggtgccacttttaaccttagtgaaatttaaccagacccgttccttttggtatctgagtgttttcaatggtgataaaatctttcttttaatgtcttgctattttaagattttgacaggggtgtgcggtgtaattccattgatttttggatttcgatcgtatctaagatcctagtttatctgggattgctaactcaatggtagagtactcggcttttaagtgcgactatgatcttttacacatttggatgaagcaaaaaattcgtccagactcttggtagagtctataagaccgcgactgatcctcaagggtaatgaatggaaaaaatagcatgtcgtaataaaatcaatttcttattttggatttttggaatggaataaaaaaattctgattttctgggtctaatgaataaatggatagagcctggctccaattctggtaaaacaaaaagcaacgagcttaacttcttaattggaagaactccctgatctaattagacgttaaaaatagattagtgcctgatgtagggaaaagctggttttcctatgagtagacctttgattttttcttttttttttagaaatcctaattattcttgattttggattgaaaaggatgttatggattgaatgtgtaaaagaagcagtatattgataaagagactgtatcccaaagtcaaaagagcaattggcctgcaaaaataaaggatttgttctcttttgtaattagaacaaacataaacaaattggatagaaaaggagcggaaaaagatccgtggattagactccttttcttccccaggggtttgtattaaaaaatgcaacaccctgttctgaccatattgtactatgtatcaccatttgataaaccgagaaatatttctctctctctgattcaagtagaaatacaaatggaaaaattcgagggttattcagaaaaacttaaatttcctagacaatatttcgtctacccactactctttcaggagtac

SEQ ID NO: 64932 - DNA, 6952 bp, Oryza sativa
cccgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgatagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctgggga

SEQ ID NO: 64933 - DNA, 1158 bp, Oryza sativa
gtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttctttttt

SEQ ID NO: 64934 - DNA, 2399 bp, Oryza sativa
  unsure (1)..(2399): unsure at all n locations
tgtattttccatatcccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtttnttaataaaattnaaaggganangnananattctttttnnctncngngatatcaanttcccnccctttgccnnccctcattttctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcccagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaatttcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaa

SEQ ID NO: 64935 - DNA, 2867 bp, Oryza sativa
  unsure (1)..(2867): unsure at all n locations
tagtggatccccctgcggctggatcacctccttttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggaatatagctcagttggtagagctccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatccc

SEQ ID NO: 64936 - DNA, 1347 bp, Oryza sativa
tgggtagccaagtccggagaggataactgctgaaagcatataagtagtaagcccaccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtaggattcgaacctacgaccagtcagttaacagccgaccgctctaccactgagctactgaggaacaagggggattcgacctcctagagttcaactcccgctctcaacccatgaacaatatgagtccgaagcttctttcgta

SEQ ID NO: 64937 - DNA, 3536 bp, Oryza sativa
ctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtagatttcttcgaacctacgaccagtcagttaacagccgaccgctctaccactgagctactgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatggatcgataaatgtttagatttctgtgattattttttacgaggagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgctttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaatgaaattggctgatatcatgacgatattaggtagtatagatatcattatgggagaagttgatcgttgaaatgataatagacagggtacaggtagaagctatcaattctttttcgaacttggaattattaaaagaagtctatgg

SEQ ID NO: 64938 - DNA, 5970 bp, Oryza sativa
  unsure (1)..(5970): unsure at all n locations
tactatttctttagccgatacaaattgagacccacatctcgcgaatatatcgattccagccaacgatgacactatgacttcaattcgattgattcttaacaaattagtatttgcaattcgtgagggccgttctctctatataagaaatcattgattaagaagaatagttaattcttgggcaactgcgtagatttatggaatcactcactattcttttttgttttgcatacaaaaaagacggggaatattgatatatattacagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttattttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaataggcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatgaaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttctccttttattttaggaattttgggaacatttcaacaaaggaggtctttcacaggtcaaacgagatctaagacttatctaaaagaaattactaaattgaatctatttctattaaaaaaaattgcattaaaaaacccgatcaaaaagggcgagcgaagtaagtgatcgaaaaactttgttctttgttcgtcctatctataagaggagagcatatgaaaaatgtaacccattctttcgtttttttagctcactggccatccgctgggagtatcgggcttaatacgcatatttcagcagcaaatctaataaatctaactgtagtggttggtgtagtgatatattgtgcaaagggagtgtgtgctagttgtgtatttcaagaatagattggatctatccggctgcacagtagaatattttttagtattgttagaatgaaaagaaaagggtgcacgatctcgacgaattacttctgaataaatgcagaaatcatatgaaagagccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaagcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaata

SEQ ID NO: 64939 - DNA, 4410 bp, Oryza sativa
  unsure (1)..(4410): unsure at all n locations
gggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 64940 - DNA, 1313 bp, Oryza sativa
ctattctattggtctagacatggtagagggcctgtattcaacctttttcgtccaccggttccagcgctccagagcggagtagagcagtttggtagctcacgaggctcataaccttgaggtcacgggttcgattcccgtctccgcacttagcagtctgtataaaataactattctatttgtctagacatggtagagggctgggtggttgggcggtatccaaccctttttattcattagttcccgaccctataaggccaaattgagcaggttgcgaagtaacttgctaccacaagaggaactctcaaggccccctccctaccttgcagaaaagaaaaaataaatgaaagaaaggcacagtctatctcccttccctttaaaagctgtttgctggttgtttgtttcggtgaatccccggtttagggaaccctgttgccgagttcgattcccgccgctgtagtgctctttttttgagtggggtgcaaagggggttaagatagtaaaggggtacggtactagactaacacctattactttaataaaagtagactaaatttttatcatagtaccttactaaattaagctggcgagcggcgggaatcgaaacccgtatcttctccttggcaaggagatgttttaccattgaactacgctcgctacgtcctatattttatagggtatatccgcctgggtcgaccgtctatgtctgggtcgaccgtttcattttctatttgagttttctttttattaatttaattgtctgtcaatcaattcggggcgcaaattgcattttaatgcgtctcacaatccgaataaacggcccttttttattttgtatcgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaggaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggatttgt

SEQ ID NO: 64941 - DNA, 2829 bp, Oryza sativa
gcacgagcagcggattcgacgacggggtgtacccagagggccagatcctggaggcaccaaacctcaggacattcacattcattgagctcaggacagccaccaagaacttcaggccggatagtgttcttggggagggaggctttgggagggtgtacaaaggatgggtggatgagaagacgatgaacccggtgaagggcggcaccggcatggttgttgctgtcaagaagctcaactcagagagcatgcaaggttatgaggaatggcaggtaaaaatcaggttctttgtttagaaagaaagaaaagaaatacttgaattgcaggatgccaagttggttagcatgagcataggaatcttgcatgcttatggggtttgactttagttttgattactgctgtataataaacttaacaagttagaggatgggatcactttctggcattgcaccattaatggacagataaaaaatgcaccaaacttttgaagtttctcctcatggtcatctcatgcttatggttctttatgtttgtttagcttctgatgacttggctgtctgttttataagctgcaatgtcaattctttaataggcctatgtaatctgggtagtgccaaacggccaatagcccaatgctgaccagaaccatattaatgttataatactagactcttcataattcctgaccagaagcatcctataaaccacatgtttatcacaatgcagtgtttctctgggtcagttttggtattccaggcaaaatattacagctacctcccacatgcctttgcaaactttaacaagatatactactcaattaacttagtttactctaacagatgcgattttttgtcaacattaataacatctaatcatatttctcaatgtgtaccctgcagtcagagataaactttctgggtaggctctcgcatccaaacctagtcaagctcttgggctactgctttgaggacaaggaacttttgctcgtgtatgaattcatggccaaagggagcttggagaaccatcttttcaagagtgagttcttattggtttgttgctaatcatttccatcatcttatttatatcatgaatgaagttctcttaggcatttcactgaaaatttggggtgattaccttgctatgcacactgtatttctttccccctgcaatactttgtcttctggagtagaaaattctaaatctgcaaacatataagtgcatgatgtgagaatatctcggggcagttacttgacttgattgagaggtatactgatgatgaaactggccgcatctcttttcagaaggatgtcctccactatcatgggaactgaggctgaagatagccattggtgcagctcgaggacttgcgttcctgcatgcctcagaaaaacaagtcatctaccgtgactttaaggcttccaacattcttctagatgctgtaagctttctgctatttaatgtgcctgcaaccttctcattattgagttcaaatgctgatggtgttctttggcagaactataatgcaaagctctctgattttgggcttgctaagcttggaccaactggtagcaactcacatatcacaacaagggtcatgggcacatatggttatgcagcaccggagtatgtagccactggtatgtgtccttacgcctaccctgcagttaattatcaacacttaacactgcatgtgatagtcatagtacagctgaaatagcaatatgtgtggaatttgacctctcagtcttcatatgttcccaaatttagcgtttttgattgtcaatcatgtcacttacatttttggatgcatgctatatctcctccttctgtccaatgataaaattcggaattttagctaacagacaatataaatagtccatggatgttgaatagaagtcaagtgtgaaaatgaatattgcctaactagaaaggaagcaataccaagtcattgaatatatagaatagtgggtatgcactagctaagtccagagtctagacatgtatacgcatgtgactgtagggctccatcttggacagatatggatgagtaacatgagttagcacctactgccatccaagtggatgatccatcttaggaaaatgtgtgctaacaatcctttttatgtacggatattcgcctaatgtcactttccactcaaaaaaaagttgacacagtgcgcacccaactttcctcaactcgtaccattaatatttcagagttactagttagttttgcatcccacatgaaattcagaattcaagtttctataatacattgtcaaattattattagctctgaagtacagtttactatctgtagatactttcttagctgccggtggttattttcgctttctcactatctgctctactaaatcatgactaggtcatttatatgtcaagagtgatgtttacggtttcggagttgtgatgctggagatgatgtccggtcagcgagcactagaccccaaccgtcctaatgggcagctcagccttgtggactgggcgaagccctacttggcggaccggagaaagcttgcccgcctcatggacccccggtttgagggccagtataactccaaacaagctgttcaggcggcgcagttgacgttaaattgcctggcaggtgagcccaggagcaggccctcaatgaaggaagttcttgagacactcgaaaggatcgaatcaatgaagagccgagcaagggatgcaagaggaagcggttcatcaagggaccatagccatggtcgcaccacagcgcaccaacggtcatcgccgcgccctgatggtcgccgtggatcaaggaccaatggtcacgccacggggtgcaggaat

SEQ ID NO: 64942 - DNA, 3166 bp, Oryza sativa
taatttgtaaccactagaaatagaaggaataattcttgaaatggcttgctcaaaatagcttccccgctgtgttcaattttgtgggtcttgcaaccggagcttgactgcataagtgtgaacattagactgcatcatagtgagtaaaccttgctacttggtagaaattttggccagttgtgtgtgataagaaatcatttcttgagcaaatttgccgatttttgaaaagtgacaagcagcccttgtaacaaaaccaaggcagtagtatcttcagaattcagcaattatgtttttccggagggctaaatatggcagcccatatactctctgattgatgtgagttgtgatcctgctcttttttctaatgacaagttccaaatttccaacagctagaagtatgaatatgcaatgaattactttgcacaaaatgaatacagagagggaattattgtggccataaaatactgggaaatgtcaaaagcactaaaataccaaaattccattccatggaatggaatatatgcatacgtgttgacctgtcagtgttatgacaggctgttcatcctgacttgtgtgtggccgccgcccattttgacgtcaaaagcaacctccatttctctcatgtctccggccaaccgaccaaacatccatccttccttccgtccagctccagccattgttgattgctggacacagcccttgcttatctttgatgagaaatttaacgatatcccttaaagtttttttggtccaaagaaactacacaagaacagggcagaatctttgtacggcctccaagaaatgcactaacagagaaagaatcatcacgatgcagtgtctcagttcagggctctctgaatcatctgcattcagaagtcgctcaaatataaaagtgtagagtccttcattttctttaaaaaaaataatcagtttccacgtagagttaagaaactggaactgtctagacatctctcgtatgattttttggtatgcaaatatgagaagaagaaaatgcagccttgaagaagctggcccaatccaaagctccagcccgatatagaatgaaaccatgagcgcagcataggacgaaaccactatccaaaacagtgacttgatttgctccggtcttgaagatggggatgcgttataccggttttgcggttgagggatatgattcaatcaatagaagagttgaaggaggtaaaatagacttatttcataaataaataaggctagagacggcccaatacactaacttcactaaatgaatttttttcgtttttagattttatttttaatatttacagaaataatctatcgaccaaaaaaattgcagaaatagcccctgccgccctaatggtgggcggcaagctgacgtggcagacggtgggtcaaccgcgccgtctgccgccgtcggccaaaattgcgattaggcccttgccgcccgtacagagggcggcaaggggctaattgcaattttggcgcccataaagagcttgcggccgtactttttcatctgggtcccttgccgggccaaaagatttttctatgttatgttaataataaataaagaagtatttattggtaaaacttgttaatattgttataaaaatgtattgaagttggttgttgcgtaatttcatatgttaagtgaggtattattttgtaccttattcgacgtattagtactcggataatttatataggcctatcacagtctgggtcgtagaaacattatatggacttaaacaaggagaattatataacatgaagaaatagtagtacaatttgaacatgatacaagtatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctcttctttctcaaaccgcgcccctacgtgaggatccctcttctttctcaaaccgcgctttagtaacactgtattgctctggtagttcaagctgcataacacggctaggtggagttagaacccttctggtgtctatccattctctgtattgacatctccttggtggttcctgggagaaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgtagttcacgacattgtcgttcataagccgcttttctctgtaagtattgctcagtactttcggatgcgaaataccagcgactttcttgtaaacaagtggttaggtcgagaatgggattttctgtatcgacccactcgatgtatgcgcaagccgtagtgcaggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgcaacgccagtttggatcctcaacacctcggcgtctagccattgacgaaagccggtcgaatttgtaatgaagcaagtggggaagagagtactgaatgtgactgagttctgaaggagtcgtgaaccgtgagtagctccccgcacgtccatgcccggaacgtcccaagctgagccccctgcaccgcagtaaggtgagaccggtgtcggtgatctattgccgggtccaacaactgaggtgtatcctgacgtgccatctctgaaaaatatagtgtttcgtattagaacaattcaaaaaatagtactgtaaaacaaaagataacttgcaaaattatgaaatagtaataaaatcatgagattaattatgtacaacaagagtacaggctatttaaatatagcaaacgttactaatgg

SEQ ID NO: 64943 - DNA, 16810 bp, Oryza sativa
  unsure (1)..(16810): unsure at all n locations
catatcaggaataaagctgtactcctgttaaaaaaatttataatcacacacatgcacatctgagttatgattcatgtgcagctacgtggctcttgaatcctgctcctacggacaacatgtaggagtactgaagtaacccatttttaaattattttcgcagcgccggctgaacattgccggccgaaaaaaattattaattaagaaaaaataattatattagaaaaaaatataatatgcatcacttacataaagacaaaaaatataactattatcacctcttcgtttggatgactaacgaataaaatgcatgcatctaatggaattaaatattttgataatgtatcccacaaaaaaaatattttgataatgtagggttttaaaaagtgaattaaagatgggtggtaggtgcttccttgcatacatgcatatatgtcttatattatgaaatatcgaaaaataaatgatggtgccttgtatatatatatatatatatgagatgagtgaagtactatttatgtatgacctttgaccgcttgacttctagaaaaattacaaacacttagaaagatgtttattaaaacactacaatttaaaggatttcataccagtcaactgtatcaattgaaaaggaacggaggcaataataaaggtacaacaatatagttggtgagacaattgatcaacacaattaaaagttaaaagcacactagcgcaagcacaacagccaaacagagttcatgttatatatcttggcgcattccagtttgaattaatacagcttgaagtctaattctattggggctaggggtacacaaatttaaacaaaaccgtcaagcttaagaactgctagtgttcatcagttggcgcatggaatcaatcacaatccgaatcactttgtgttttaaaatattcaaactgtattcaatttgaaatgcgccaagattccaggaacaaaactaattttacatactccccctttggattactatccaagaagaactagtcgtcgtatctgcatgcgcagctacgtgtctcctgttccttctcctgcagaaacaatcaagaagtaacagtttattagttgtaaattagctgcaagaatcgatttaggcccttttacatcccacgcaaaaattttacacctatcatatcgaacgtttgaacacctgcataaagtatgaaatataggctaaaaataactaattatacagattgcgtctaatttgcgtgacgaatcttttgagcctaattgctccatgatttgataatatggtgctacagtaaatatttgctaataacatattaattaggcttaataaatttgtctctcagtttactaacgaagtctgtaattagtttttttagtgcctaaacaccttatgcgacaccctatataatataattaatatttgatgtgacaaactgaaactttacaccccatacttggaactaactaatcagaatctgacgagaaggccagctagctcaagacaaacggcagagcagttaattactactagctccagctgttagaagaaaaactgttacatctgattatacagctcattaattcagagattgagagagtgaatttgtgtggtgaaaacgtgtcctgccgtgtgatcagtggcttgaatttcttaaacccattgcgatcacttacgtgtcagtcaaagtcaatcaaccaaccagcaacttggaaatgaaaaaaaaaaagtactgtttgattcagacattgggtgcagcctgatggatgagtggtggactggtaggtacatttgcgtttcaacttagctaatctaagctaatttatatatgtcgtcagcaacgctgcttacgcatgcagattgatgatgctgggatcgatcgagctaaagtgatcaagattaattaaagaaagaaaatgagttcttaattgtataatactcgtaaggttaggtttttggtgtcatgattgtgtgtgtactgaattactagtattttgtagatgttgcacatgctgtgtcgatgactggctatgcgatcttaatcttaattatcaactaatatccaagaacaattacctcgtcagcgacaaggagttaggatttataccagaggtcaaaaccatggaaatcgtcaacatgtctgtgcattatgtatacgcattgaagtggagattaattgctattaactgtcactgcctctgtatcttccttcttcattaatccggtgattaaccgtgctaattaaccttttggaattaattagttttagttactattccatctattttatattacaagtcgtttgacttttctctcagccaaatttatttaagtttgactaaatttatagaaaatatagtaatattttttaacacaaaacaaatatattatcaaaatataactaatttaatattttagatgttgctaaatttttcaataaacatgatcaaatttaataaagcttgattaataagaaaaaaatcaaacgacttccgatataaaatgaaatggagggagcggtactgtgttatccatctttggtttgactttgaccaggtatgcatcgtgatgtgaccttcttgctgagggctggctacttttgaaattggagatgatgtgattgaaaagttatatgtacatgacagtttaatatgataaaaaagactgaagtttagatctaaacaaagccttaattagcttccgtcttcttcttcatcgtcaggtcatcctcgatcagttaatggcttgataattaattaattaaatcgattggagaagaagacgaagacgagaaggacgacaagcaaagggagcgtacgagtgacgctcaataataatgtcggtactgaggaggaagaagaggaaagaaatgagtgggcctaagtgggccgatttggcgagaagtgggtccagtctgtaggattatatcttgggccgtgccaggacagggcagcaatcgactgcagcaacagtaaaaccgcttgtcaaacaaccccaatagaagttatagccgcttattacaaaattctttgataaactaaatgcaaatgataaaaaaaagtatgatgaaaagatagacgccggaaaaaaacatattcggcaactaataattttactgctaaatcttcatctataggttgataaaaatttataaaaccgttgtctttaaatgcaaaatgtaggagcttattatcttcatcatattttagttggacccaaaatcgaaaacattaactagtattgcctgcatatagaatttagtaagagctctataaaaaaaatgtaccattgctactaagccgaaatactcaacgtaatttctagtaaggttaggctcggtagaaccatatgtgtaatgatataatatctagagtatatatattgcacatgtcgcgacgttgatgactggctatgtgagcttaatctcaattaatttccaagaaaaaaaatacctagagtatatatattgcacatgttgcgacgttgataacgggctatgcgagccttatcttaattaatgtccaagaaaaaaccgacctagtaattatcgtcggtgacaagaagtttgcttgtgtcaaaactattgggccaggcatgggttacccgttggtaaaaattgattcccaatttttgcccactgcgctttcggtttcggacggacgtgtccacatgaataccccggacacatgggtaaaattgccatccctacatacatacatacatacatatatatatatacatacatatacatatatatacatatgtatatatacatatatatatatatatatatatatatatatatatatatatatatatatatatatatatatagacacacacatcaacaacaacaaaaaccctaacctaatacatatccctccatccgcttcaaggcggcgacggctggcagctggctctgagggcaacgcggccgagcatggcgccgaggcggactcaggcagtgagcggcgagcagactccacgtcgtcaccaacttccttcctcctggtcgccgagtccggcccagaggccgccgtcgagctccgcttcgcttcctcgcgtcctggtccaaggccaaggccctcctcctccaccatcgcccggcagctggtgacacggcggcgcacggcaggcaagcccagtgagtagcaagcacgcatcgtgatgtgacattctagcttagcttccgtcgtcttcttcttcggctgtgtttagatttaaagtttggatccaaacttcagtcttttttatcacatcaacttatcatacacacataatttttcatttttcagtcacatcatctccaatttcaaccaaaattcaaactttgcgctaaactaaacacagccttcgtcaggtcatcgccgatcagttaatactcctactaggctactactcccagctgaattagctgcacaattaaatatcggagaagacgacgagggtgacttgttgggcctaagtgggccgtgtgccgaacaaatggcccaagtctaggacaatattttttgggccgtgatacgacattttgccacgagggcccaatatggatattttttgcattttgctccctgatttgaactgtatttctgcattttttgacggcatctcatccaggagcccaggtcggcgccgccgcacacgcgtggcggcctcgccggcgactcggctgctcagagcggcgcgaagaaaggccgcgctggagtctgcagccgctgcgtgtggcagagtagagaccagccagggagagcgcagctgtcagcaacctataccagccagtgagcttgctcgcgccgttcgccggggcgggggaagagaaccatctggcgacaaagcacaggtgaaatccagtctctgccaagcaatctctaattccccccatggttccctaattgtgtgtgtatttcccatcattagtgctgttctaattcatcatttgtgctgtttgttctcaagcgtattgctgagcgaatagaatgcccaaagtgcttctaatttgtatgcataggaattcttgacctgtcaagttacacactgcatgagttgatatgggaacgtgcggatagaaaaattcgtattttttggcgaaatttcatgaaacttgattgcatgttttgttctctgcgtttcattttggaatttggggttcaactgcagttgaaacgagtcatctcaaattcgttctgaacaattcccttcacgctgttcaaacgaaagcaaagagcctctcttataaacatgtttgcaatccggtggggatgatggcaatttcaaagcttccgaaacctgcaaggcaaaagtaaaaaatttcacattggaaagctggcttgatttgaaagccctataattttttttagtataaaatctctgtttcgaagtcaaacaattctgatcctgagtaggaatcactgatttgctaagctgaaatctgaatttgtttttgcactgaaattttatttggaaattgctcaaaaagaaagtccagtacatgtttagaaaattcctgatttcaggaaacttttaagccgaaaacctgagttggaagttgttcttgggaatttaccaattagtgtttttttgtaattataaatacaaatagtaaggacaacaaaatcctcccgctactttgtgacctaactgttggtttgcatattagaaacacccctcgtgctaaatccagtagtttatgttgtctgttagtttttgaggcaaacttctatatttgtgcaggtggctgtgatgggaacataagagaggctcttatgaacttctaattcatactagtagtatatttatgcttattatacatgctgacttgcaaccttttgctttatcatgctactatctggaatcaatattgttctaagtaacaacattttgcctaatcttaaaacaggaagcatgtcactggttaaccggccgctccctgcactgtatggaatttgcacggcctcggcgaagaccagagcttggtggctctgcagagatggcaatctcccatcaacaagtcgaatttcttgcacagagccatcgaatgggggttctgtcatggagttggaggtaatggaccgcaatgagcagacataccatgagaattcttctgcttctgaggatgaggacgatgatgaggaagaggctgtagagtggagcaaagatgagcttgatgccatctcggcactctttgaccggccgatgcgccagaagccaccaaagccgccaaacccggtgaggcagcgacctctcccgctgccactgcctcacaagacacgactgcccaatgctcctgcaccaaagcagcatatcaggctggcagcaagggctgcactttcttcacgctcttcattcagtgaccaggtgtgcaagaacccggaggtcctcattgggattgcccgggagattgcagcgctgccaccggagtctgacgtgtccattgtgctcgatcggtgggttcggttcctccggaaaggatccttgtcaatgaccattcgggagcttgggcacatggggctcccagagagggcattgcagacactttgctgggctcagaggcagactgtcgtgccactcttccccgacgaccggattctcgcttcgacaattgaggtcttggcacgcttcgaccagctgaagatggaggatgcgctagagcagtgcgtcccttcagcgagccgtgctgttcttgaagccatggtcagtgggttcatcagggcaggtaaagtaggccttgcccgaaaactcctcgagttcgccacgatcaacaagaggacactgagcccgagcgtccacgtgaagctgatgctggaggccgtccgtacgcctgagggctacgggctcgccgcggcgctgctggacgagctcggcgagaggccggagctgcacgttcggcagcaggactgcacggccgtgatgaaggtgtgcgtgaagctccggcggtacgccgccgtggagagcctgttcggctggttcagggacaccggcgggaggcccacggtggtgatgtacacggcggtgatccacagccggtgccgcgacgggcggcaccgggaggcgctgtccctggcgtgggagatggagcggcacgccggcggcctcctcgacctgccggcgtaccgggtgctggtgaagctgtgcgtggcgttgcgcgaccacgagaggggcgtccggtacttggcgaggatgaaggacgccgggttcgtcccgaccggcgacatgtacggcggcctgatcggaggctacgcggcggaggggaggatgggcaggtgccggaggctgatcagggaggcggagttggccggcgtgaagctggagaggaggctgctttcgcgcttgtctgagatgggggttgagcattctcagctctgaaagaaagaaactgatcttgctgttggcatctgactagcatggacattgcacagaaattgaactgtaaaattaggctctgcgtaattgcctttaacctgtagtaacagaacattacattatgaatatatttgttttgttgttggcttgttatcctctattacactgtccaaaaaaaaatctagctacgaagtttgtagttagaattgagttttttttagaccgaggggtatgcatattttttggttcatggtcgtgattgtatctgtagtttctgtacagagtagctgaattcctgaatgaatgtctgaattttcccaaacatatttagaggagatttgctccggtccaacaaaaagtatctcgaggtatcggtacctcacgataccaaatcgtttccgatcgttggatctaacaatgcatatccagcccagctagatccaacgatcgaaaatgatttggtaccgtgaggtaccagtacctcgagatactttttgttggacccgaacaaatctctattcagagtcctttgattcatgaaactgtcctcatgtggtagagctacaagtttttcagatccatgagttgttctcttcaaatttttggaaatttcttatgttgaaaacatctataccatgaatccatgatctaaactttgcacagtacagtaagaagtctgaatctgaaaaaagccaaaaaaaaaaaaactctgaaagctaaaggcaggcagggcagtggcctcgcgtggaaacacactcagtatccgtctcgctctcctgcctcgccgccggcgatcgatcgccggggagagggtctctcccccaaatgccgcgccgccgcctccctctactcctcctcctccccattaccctcaccctcttcctcctcttcccctctccccctcccccgcggccgccgccgcatcagcctcagcctcagccgctcccctgcggcgccgccccctccgacgccaccgccggccgctgggtccccacccgggagcccttgccgccgccgctctacacctcctcctgccccttccaccgcaacgcctggaactgcccccgcaacagccgcccacccgtcgccgcgctctcctgggcgcccgcccgctgcggcggcggcgccgtcccgaggatcgacgccgcggagttcctggccgtggcccgggggcggcggatcgggctcgtgggggactcgctgtcggagaacctggtcgtggcgctgctgtgcgcgctccggtcggcggacggcggcgcgagcaagtggaagcggcggggcgcgtggcgcggcggctacttccccagggatgacgtcatcgtcgcgtaccaccgcgcagttctcctcgccaagtacacgtgagtgctatctgctgaaatcgtgctgctttaatttccgggtttgttagagactgccattacatctttagattagactacaggatgtgtatatgagcaatctttgtatgtgtttatcgggatgaattgtagctaggtgaggtgagatttacccacattgcatcagtactgatgttttagagataagactgtaagtgatggtagattggtagatatgcaattttctccattgaatgtgatgcggtctatactctatagagatttaagttttctttgtatgcttatgaattggatgcatgagatagagatgattttttttataccataccaaaaaggcaattgcaggaagatcttggtaattcagtgatttcacaccactatgctaactaggaagtggatgtattctcaggagaaaaatggatgtcacatatattcctttgttgtaatatggatcagttccatcttgtttgtttggatgtcctgtgcttgattttggtatcattgacatggctagtatctgtgctctgcactctgcagtggtgtggttactgtcatactgtgattgtatctgatgttgtctgctgaatgctgtcaatacttatgtcgttggttatctttctttcatagattaataggtttgaggtgaggaggccagactgaaaaatatgagattatccacattgcactaatagtgatttagagataagactgtgggtgagtaagcagggagatccatagaatgtgatgaagaaattacgatttaccgtatttaaatacccaagcattatgatctatttgttgtgtaaaatttgttctgataatgttcaaacatatgttatatgttatcctactttgtgctgttaactatataaccatatggtagatatgtattgacagtttctgatgccgttcttcttgtgttttggctgtttccttcaagaacttaaaatctacaattgttgaacttaagactatggcattttgacatttatactgcatgaggttgtgctttctttgcttcatatgataaaaccataaagctcacatggtggtaactaatgatacgaaggtggcagcctgtagagaattccaaagagcttcacaaggatggaataaagggaacttacagagtggatgttgacattcctgctgatgaatgggtaaatgtcaccaggttctatgatgtgctcattttcaacactggacattggtgagttaattgtttccttagcattaagttcttattgcatgctttgctgttgtattcgtcttgtttactactagcaaagtagagtggaagtttcatcgctacctttttcttaaagtagggttggaaattgttcatagttccttatgatactctgactctaagcattgcatactttttattctggacatcacttgggaggtgggctcgtcatacctttcttgcacagccttaaaatgttcttttggttttatattgtaaatttcctccaaggatgccatctcctggatgcgtgcttctccataaaattctaagcatagtagatcatgcttgtgcatcttgctttgtaaatttctttggataaaattcttgtgcgtctccataaaattctttgtaaattctaatttgttcctaggttggttaggagccatgcgtgcaccattcctgttataatgcttgatgcttgtcccttatcaggtggggcctggataaattcccaaaagagaccccccttgttttctaccgaggagggaaaccaattgagccgccacttggcatctacgatggattgaaagtagtcctcaaaagtatggcctcttacattgaaagggaggtcccaagtaaaacactgaaactgtggcgctcacagtcacccaggcacttctatggaggtgaatgggatcacaatggcagctgcgtgtctgatcggcttctacaagaacacgaggtaacgctctgagttcagactgtttttgcttcagaaatgcattttaaagttctgaatcatgacgcggctgtaacaaaatcttgtgcagctcgacttgtggttcgatcccaggtttggaggagtgaacaaagaagcaaggctagtgaattcggcgattcaggaggccctgattggcacagacatccagctgctcaacctgacctacatgagcgagttccgtgccgatgcgcatccggcaatctggctcggaaagaaggacgcggtggctgtatgggggcaggactgcatgcattggtgccttcctggcgtgccggacacttgggtcgacatcttggctgcacggatcttgcatcacttcaagcaggcaaatggttgatgacatgctgaagcttggaccattgtggcaactgcactgtaaatgttgtgtgggaacaaacacgatgaatggcatgctgtatttagaacaggagcattaaaaagctaggtagctactcttgttgcctgtaattcttttcttcttatggaaaaccaagataggagatggtggagttaactgttaagtacacttaaatacttactgaagaaattttgtacttgcacacttgacgttgatgaaactgcaattgctcagtagagtgaagcttcacactttccagtcctctcctctctttggagtttagagctatgaaagaaacgttgttgggttttaatcctgattgagctgatgctttaaatggattttttcttgtgtgtgttctgtaatcctttccatacacaaattacaacactttatatatatatatatatatatatatatatatatatacagagttcaatcagaaatcagattttctacacacggatttggcacgaatctcaaggtagaatcggacggtggatgcagccacagcaccggtgccgaagagaggaagaaggggaaatcaaatccgagtcgtttgctgcctgcgacaagcaaaaaccatcaaagattaggcggcggcggcggcagatctctcctccggcggcaatggcggcgcagcgcgacgacgaggccgggtggtcggcggaggcggcgcggcgggtctggggcggcgccgtgccgctccaggtccacctccacgacgccgacgtcaccaccctccccccacctccgcccttcctggtaaagcctcatgcttttcccatcatcgtcttctccttctcggcctgtggctatgctcttcaattggaggtctcccatccaaatcttggatctttgccacgagttgttggatcccgagtactcagattctctggattactaggctgcctgtttggattacaatcgttctagcacttaggttgttgattgcagttttaattaggattcctgaatttgtaggtctatgtacaatattagggggtgccttttttgactcagtggacttgattggtgaattgatgacttgcttgttttgttcacatattatgtgtaaagaaaagagttgctgcatgatatatagtcattgttctcccttgtttttaccaagtgcaacaaatgcaagttatacttttgagtttgtacacaccatatatgttaaggtgggttcattgctcatctttccctttatgtgagtgatcttttttaataattaatttacgttatgttatgatacttcattaccttatcggctttacttatggagttctgtttcatcaataacagactttggggccaagaatcgggtatcttccactgttggtaccaattataaaggctcattttagcagcacactcccgcctggtattgacactgtttggtttgaatacaaagggctgcccttaaaatggtaacatacgttatctcctaccaatatttatggagagaatctactcagtaccactgagttggacacacttcaacaatatgccactgactttgtcgatatccataatatgccatcgccttttccttaacctctacaatttaccatcgccgtcaagctacacgctgtttgcactgttaatttttttagtaatgaccaaaatatcctttgaatcatctaatccgcatggcctagggccctttcttcctagcatcgcatctcccaacgccgcattgccacccttcccagtgccgccacggcgcgtcggcgccacgccgcatctccgcctaccgccgctcacatgtcctcgccagcaccgccatccctagcgccggcacgacctccgtcaccagcgtcaccatccgtagcgctggcccaaccgccatccacagcggcggtccgaccattgtcgtcaaagccgtcgtcacatctaacgggagatggcgtccctgttggagggctgctggtggtgctgccatcgtcattagcgctgccgtcgcaaacaaggggacacaacgcccctgccggagagctgttgctggtgccgccgccgtcgtcagcgccgccatcgcttgcaaggggacatggtggccctggccctgctggagtgctggttctgtcgtcagtgcaatcctcaaccgctcctcaacagtcatcggcacccaatcaaagatctgccccctcctgtcctgtagccttggagatatttgctcataattaaaatacttaaaatatgtgctcgtaattatttataatcatgttgcataaataaacagttattataactctcggtaccttgcacgacatggtctcagtgctgccaatcttcactaagggcacacttgttttttctccaatgcaaactaacagactatagacggcgatggtaaattgtagaggttaaggaaaaggcaacggcatattatggatatcgacaaagtcagtggcatattgttgaagtgtgtcgaatatttatgaatatgaatttattggctctaacattatcttcaaaactaccctctcaaattcccaactccccgatttacctttgcactataggtatatacccattggagttctttacgaccttctatgtgcagatccagaaagaccatggaatctaacagtaagtctagagttgtttaaattttcccatttatttatttgtttatttccttgcttgacttgtatgatgcttttctatcataaaattgtaggttcattttaggggatatccttctgaaattttaactctctgtgatggcgaagatagtgtaaagtggagctacatgaattccctgaaagaggtttgtttatgagatctgccattacccaatcctttgttcctgcagcaaggaagtggagtgtgatcacgagagtaatcttttttcttgtgcaggctgccttcatcatcactggcaacagtaagaatgtgatgaatatgtctcaggctgatcaaggtgctttgtggcaatcagtaatgaaaggtgtgctcttcagaaagaacacttgaatactagccatgcttaataagttcattatgaaatggttgtttgtaaattagtacatatcaagcactctgactaatattgcctactatttgagtgtggtgcattctctgaatactgtatcttcatcatttaaccagaattgtgttattttgatattaggtaacttagatgggtatatgaatatctccaccaggcttaagcttggaccattcgaagaggattgcttagtacgaacttcctcagtagagggtcaacaaggttctgatgagcctgaatctcctggatctggcaaaccatgtatgcttttctgcattgaatatgtctacctttactattaattgagcattcacatacactccatatgcacaagttttttatacagtagctagttggtgcatagttttcacattttaaattttctgtgtgcttgtagtcacataataagtgatttcaacatgttacaatgaatcagctaccatcctggctcttatcagttattctctggttaggcagggttcctgttcgattatatgtgcgcagtgttcaagaagacctttatgatttagaagatgcactacctgttggtgattgggaaagcatatcctatattaaccgaccattcgaagtacggagggaggaaggtatgtagcattgtaattaacatttatatcttttggatgacagtagaacaaatttggtcaagcgtttacttgtccttcatgagtggtttgcataccgtttttgcatgcttcaaagggttcgttcaccaacctggaagtagtggcgctcttttataatttcgagacagtagtagtgccctattgttgtacatttcatttcccctcattcctgtgaaacgtgtggtgtagggatagagatccagatgctatgaaatatttggtttcactaaagggttgtggttatcccccaaaaaataatgcttacaccattatgcttgatattgtggtgctatgattcagaatgttttacggtgcagtatcagcagtgctttcctgatacatttctttggtgcaggtagaagctacatcaccctggaacatgcgttgaaaactttgctacctgagttcttcagctcgaaggcatcacgtatacccgacgattccgaaactgctcctcaggcaccagattcagcccctaatgatgattctgatgtcaccccaagaagttgtgagaagttagagtcgtctgcttcgtcgagcccgcaagaggcgaatgtggccaacaagggtaaaatagtgaagctagtaagggtgcaaggcattgaggtcgacatggacatacctttcctttgggttgccaacaacctgaagaaccctgaatgttacctccatatttgtgtgtatgtcggtacaagaaaacgagagcctaaggatggtagatgaaatgttagaaacacaatagggagagcgcattccaggaaaaatctggtcttggttctcatcttggatgactcctagacattaatattaattctttgtacagatgctgaaatcttaatacgttttgacgtgctgatcaattggtgtaagatattggattggaattagatgatgaatgaatgaatgaatgaatgctcaatgttttgaaatgaagaaaattctgaaaaatgttgatatgcttgaacagaagagaagtgctgcttcaccacaaaagcatatacctcgttaaaaatagcagtaataataaataaataactctaagaaaagcccgggaaacctgtgtccaaaaaaaaaaaggagggaaatggaaggtaacaaacaaaagaggaaagtgtaaaaacgttgggtgctcccgcgttttcgccgcgtcgcgcgcattgtccgccattgctttcgtttcctcttcatgcgatgcgagctctcctctcgtttcctctcgtttatttataaaaaccaacaagatcgagctttctccgatccgatccgattcatctgtctcatcagatcagcgtgaagcagcggcaagaacacaaaaatggcggacgagaagctcgccaagctgcgtgaagccgtcgccggcctctcgcagatcaggtaattatattagtctcttaattctgaattaattcctcatctgatcgctcaagtttgatctgctgatcgattttgggttttgaatcaaatcattgcatgcgtgcagtgacaacgagaagtccgggttcatcagcctcgtcgcccgctacctcaggtaaacacatcctatcctccatggatgaccatttctgatcaagctgctacttaactgtatgcatctgacgatgaactgattactgaatcgatatgatccaaaattaatgaaaaaaaaagtggcgaggaggagcatgtggaatgggcaaagatccacacgccgacggacgaggtggtggtgccgtacgacancctggcggcgccgccggaggacttggaggagaccaagaagctgctcaacaagctcgccgtgctcaagctcaacggcggcctcggcaccaccatgggatgcaccggaccaaagtatgtgttttcttctcatcaatctcttctcaatttggacattattaggaagacattgttcatcatcatcatcatgtcaatgtaacatagaattaatgttgctcatggcctcgcagatcggtcatcgaagtgcgcaacggattcacattcctcgacttgattgtgatccagatcgaggtgggttcctaaaaacttcacgcaagattcatccattgttgattcatcttgctgcaaactgcattatggcattcggtgacatggctttcttttgcagtccctcaa

SEQ ID NO: 64944 - DNA, 2326 bp, Oryza sativa
cagcttgtcccatccgctcctgttcccatcttcccacgtatcgtccaatatgagcagaaaccttttgcctctaatttcctcccaaagggtgttttgcagcacatcaaaactgattatatttttgtaaccttgtctatctttacacacgagctctaacatttcatgtgttaggttcttttcattgaaattatcggatacacaaacccacattctcaaatcaaaatggtctttaattcttgatcatggtatacaaatctggcaagtgtagttttcccaacaccaccaacaccaactaatggtagaacacctagatcacatgatttcacctttgttaacaactctattatgttgtccctctctgtgtcccgcccataaaccttgtgttcaattgcaagagaagtcgtctgacgaggctttctgggctcactctgactgtgctttggcattgcaatttggcgtaaaatctccagctgaagaactccttgcacaggcttgcacctagtgcgtaaacaattcactatttcattgatcctcttagaaatatcatgtttaatctcaagaggcagcatggtgctatgagtttgctcctcttcttcctctcttttccttttctttccatgcataggccaactaatatttgatttatgctgttgcttactcgttggaagtaagatggagtggatgaagacacataacttccctcagggttagtacaagaagcagcagtagaacctttccctggataagaaaaaaacttggtgttaagggacaagcaaaagaaagccacttgtgcaatccactgctaataattaaggtttcttaaaaatggtaaataatggaagttgaaatgatggtaacgtaatcacaattaactgataaaaactgatgtgcggtgactggtgcctatggattatggtatttagctgctcttagtagcacagtaagctcacaaatacacaaatgcaaaagaagcatgaagcaagaaacaaggaatggaaggttgatgagtgtgttaccaccttcgatgtgttgctggagccggtagtaatcaagctcgtccatcacgtcctcagcatcataaagcagctcttttagctcatcaagtgactcggacagtggcctgttgtcaatcttgctactctcggcagctgcaagcaccatctgcatgctcctcatctcagtctcaagctcctccacttcttcagaaaggccaacttcacgagtccacacttgcatctgtccagtgaagaaatttccgaggatgctctcaaccacccatcctattgcagcctcaattgcagtggcaaccaaccccattatccacactgcaactaaggcgacggaggctagaacaagccctgcacaagaagatggatttagaagaatggagcgcaacgatgcattatggaagcaacagggatggcataacacaaggcatgcagcatataaagagtcaaataaaaaagatgtgaggtttacactgcaggttcttcagtacacagctgcaataaagcattggtaaacagtttattagtgaactgtctacggctccatgcacctatgcagcacagttatctttgctaatgaataatagtgtatccatcgaccttgacaaaactagtagctcatgatgctacagaccagttatttagcttaaaaaaactgtcgagataagttcatgcgtggaacagcattactataatacaagtggtacaagcggcagcgaaaaacattacgaaggaacaaaacatttctaaatagtagtaacctgtaaggatagtacaaagcaatttcctggaagcacctacaaaccacgacaaaagtaaggtgttgattcagtaaccatctcatctagctaagaatgcaacttgtaaaatataaaataggattaccatacggtgttacctaatctaatgtatcgacgagcttggagctgagggtataacagtacaggaatggattaccgtccatacatgatatgagtcgcaaaggcagctgcgtgagggtattacaatataccgattatgccgttgaactccactcgaactggacagatcaacaaccaacatagagaaatttcaggtttcaacttggaattgcaaaaaatttaacactgcagagcagagctggacctgacgtatcatcaaccggccaagttgagagggggatttcgcctctcacgccgatggtgacggatgaatacttcaatagtgtgaatggaaggataggacgcggatgcaactggaacttgggcgggaggcggatgcagctccgtcctccgtggagggcccgcaccgtggggggagcggagaatgctccccccaca

SEQ ID NO: 64945 - DNA, 4641 bp, Oryza sativa
gaactttcagcccacactccactctgccatgttcttttttccttttctcttcttctctctcattttctcagcaacgcaatcctgttggtctctatcaaaccaaagagcttagtagcttgcgatggtatcgtcaacatgaatatatgatcgattattatgctgttcattcatgtttggctgaatctcaaagccagaggtaggtttattgatggtgctcaacacatttcttcagatttcagtacactacttcagttcagccctcttatctgtatccggcacttatcttttgtctcatctcaatcctcttggttaatgtagaaagaaaacagaacgtaaatttgtttttttttcttttggtttatcggtatacatttgggacgtaaagcatctgaaaaaagagattccatttcccagttctgataccaatctctgcaggtaaagcttctgaaaaaaggcatgaacaataaaagaaacacaatagcactcgcaccataaataaaacagtaagtatgtggcatgatgtacaagtacaacagactactacatcaactgaaaagactgaattggtgaattctctcttcttctcagaagctgctcataaggtatccacacattttgatttcatctgcattagttttgtcatttctcttctgcaaaatccttgtgctgatcaagtgactgacccagccttaacaccatctgcttctacagaagttatgagtgagaggaagaggactcaaatcgatggagggcaagggagcagctgcagcagtggctctctgctgcattctcatcctgctgtcaggtgatcagcttcatcaggtggctgccatgtccaagttctgcagatgctacttgcagtgctaccctgactgcaggaagagcctgcctcggttcatctgcgtgctcaaatgcatcgatgattgcagccccaacaagaagaggatggccgtcggcgactgcaacaaattttgcctgctcgccatctgcggcatggcgttgaatggtaagatcagatagctagaacaatctgcattttgtgtatgtcttttgtgcatcgtatttgggagattatcctgactgattcctcaccgaattctcactgctgtgtctgcttatatgccttgacagggcaagctgatgttgcatcttgcgtagatgactgcaccaagaacccagatctacacaccaagttcctttaagatcatgggattgattgattcgtactgttgtctgtcaagagcatatcaactctagcataatgcatactacagatctatagtccacttttgagtgttgaacgatgatcagtggtaataataataataatcagcttatgtttgccacttgtctggtttactggttccacaactttttttaagttctgtttgtttctttccaattctcatgtatcatccatgaccattccttcgtttcttctagtccatggaagtgtgcaagaactgagcttacgcaggtgaacaaggtagcagaagtacatcagcatgcactaacagctcacgaaagagaactttgcataagtgcaatacatactgttcatcaacatcagaattcagaagcatgaaaaggattggaaatagtatcagagagatcatttgtatactaatgatttgcctcaagttgttggtcaacatatctatgcaagttaagacatagtaagttccagaatgtgatgccatcatgccaatcaaatagtgcatgtctactgccaaacgaattacaggctccatgtacatagttaagatttcttctagttacaggtgacaaatttggcgacccgatgcattgcgcagcaaactgccccgctatctgttcattccatcacacaacacttgtgtagtttcaatgtaagttacaacacattgtgactactcatgcgtaaaatcatctcaactgccggctctgtacaaaaatgagcaccaatgttccctcaaaatagtttatccgtgtaggattcattcatcggggtacagtgttctgcttcatggtaccatgaattcagccactcctagaatatgggcagctatatgtctatctttcgttgatcatgcagaggtaaccacccccagcattccgctccagagggtacctggtggcacctctcatgtactccagatgcttcaaggcagcatggcggacaacagatctttttggtgtcttccctttctcgcgcttctttatcatggtgcaagagctcaaagggccctcgcttccagccccaggtctcctatagtgcattttgcaacgacgaagtttcaagttatacaacatgtggcataatgacatatctgattaatttagttaatttaagcaccagaaccaagcagatgaaaatcaatatctagtaactaagtatctaagtggggttgccatggagtgattgacgaatggaagcaagaaccatactaaataaaggtaggccacaaaacttacttcaacagtttctcagaagcaaccctagcagcttcaatggtgtccttggttggagcccactttactactctgccaggatcacctcgcataggtgagtggatttttacaagctgcacatgtttatatttaaaaacagtaagttatctcttcacactataacagtgtggctaagtaataatccttccatgtaggaatggtttgattagttcggattaggggaaatgagaaactcacaccaagacattccatcatttgataatatgctctcccatgtaatggagtgtgtccctttctggactccgaaaagtacctggtcctgaaagatcatcacatcaactgtaagcagatctgcacatcaacatacatcatatttagtgcgtaagatcgatcgcaccaaccattccttgtatcctgggtcaactgtaaatccatacatgtcgacactgtcacacatagacagagcgaattcaagagccttaagcccagttcctttagcagaggaaccaaacgatgtgcctagcatgaggtatactggattggttattggaatttcctacatagcaagaattccagcaggcaggtaagagaacacagaatatgtacccaagctaccgtatttttcttaaataggacagctaaattacccggatcatttggttcatgatatcatgtattgttgtcttaacgataagggcttccttttttgtttctgcaaccataaaaattagcatgccttagtatctcaccaaatgggaaaataggtggctgacagacctaccatctaactcaacaactttatctagagcctttgcagatcctctgttaagaagtcgaaatgtactctttgtcccaacatattctgtataattcttcaataaaaatagaagtcagtttatgttcgagtggaacgacacaagagcagcaaacataagtatcttaaagaaacctggatgggtgcaccgttctctctaataacgacatcataagaatcaatttcatccccaaatttggttttaagaagatccccagagtttccaactacagcacatctaccaaattgccgaggtacatatggtggtgtctcaggaagaactaatgaaagtttttccatgcaaagagtcctgttctggcacttgttcctgcaatttcaagactaaacatgctcaataatctgtttgtggagttaatcatgctgcaaatcttgatgaaactgcaagtatgtgtacccacagatggattcctttattgatcctgcgccatgcatactcctcccaaccatttggcaacgcatcgatgtactcctttgtaagtattgttgtgctattgcgaacctaggaaaaaagcaactgagtgaccataagtccataaaaatagctaatactgtgatctaacaaatatctggacacagtgtttacatactgaggattgccatgttttacattatatcatataatattaaacttcaatgcatctgcaaaaaaacacatacatatgtcagttgaatgaatgctaacctgctcccatgaagccacagcttcacagagattgaactcaaatgataaaccttcaggttctccagtttttggatctttctgcaaatatcagtgcataagaactaagaaaaacaaacacacgcatcactagggatgggaattttacccatgggtccaggtatccgtggatacccgacccgatgggtacgggcgtgggtgtgactttttacccatgggcacgcccgcccgagacccgaagacgttatgggtaataggtgggtttcattttttacccgtgggtaaaccatgcccaatccgatacatatgtattagctaattttgactcatttcttaattcttataccatttctctcggttcatttgtgatgctaattgatactaagttatgatgtaattcaaattattgttgataaccgataatttggtaaattattgattttatttctctttgttaaattacatatctttcaagttattattcatgtgagattcattgggtacccgccagatatacccgcgcccgccgggcacggagttttgcccgctacctctagtgggtagggtttgggctggcaatgtcgggcatcgggtcaggcatggttttgctctacccatgcccgacccgacccattgccatccctacgcatcacaaaaggtggcacgagtatgcaat

SEQ ID NO: 64946 - DNA, 3305 bp, Oryza sativa
tcctgcaccccatcctgattgtttttagcacgagtacacattaatgatctttatataccgaacatcaagtcaccacaaacaagaatacactacaaatttccttcgtgaatgtatattaggatactatcgatacaacaaagtacataccaggacagtctactgaattactatgcctttgagtaaacaattaccacgataaatcaagaatttacgaagcaataactaatcaccacgccgattctccatgagtgtggaaatctaatggccccaaatctcacaatgtagcatctaattgcacacaattacaaggcaactgaatcccaattgcccgtacagtgaacaggatcaattaacagcggagacagatcaggaaaccgtaccacacacttgctgaagccgctctgcagcgcgcccagcgccgccaagtccgcatcggaaaccctagcgccgccatctgcacgcacgcacaaacgcatccatcccacctcagaatcgacacacgcaaagccaaaagcagaagaaaaaaggcgcgcgcattacatgaggagaggccggagaggtagacgaggatggcggtgacgccggagaagatggcggcggcgagcgcgagggggagcacccgcatggccggagcagccgaagccctagccgcgctctgccggctttggcccccgtgctctcgccggagtcgagtgtgagagagaggaagcgagcggcggggatcagttcgccatttgcgaagagttcgagggggcttttcgcatattgtgcatttagtgagactttttttcggttttagatttttttaaaaaaatatttacagaaataatctatcggcaaaaaaaaactacaaaaatagaccctgccgcccacctctggggtggcaagctgacgtggcaaacggggggaggaacgggcggtgacggagggagggttttttttgcatgaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccccagccctcattcttctctcctcaattccagtgaaaaaaaaaagaagagaggggaggagaagataagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatttacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggactaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatatatatttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatg

SEQ ID NO: 64947 - DNA, 1129 bp, Oryza sativa
tctttgaagaggttgagtcacactatgttatgcatgacctaatgcatgacttggcagaagaagtttcatcagatgagtgtgatactgtagatggattgggaaatccaagaaaatttcaccaggtcttcagcatttatcaataataactactgcttatgatagagaagaaccttgcaattttcctagggagaagtttgagaacatactacagagtatcgggtctttgccaaagttgagaacattaatgttcttcggtgaaaatagtataatgttattaaggtccttaaatactatatgcaaggagtcaaaaaggttacggttactaaagatttatgtgacagctgctgacatcagctctacacacaatttgttcaagccaaatcatcttcgctatcttgaatttattgttgttcccaccaataatatgtttggaagtcgaggcattgtaaatacctctattcctcaagctttgacaaaattttatcacctccaagtgttggatgttagcagtaaagtaaatcttgtagtaccaactgatatgaataatctcgttaatttacgtcatcttattgctcacgagaaagtgcactcaacgattgctggtgttgcaacttgacctctcttcaggaactgatattcaaagttcaagatgctagtaatttcaatataggacaacttcgatctatgaatgagctcgtaatacttggaatttctcaacttgaaaatgtgaaaactaaagaagaagccaagagcgcaagattgattgataaagagcatcttcaagagttgtcgttgtcatgggatgataaaaacatgaactctggacctactgcagagaaaacaagagacggtgtgtttgagggtcttgagccacaccacaacctcaaacacctacagttgactcgatacagtggtgctacatcgccaacctggcttgccagtaacgttaagtcactgcaggtacttcatctagagaactgtagagaatggcaaattattaactctcttgaaatgcttccagtacttaggaagttgaagttaatcaggatgtggaatttgatgtcagtctcaattccttcttatttggaagagttgatcttagttaatacaccaaaactggaaaaatgtg

SEQ ID NO: 64948 - DNA, 1475 bp, Oryza sativa
ctgcacccccgccttcttctctgatttcgttcttatccatcaagggcctttcatcatttccaacaatggtgataaatcggagagtgctcacaatcgaatctaatgagttgagtgagctcgatggcaggatctcaccattccataatctgaagggcataacatgggtaaacctacggcgttgtccaaacttgacccgcatttcgatagacggtttcagccaaccacatgtcatgtcaaagcctgttcatgataacagtatacctattacgagttaccctgtcctcccatctgtcaattctctcagcattcagtcgtgtggcatagctggtggatggctaactctaatgcttcctcatttgcagtctcttgagaacttggagttacgagactgcccacagataaaacttttatcaacaagtcaatgtacaaaaatagaagcaccgaacagtttggcttcagcagagacaacctctgccagggacaaataccttttgcaaattccatataatctcctccgttctctaaagtggttaattatttgggcatgccgagacctggaattttctggagtcaatgaaggatttggaggattcacctctcttgtggagctacaaattagggattgccccaggctggtcccatcattggtgagtgaaaccaaggataattggttactcccaacatcatttcaatatctcactatcagtcctctcccggcaaacatgcagctcttcgcccctgagggcctaacttgcctcagagtgttaagcgtattttgcagccaatatttgaagtctgtgcagctgagatcctgtacagcattggagtgtctgcagttattggagtgtcaacagctgagtgttttggagggcctccaacaccttagctcccttgtaagtttggacatcgagatgaatcatgaactgtcaatggcatgggatcacaaactgcaggagcaagaacaaggcagcaatcaggttggactatttcccctgtcacttgtacatcttggtatcacaaatcttgaaggcagtgtccattctcgctttctggcctcccttctattacgaaattagacttgtggaatagtccagatttgaagtctctacagttaggatactgcacagcgctggtagatttggcaattgacagctgcaagtcgcttgcatcaatcgagggtttccagtccattagaaaccttaggtccttgagagtaggtgactcccccagcgtatacccatgtctgcagcttatgtcgcagcagcaaggggcatctgacatcttttctcaactggaaactctaacggttgatgatgcctctgtcctttccgtgcccctttgcaaacatctcacgtctctacgagtcttaggattacaccgggatggatatagtggcaagtctatggttagtctgacagaggaacaagagcgagccctccagcttctcacctcactacgacaacttaatttttaca

SEQ ID NO: 64949 - DNA, 1282 bp, Oryza sativa
attctgttgcatcctagacattcaactgaaatgcgtaagaatagtctaccttgaaccacatgtacatttgtcttttacaagtaactagagtgttttcccacgcaatttcgtgcggagctagattttataagaaatggatttcacatacaactcttagattttgtttctatagatataattatattttgcatacaattgtaagtgatctataaccccacttctattactatacatacaattgtgttttgcatataatagattttaaaaagtagaattggattaatatatattttttatcttctattttcatagatataattatattttgtatagaactatatcaatcgatctacaccatcaaaacattgatataacataatctactggttaatattttttttctttttctccgtggtaatttataggcctccagagcaaatttcttgactggacagatgcaagtgtggactcgtgaagttggcctttctgaagaagtggagcttgagactgagatgaggagcatgtatgacgccgaggatgtcatggacgagcttgactactaccggctccagcaacacatcgaaggtggtgccgaatctcatcaaccttccattccatgattcttgcttcatgcttcttttgcatttgtgtactagtgagcttactgtgcagctaagagaagctgaataccatagtccataggctccagtcaccacccaatagtttatctcagttaattaagattaccttcccatcatttaaacttccgttgtttactatttttgagcttactatttttgatagccactaagatatatgtttctgtcaaacttttatgcttgggagatgttctagttgtttctttcttcttttttggctgtgtgcattttatgcagaggccgggggtgactcggtttgattgtatcatcttgatgtaattaactgagtttaaataaagcttccattatctaaaaaaattatttttaagaaaccttccttaattataacagtagattgcacaactggttctcttttgcttgtcccataacattgggttttaaagagaattgcagagaaacaatgaagatggattaatctctcgagtggatgtccacccatttattgcatgtcaactaaatggttgtgaatttttttaaaaaaatacaagatagattaatatgtattatatcacttcacaaacatacaagttcaaattcgacttctataagtcgtaacaaaaataaaaaattaaactctaactagtatacgcgggctgcaggaa

SEQ ID NO: 64950 - DNA, 1017 bp, Oryza sativa
ctgcaccccagtttctcatgccgaagttttggtgtcagcattcagcaatcctgtgagtcatgcatagctgaaggttcatactgctgcctgtctcatcaaaagttcagattttgcaatgttgtttgggaaggtaaggtctacgcattgtccctaaaacacagcaatttttgtttctcacaggaaacacgtcagctgctgagaaggcaatactgaagacgaaatggtctgtcaactgaatcttgaccactgcagctatttgtaatagacaaaagccaagattgatcataaatcaaaatgaagtgcatggcaagagttgtaacgtgactaaagaagaatgcaaggatcatggaaaaaaagctgagagaaactggcggatgcattgccttcatgtcagtatcaacatatagctgcgatgtgcctctctggtcaagtgatggcctctgtgatggatgatcttgtagaacatccaggaacatggcaatcccgattaggcgattaaacaaggagatcaatctcgcgtgtcatccagcaaaatgatagccagctctgaaagtcaggtccaagttatcacacctcttgagctgacaagaagccaagttagattaacaggaagaggagcagaacaaacgcaccaaccagtctaccacaaacaggacaaatcaataattgaatatcatgcgcggattgctgctggaacaacaacaagagttgatagattcgagctttgccttatgcaacaggtgagagctcctttgcttttacacaatgcaaattccatccatggattgtctctgaagatagggttgtaacatccggcaagaaacatatggccaacatggagcgatctacacaggagatgccatacggtaattgcacatggagaggaataggattctgatgcaaaggctcaaacaattttcaaagagaaaaggaaaacggatcagctcctttaggtcgcaagtttgtcagtgcaattttgtctgaaatgacaggaaataatgtgttgcaccatgtttt

SEQ ID NO: 64951 - DNA, 11451 bp, Oryza sativa
ctgctgtcgttggttgcctggggcttaacctgaccagtggaggaggaaggaccaaggacaataacacattacacgtaggacagcgaggtggttgcttgaggaggagaaagctgcattgatggcttgttgctgctggtgttggtgttgcggggacctgcttgtctctgttggcagataagaagccagctccttttatccgtccttgtgtcctccctgttggtcgttacagatgagatattaactccatcttggaatgtttggtgttttttgaccagaaaaacaaagaaatacactctgaatgaaaatgccagaatgtatccatcagtggaaatatgttaacaagaaggaaacatcaaaggttaatgaaatggatggatgatatcactggagttcatatatgcatcattggacaggtcacgaacatatcccctccatcctagaaaaaagaagaacttctagctatgaacaaatgtgagcatatgatttggacaaaggaaaatgacaagcacagaagcacttgggagagaaattcctgatcaaatgtgccagtattttggcatctgaacatccgtcgccgtccaaactatgccacaagagggaacttaacatgtcttgcaagaaagcaaaagaagcctctcctgcctagtgtataccaaccctgcattcgacggcgacaggtataattctatacaaagccaaatccatccatcagaactcacattaaccaaacataagagctgtcactatcttaaaggacacaccatctcaatctcatcggtcccaagtgaggaaagtttggtcagctaactgaaaagaatccatagcacaagcatgaatcttgatcggattactgaagtaacaagagtgaaatttaccctagctaacgtatatgtcacaccatttaaacaaggaatagttagtttagtaggagattgagatacaaggaaccagagatcgatcgatcgagatattgcgatgataaccatctgatggggtaacaaacaagtggtcataaaattgggcaacctagagctaacactagaagaaacagcaagcaagaatgatgggtagatcgatgtgatgcctcgtcttatggtgatttgcccaccaaataatagatttacacacacacacaaacaccaatcatacactgaccaacaatggcacgaacttgcaagaaagggctagaggtggtccagatggatacagctttacaccaaccatcagattagattagtagtcagcttgcaagaatgcatgagacatgctgcctgcagctatcgagcgtactattagattaggtttatgttttagtatcatttgtaagtacaagaaacgaacaactgatcatgcaattaatgaattttgacgctatatacactgtgtgtgtattcagtattcttcatcagtgatctctagctaaatctctatgaaatttgtacaaaaatatgtatcagttaccactatccaacttgtattctcttctttctttctattccttttctgcctttggtttggtgttcctgagggaaaaaaatggtcaaatcaattttggttgggcttggcagtgacagtggcattggcagaagcggagcgagtggcgaggcggaggcggccggcgcggcagatctcggcgggggcgggcgcgtcccaccgctcggcgcgcgtcatgagcgccgccacctccgccacgcaatcgtccgcgcccatggtcgccaccctccgccgcaccgccgccgcctcctcgccggcgacctcgtcaaacagcgcctcccacccttgctcccacggcacgctcgcgtcgcacatctccagcgtcccgttccgccactccgtccagctccacccgcgcaccagccgcgccgccgacgcgcactcgccgccgcggcacgccggccggcacggccggcacttggcgccgctcagcgggccggggctccccagcgacgccacgggcacgccgtacggcgccggcgggaacgagtacctccggtcgctcagcacgcagaacggcagccgccgctccctcgccttgacgccggccaccttcagctgcgcctggaacgccgcctccgagttgagctcctggtagcccgcgacgtcgaggcgagggatcagcgagagcctggacagcgcgacgcgggacgcgtggcggccgccggcgccgaggcggtcgttgaggcccccgaaccgggaccccttggggacgacgtaggcgccgccggccgggaacgcgtcggcggcggcgagcgggccggtccagaagccgtcgacccgcgtacggaccacccaatcgtacgtgaagttgcctcgagattcgcgctcgcggatcaggtccaagcacccttccaccaaccgaaaatattgcagcaatccctgctcaatatagatacatacaaaaatgagaactctaattgcagattaacagcaacttcgtcccataaaaaccaactctcactttaaatttaaatttagacatttggtgtttttataggacagggaatatactctaatatatagttagacacataagtagatacagtaataagtattctaatagattgatttaatctacggattaggtagattagtcactgtcaataactttttttacgacaagatggagaacacatgacaagtttaaatctactttgtttttttctcttttccgagcattgacgtttgcggcatcggttgtttacatggggatgaggtatctatctacttgtagcttgtcaccttttctccaattctcccagagaaagcataatgccatcataatccgaagctttggaggtgaatacagaggatgcaaaagacgagcataaagcaaggcaaagaacaatatctatcaaacttttgtgatgtagatgacaatggcttttcaagagactttctcaaaagcgtcactacgtacccacattacctgccgtttttaatactacgtggaacatggattgtcatacacctttgcacgttattatattcgagcaaaacaaattatgttagaccaagatgatgtatccgtacattgatggtataagaacatcacgtttctacagtaatttcagaagatattttttttactgttccaaatggtcggtaccaaattttgtcttgtagaacctaaataaactctaatgatgaactgtcatcctctgttttggagggcacaaatttcattggaaaaaaagtccaaatgaaaccagcagtttatttgcagaaacgaggatatgtgccagcctagcctgatatgctttgtttacactagcaatcgcaaccttctggttactctactgtatgtatagaagcactcatgtggagccagccatgtgctcatctactaattgacatgccggtaatttgcctttaatttgcccccctcagtctctctccaaccaaccatggatcaacactgacacacacagcatctcatggataattcaggctgatcaataatactcaattactctccatttcacaatataagactttctagtattatccacatatatatatacttcctccgtttcacaatgtaagtcattctagcatttttcacattcatattgataataaatctaaatagatatatatgtctagattcattaacatcaatataaatgtgggaaatgatagaatggcttgtattgtgaaacggagggaatagatgttaataaatctaaacacatacacatgtctagattcattaacatttaaatgaatgtgtacaatgctaaaaagtcttgcattgtaacggagaaattactagactaattaatcgtggtagttaagcacacagacagttagaaactaccatcggattgggatcagtcatggtagtcgtggcacgtgctgacgtgcatgccttatacctacgtgtactggtagtcctatgggtgcacccgcgtaagatttgtcacagtactagccaagtacattgtgacaaatgtctcacagtgaaaatcaaatgtgcacacggcaatgtcctattcagttcgtagcttccgccgaacattcacaaggacacagtgcaaaaaacgaaaacacgacacaatttttttgttggtacacagtgcagagcgagtcagagacgggtcattgattgacacgtaccgaactgtctacgaaaggaacaatgactttgtgatcaatcatccgatcgacgacttggccaaccttgcttaccttgcttggaccaaagactgactcggatatttatttactgttaagcacatgatttctcttctgaattctgaatttgctttcttgtgctgattctactgtagtgttcgtccttatgaacaattgagagttatggtcccaacgcgttgatgccttttgagaaccaaccaactcggtgattgtgattgatatttttgctagctgtgggcaacgagctctcatttaaaaaaaataactagcagtagcgaatttggccgctgtctagctgacactttgactagatccgtgaatttggaatgacatgcatgcatggcccgatggctggccaatgggccattaacaaattgatgatggctctatacaattcccatgcgacttccgcggtagataataagatgcaaattgattaaactggtaccaattcaatcttgcttggtttcttttcctccatttgaagacgttatcaatcttaattatcttttggacctaattaagggcttaataaattaaaaggatatagagaaatgaaaccgcccctagattaaagagaagaacccaacaacctgcccctaccatgccattgccaccatcacctaccttcggtttaacttcaggtggttttactactttattaggtagttttttacttaaatgttttttttaatataagaagaaaggttgaaacaaattatctccaaattaagcaacgtggacagattagcagaggcgacaaacaagtcaagacgaacaaacagaacacccaacaaaaaatcgataaacaattagcaatgtgtagggaaaaaaattgcaatgaggagtatgcagcggcagcaagcaagtctaaggatgaagaaaacgacgcaacgtgcggggaagctatcgttcgatcggagtcggggaggtagctagcatgcgtgcgtgcgtggtttgatgcggaagcaaggaacaaaccaaaccaaatccaaccatggagtagtgggggtgatcggagattgaaacggcggcgggcgcgtacctggatgccgttgggcgagttgctggcggtgagcacgcgggcgcgctcgggcgtctcggcgatgcgctccggccggaacacccgcacggcggcgagcctggatcccggcggagcggcgcgggcgaggagggagagcttgtaggcgtcggcgtcgagcgggctgtggaggaacacgtcgacgacgggcgcgccgccttcgccttccttcttctcctgctgatgcgcgacgagcggggcgaggacgtggcgcgcgatggagggccccgtgagctcgaaccgccgcgcgccacccaccaaacacacggccacccgcggcggcggcggcggcgggggcggagacggagcgtgcctccgtcccagcgcgacgagcgacgggatgcggccgatggaggaggggaaggagagcgcggccgcgaggaagaggagcagcggcgcgatcacggcggcgatgcggccgcccctgcgcgcggcggggagtaccgacgacgccgcgcccccgggcttcatgctgcggtgaggaggcgagggcgagggcgagggcgagggcgtgggcggttgctagctcatggcggcggcggcggcggcaaatagtagtgggcgcgcgatgtgaggggggcgaggtggtgaagagggggaggttgtgccgcggcgcggtgcgttgcggaggagggaggatgggacgacccggcgacaactttgatgcggcctttaatgacccacgtctttactatttactgttcctactactatttacccttagagcaagttcaatagtatagccaactactagctccaattcatctatagccaatctaatagctcattcatacaatagttacatactacactattaatatctagtcccacctgtcatagacacactgcgttttagagtctgtgctacaactggctacaaatctatagcccgttgctcttctctctcctgatttatctctttaaaatatgtttgcagctggtttatagcctgctattgtacctgctcttatattacttatttagagcaggaaaagctataagccagctataatcacaacatatcgagaagaaaagagaagagagaaaagaaagcggctacagatttatagccagctggaacacagactctaaaatgttatgtgtgtatgagaggtgatattaatggtgtagaatatttctatggttaactattgtatgaataagctattggattagctatagatgatttggagccagtaattggctatcctattaaacttgctcttattgtgtaaattaagatatcaatttaaatcataccatttttttgaagttcctaaattgcatgcttttagttttttataaactttggtaagtacatgaagaatcgtgccaaaacttgataatattaccatcttacaaaatttggtaaggtttattttgactgccatctaaataaccccttaattaattactgctagttttaagttttaaccatatgaacctacaatcaaccatctctaaactcggcttcgcagtagaagtagctgctagtgtagtcatctgtaatagtagtggtttattgttttagatcaacaaagggaaatggcatgctgttcctagcatatgtcctgcaggcatgcatgtcctttggctgataaaccagtcgtgctatagtttgaataattttgatgagactaatggtggtggtgactggtgcttttttttttccgtcgagatcgcgtttgagtcgtcgtcgtttgactggcaaagcttggatggggatggaactgttatttagaggcaattaaagtttgaataatttgttactcccttcttttcaaaaataacttaaaaatctaggatatgatatgatttattctagtagtcctaggattgtccaagtgtaaatgtaaaatctctcatagtttaggacataaatagtattacatactccctctgtctaaaaaaaacttaacctcatactacgacgtgacacattaggatgaatctggacatactgtagagaatatccaaattcacatcttagtacaatgttgcctttttttggtgatagagggagtagattgtaatacaggacataaatagtattatggcagtgtatttatcttccttatttttattacacggtaaatgtgtacgcatatatatcactgcagacacaacatcacactgatagaatgtttccctcagagaaggtacaataggaaaaatttatcttgtgatagtgtgtttatggtggcaaaaatggtgaggtggcacagaaatgggaaccttcgtaggaaagtagtatgataagcggccatctatggtaagaaataattcttgaaagcaagttaattcaatttccagtatagtaatcaatcgtcgaatggtaaccttgtctatagcaaatggaacaactagtaaagtaagtacgcacagtttgtgtagacgggcattgcacatgcatgtttatcgcatcaagtgtttggactttagtcctgtcatatcagatgaatttagagtattaaacatagattatttataaaactaattatataaatatgagctaattcatgtgataaattttttaggcctaattaatctataattagctgataacaatctggtccaggtggggttggctaaggcccaataacttaagattgcccggaccccaacagtttataggccaataacttaaagttacccggaccccaacaatttagtttatagcccaataacttaaggttgcccggaccccaacagttcataggcacacccactggaggaaaggcccaatctccctaaaagactagtccaataggagaagggtagctctcccttttaaggtggcttccttctcccaagctaaataaagtaggattattcagaggctcacacggtcgccggcttcctcctaccaagctaagtaaggtgggattattcagaggctcacacggtcgccgtccgacttttgcgtctttgccagcgggtaatagtggaggatgtcctcatcattagcgcatgtttactgtagcatcacataggctaatcatggattaattaggctcaatagattcgtctcgcgaattagttcagggttatagaatgggtttttttaataatctacgtttaatatttataattaatgtccaaacatctaatatgatagagacttttttagtctcatttaaacagagttctctctggggctcaccccgccctgcagctgcttggcctaaataactgtacgaaagctgaagtggattcagaaaccgtggccgccacaatgtttgtggattttaattagaaaaggagcacggtggcacatgcacatgctgcggccccctctccctatcgtgatctcatcatcattcagatgaccactcctccatattattcttaacaacaatatcgtctctaaaataatattgaacttatgtttttttattataatacataataaatatattttaattttttattttagtattttataatataaatttatgtattctagcactattactttaaatacttttagagttattatggtcgaaaggcctttcactttgttattattttcaaccttatcaaattttagtaaaattgctaaaaaaaatggctacatttagtttgctgtcaaattttggtaactatataagaaatccattgccaaaatttggtaagtttttttttcatcaaagtgaacaggcccgaaattagaaaagtttgatcttaatcttattcaaaacgagactgaaaaaattattgatcgtacattgcaaatttagaccttcctaccagaccaacctacatatgggctatcatacggtttaattttatatatccaacatgtaagcaactaagcacacacatgcatgaatgtcagtttgcttgattttcatgtgcgagcggtcgatacaagttgaatatttttgaccatgctgctgagctgcacatttgtacactccaagtctccaatctggtgagtcatgggccaacaactgggttgatttataattgtttttgcatataatatcaacaagtatcgaaggttcggaaacacgcaataattagttcaatatttgttttctttttgtccttacaaaatcgaacgatcttattttttctgatgatactacaaaatcgaacgatcggttggtggttggtacgcgtatggttgtatgcatgataattagtacgactagaaggtcaatgcaagaaaatgtcaacacgttgatgagttgtagctaaaattcgaatttcatgacttaattttcgggttgttttttttagaatttttatttatcgtactctgttttttattcactggcttttaaacagctaataagatgcatatagaagtcttggtcacacattattatttgttactaatatgttcattttgaatggactatcaacgtatctcaggcgatcaagcccgccgccatgatgcgtgtatatatggatgcacgaacgaattagaaacatcatgcattgtgtcggcgtatgcagagttggtggtggtcaaaataggcagtagttagctggtctctgtttcttgcgtacatactgttacttgctatagcatgttgctaaatactttattcctcgagcataagactttatactttattcctcgagcataagactttatagcattacccatataacattcacattatatgcctaaattcattagcatctatatgtatgtgggcaatgctagaaagttttataaccttaaaaggatgcagtattatattattatacatggtttttgataagatttaggtggtgttcttttcttctgaagatgaagatgaagattaagttttttttacgtaaaatgatgtggtattaacgtataattgattgagttttaattattataaacttaaaaaatagattaatatgatattttagagcaactttcatatacaaagttttcgcacgaaacacaccgttcagcagtttaaaaagcgtgccacgaaaatcttaattttcgtccaactcttgttggagaaaagaacgggaccttactagtgttacatactccctcctaacacaccctccatcctaaaataaaataatctcggactaagatgtgatatatggactaactcatattcacaaagccctagattttttggccgagctggatttgaaccagcgtagacatatcgtcaacgaatttatagtctgtccccattaaccgctcgtgcatcgacgctggaaggatttattctagggtttttgataacctacaattaacatactttcataatactcctaccctcaaggaagttgaatcccagctgctccttgaaagagagatgtcctgaaccactatatgataggggtatccatgtatcacattttagtacgagattaatttattttgggattgctctatgtataaatttgttgtactaggatatgtacgatgttggtttattttgagatgaaagatgtacttctaaacatttctgtgatttcaagtgtacaactctgcattccatagtttccatctcttcataaaacaatgtacattcgacggcccatatttgagtcacaacaaaaggctagtttgggcccggcccacctatacaactcctacgtaattggcccacgtgtccgcacatgaatcaccgtaccaaccgcacacgtcatctcgctcttgaatccatctcagccatgaaaaatcccttttctcctctgccgaataaataaataaataaacaaacaaacaaacaaatcaaaaaagtattatttaatattattatcttcatcctgggtcccacacgcataggcagagagcaatcataacttgggtcaaagcgattaaccagccgaagcaaacaccaacaccaaaaaggggaaagcaagcaaatcgcaagcaatcgcgcggcgtcgccgactcgccggcggcgaatccaccgacgagcaatccagccccccaatcccgccgccgcaccaccgcgcatacgatccgccaggttctccgatccatcccccctccctctcccccgttcaattcgcgctctccgcctcccgatcggtaaccatttagggatagatatctattgggaatcgatgattctcgtgggtttggggggttgaattgaatcctcgatgaattttgtgaggtggtgacctgatggttttgagttgattgggtgggcaggaaggaaggaatggcgtcgtcttcggatccatgggtgagggagtacagcgaggcgtccaggctcgcggatgacgtcacc

SEQ ID NO: 64952 - DNA, 728 bp, Oryza sativa
ttagagttggttgcacttgtgtgcctggggttgagacttcattacgagataaattagaagcgttgctgtccaggattcctccaaagttcatgtgttgcttccttccttccttcataacactgctactacttaatttctgtttgcgtactaatatgggttgttcatatgttggtgatggaatcacagttagcttgtacaaatcttatggaatctgtcggtcccctgattaacttacgccgcgatcgaattcatttagaattgttacccttacacgttgacctgtccacttttcacccttgtgattcaccttctggatcgaacactaaattagagttggttactcttgtgtgcctgggttgagacttcattaaagtagatgctgttcgatatttctccctatatctgagggattatcggcaattcgggattatgattctagtgaaaaaaaaagattgctactggtattcatgctgttctctcattatgcagcacggacaaggagttgcataagcgacaagacatgctttcaaatctgaaatctagagcaaagcagatggctacaagtttcaacatgtcaaactttgcaaacaggtctgttcttgttctcagatatcaacctggtagcctgatacagttatttgccttgttctctcgaaataaagataactggttgatgctttgacatgttgcaatttgttcagaagcatattaatggaaatctttgtttg

SEQ ID NO: 64953 - DNA, 1463 bp, Oryza sativa
ccgtaggtgacaacatgagctgattctttctattatcagtgatcatcgttcaacagtgcaagcatgcattatgctagatttcatttgatatgttgttgacagacatcagcgtgaatcaatcaatcccatgatcttaaaggaacttggtgtataggtttcggttcttggtgcaaccatctacacacgatgcaacatcagctgcccctgcaacggcaaatgcagacaccgcaatcagaattcagagaggaaacagaatctccctaatactatgcacaaagacaagctcaaattcagctaggaccctgatgattggagacttcctgatatcggatctcaccgttcgacgccgtgccgcagattgcgagctggcaaaaggtggcgcagtcgcaggcgacaaccttgttcttgttggggctgcagtcatccatgcacgcagatgaaccgaggtaggttcttcctgcactctgggtagagctccctgtagcatctgcagaacttcgacatggcaccaacttgatgcagttcatcacctgacagcaggctgatcatgcagcagagggccactgctgctgctctgttgccctccatcgatttgagtcctcttcctctctcagtcactctgataacttttgcagaagcagatgatgttaagttcagatcggtcacttgatcagcacaaggattttgcagaagagagatgataaaactaatgcagatggaatcaaatgtgtggacacctatgagcagcgcctaagaacacgagaggattatcaattgatgccatatccctactgttttatatatggtgtgagtgcttgactgcttgtgtttcttttattttggtgcatttttttgtacaagctttatgaattatatgagagcgatcagtatgcgacctgttttttttttgttcatttccatatgaaattgcttttctgtcccaattgtaccccggtcatataaaaaccccgaatcaaattagcattctgttttctttctacattaacccagaggatcgagatgagacatgcttaccagctagaggccttgtctacgaaaagaaagatgaagtgtactgcagcaatatgttgatctcaattagggtagcataaatgtataaatcgatcataccattgcaagtttttttggttttgtaaaccccaacagaatgttcaaagaacaatagaaaagaaaaggaagaggactgcaatgctgaggggcagacgggcagtgcgggcgatggaacaaaagaatttttttgaatgggccgtatataggccactcatcttcacgtattagtattgggctataaatgggccgacagacaagatgctcataaaatcctccaaaaagagctcagctcttaaataaaaattaaaagagtaaatatcataaaataacatatattatggtacaataagttgcacaaaatcatatagattttgtatagtgacatataacca

SEQ ID NO: 64954 - DNA, 1419 bp, Oryza sativa
agtgttttcgcgctaacatgttggctgctgtggaaagaatgcaatgcgcgtgtctttgaacagaaatttcgaagcatagaacagcttgtgcaagatatcaaggaagaggccattgtctggaagacgacaggagtgttcacaacgtgcaatagcgagatcacgtaatatgcattgtaatctgtagaagttttctagcttaccgggtcagggcttttgccccaatctgttttcgacagcatactgtcgttgtaagctctttaattgtattgtacccttcctttcttaatgaaattggtcgaccgaacctttcggctgacccggcaaaaaaaaaaggaaaacataataaagctgttaacaagtgggaaacctagtgatctaggtgttctgccattagttggtgtcggtggtgttgggaaaacaacgcttgctagatttgtataccatgatgaaagaatcaaagaacattttgatttgcgaatgtgggtttgtgtatctgattatttcagtgaagagagactaacacacgagatgttagaggtcctgtgtaaagatagatgaggttatgaaaatataaccagttttgatgcactgcaggagagccttttagataaaattagacacaaaagatttctgcttgtattggatgatatctgggaagataaggacaggagcagatgggataagctgttagctccactaagatttaatgaagcaaatggttgcatgattttagcaacaactcaaaggacatcggttgcaagaatgataggaacaatgcataaggttgaagtgaatggcctgagtgacacagagttttggttgctcttcaaagcatgggctttttttggtaacgagaaccaggagcatgatccaactatgcagtccattgggcaacacattgctaaagcactaaagggcaatccactggctgcacggagtgttggtgctcttctaaacaggaatgttagctatgagcactggaggaaagttcagtacaaatggagatatcttctagaacaggatgatgatattctaaccatcttgaagttcagttatgaatttctaccggtccacctgcagcagtgtttctcatactgctcactgtttccaaaggatcacaaacttagaggggaaaatttggtccgtgcttggatatcacaaaattttgtggagtgcgaatgccattccaagagattggaggaaacagggaagcaatatttggataatttagttgattggggcttcctcgaagaggttgagtcacactacattatgcatgacttaatgcatgacttggcagaaaaggtttcatcaaatgagtgtgctattatagatggattgggatctaagaatataccaccaaatgtccgtcatttgtcaatcataactactgcttatgatcagaaacggggtgcagga

SEQ ID NO: 64955 - DNA, 2297 bp, Oryza sativa
agttatggtttccgtctctcaacaagctcaccatcggtcattatcatcgtataatgtatttatctattatcgttaatattgctttccagtatattgcgaaatcactgtgcacttactttgataaaatgatgtttcagatcatggaaaatccttcctttagaagaaatgcgagcactcaaggagttggagttaatggacgtgcctgttgttgaagaattgtcagttccttctctggagaagttggtgttgattcaaatgcctagcctgcaacgttgcagtggaataacaacttcatctctaccggtttcgacctcccaaatacatcagaagaaattggtatctagtctccataaacttactatccatgattgccccagtttgatagtgtcgcttcctattccaccttctctgatttctgacttatctgcaaggggatttcagtgttcccaacaattaacttatctcatggaacattcagtattgaatctaatgagttgaatgagttggataacaggatcttaccgttccataatctgaagggcttacggtcgatgtacctacaacattgtccaaacttgagctatgtatccagtgaagttttcagccagctcgttgctttagagcatttgtctatagagcactgccctaatttgttccagccacactccatgtccgagcctgttcatgaaaacagtatacttaacacagatcaccttgtcctcccatctctcaggtttctcaaaatttcctcgtgtggcatagtaggtagatggctaacacaaatgcttccccatctgctgtcccttgaatactttttattatcggactgtccacagataaaattgctgtcaatcaaccaaccaacagaaacagaagcaaccagcagtttggcttcagtagagacagcctcatctagggatgaacagattctgaaaattccatgcaatctccttcgttctctaaagtggttgcgaatttgggaatgtgcagacctggaattttctggagtcaatagaggattttcaggattcacctctcttgtgatgctacaaattagggaatgccccaagctggtatcatcattggtgaccgaaacaaatgatactaatgtattactaccacagtcacttgaacatcttgatatcggtcctcttccagcaaacctgcagtcctactttcctaaaggcctgccctgcctcaagaagttaagcctaaatagcggcgaatatttgaagtctgtacaattgcattcatgttcgggtttggagtatttgcagatctcgcggtgtccacaccttagtgtgttggagggcctgcagcacctcagctcccttcgaagattatgcatccagatgaatcctgagctgtccgctgcatgggatcttaaactgtttcctctgtcacttgtagaacttggggtcagaaaagtcgagggcagcttccattcccgctctctgtcctgcctcccttctatcacaaagttagagatacaggatagtccagaattggtgtctttacagctaggatactgcacctcactggaaaagctagagattacaaattgcaagtcgcttgcttcgatcaagggcatccagtccattagaaaccttaggtacttgaaagtactcttcgcccccagcttacctccatatctgcatggggtctcagggatctggtctcgactggaaactctccagattagtaatgcagctgtgctatccacgcccctatgcaaacagctcacagctctacgtgagcttatgtttttgggtaagcagggggagggatatgacggcgagaccatggtgagtctgacagaggagcaagagagagcgctccagcttctcacctcactccgagtactagctttctcccacttgcagaatctcaagtcacttcctacgaacctacaaagccttgactgcctcgacgagttgtatatcagtgtgtgtccgagcatcctaaggctaccacagatgggcctcccaccttcgctccgttacctatctttgtaccgctgcagcgaggagctctgtgtgcaatgcagaatggcagaaactgctaacctcagggtcggcatttactctgcatcggctattcccaggcctggttatggtacatattcctatgcctgattatgttgcaactgcccttccctaatctagagttgatgctgtctgcatatgcactgagtctgaaacaactacacatgtatctgcatttctgctgtgcaaatgctatgatatagtcaaaatgatacagttaaagcttgtgtgtaactccaatctttgctattg

SEQ ID NO: 64956 - DNA, 4809 bp, Oryza sativa
cttcttaatacaatgtttggttggcaaagccggcccggcgaaaaaaaagtttttttttgaaaggagggcaaaagctttgcctcgtatattgatagagatggagaaaaaaatacagagcgacagaaatatgtacagggctagtctaaagaactaaacccgtaaaaagagagagttaagtgatatctcccaaaattccaaactcttgaagctttgaggctcctaaaaaaaagtagaagagttgaaaaaacattaacagaattataacagaaccagctggggaatttgtatgagctgttttttttagttgttgacaattgtttggcagtggattattgcattacaatggattatatttgttcatgactgattgatactaatttgttccatgatcttgtaggtacctggtatagacttcttggtggcttggcgcaatcgtctacacgagatgtaacgtcatctgactccggtgccatctgctggctgctgcagatgatcaccggacattaggagcatgcagcagagagcagctgcacctgctctcttgccatctattcagctcctctcactcactgctgcagaggtagaagatgttaagattcggtcaatcacttgctctgcacaagcattttatacaaagataattcacaaatggatgataccaaatgcatggacgcctatgagaagcattttagaacaagggataagtatccaattactctggtcagctcatgtagtagcctgtagatgttgccacgctgccgcccatggttatgtattgcacaagctttggttcggcttccgcctgtctcctcccaccaagaaatggcgagcgtgatgcagaatgtaggtggataatacaagagaattggaaataaattgctaagccaaataggtatactaatatgagctgatttacgaaatcttttcatttgtattattttgctgataatcatttaacagtggacaactgcacgcagaatgtatcggtattggttggtaggccgtaggcctataccattcacaacccatgtgacggtgtcccatggaatagcattcctgtgtcttcacaagtacatatctattagcagcgcacatatggtgtaccctgccttgcctgtcctcatatggcagccagcctgccagccatccatcgtcaaggtcagttccttgaattcaggtctgtctagtttagtataagtggttgtcgtttcgtattttctgcttatgctcagttgctcagtatatagtctgatggtttttatctcagcgcatttcgtattttctgcttatgctcagttgctcacttccctagagtaatggaaaaataaaaggcatgagtgtgatgttgatcgtggatgaaaagcagaagagttgaaaaggcattaaatactccctatgtttcatattataagtcgctttgacttttttcctagtcaaacatttttaagtttgaacaaatttatagagaaatatagcaacatttccaacacaaaacaaacatattcaatgttatatttaatgaaactaatttagtgttgtagatgttgctaattttttctataaatttactcaaatctaaagaagtttgattagaaaaaaaaagtcaaaacgacttaaaatatgaaacggagggagtaaaacttagcaattttatggacttgcagggacatcaacataaccaaatgagagataccatgggctgatttttttagtcactgattattatttaaagttgtgtgaaaaactcttcataataattgattgtgcattacactggattcgatctgtttatgatttacaccgtcattaattagttccatgatcctgaaggtactcgttgtagagttcttggcgctgtcatctacacaagatgtaaagtcatctggccctgctgcagctgatcattagacagcaggatgagcatgcagtggagagcaactgctcctgctctccgtgtgaagcttgggtcaatcacttgttctgagcaagcattatgcaaagagaactgacaaatgtagatggaaccaaatacatgtacacctatgagcagcttaaaagaaaaagaaagaagtacccagttaatctggtcagttgatatgtggtaccctgtacatcacgccacacagcagccaatggttatttatggcgcgatgtactctgttttttttttacttcagctgcatttttttttgtttcagaatattcacttgcatagattagtatgaaaactgaatttctttctcggtttcaatatgtgagttgcttcagacagttgtacgatctggagtcctgtggcttctgtggagctaacataacacatcgaatgctggagagaaagcaagaatcagagatgagatgtgccagtcagtccagccaagccatatgccctggaatttcaatcagtgcttggtaagaggatgaggtaaggacactaacctgccaagaaaatattgttcgtgcctgaagttttctcagaattgagcatgtcgggagaatctgaacaatggtggttgttgctttgtagtctggagctcaggtgggcattgggcaaccatggggaggaggagcataatgcaggtgctggccagatttttctgggcttctgatcgcttccatgctgagttgagtcgttgcaagcatgtctccaagctctcaagtttgcttcagatgcaggaatgcataagcagaatagtgaagaaacatactccctctttttatgacgttggtcagttcaaaaacattttgggatggaggtagtatgtttgtaatatcgatattggcctatatatatttgtggacgacaaccactgattcttttgtcagggaaactaagtttctgctatcttgtaatctcattggtattcctaatctctgagtgtaattcagtcgcccatgaatgaattagctcatcagtttattggagcttacatggatccggcaagtgtcttgttgtgactggactggatattgtgaacaatgtttcagctttttggtgttctttttttctttcaaaaagaacagattagtgtaagatatggccgatgaattagagattcgtatagtcgatgagatggtgagatcatccagttcgttggtgcaggcagccggacaaattcatcatcagttgttcggatttgctaatcttatacggcgggcgcccgcgacttgtgttgctaacgggcgcttctctgcactgcagctatttggtcaccgtgctcgctcaaagctgccgcgaatggccaccgaggaatgaaaccctagttcacgcccaccggggatgctgcgactgcgaatctgcgattcgtcgcgcggcgttctcgcgggatccaccggtggtgtggtggtggggattccgcgccggcgaaaatctccgccaaatggactggttcaaaggttagatccaccttttctgctatttcatccttcagtccaagtgaaagctgaaaaagaaatgaatctgaaaccggatattttgtgtaggattggtgttttacttcaacagttgcgactattggttggatcatggattgggaggtccgaatcggctgttcattgtaccctcggcccctgtgttggcaaggtcatgtgatacatacacaggtaggagtaacactcaaaacactgtgtgctgattaggtgatctacaagttgcctcctcgactactagaatctatagtgtgtgttcacttcactgaccgagttcaggcctagttcggtcattgttagcacttgctttcacgaaattggcacaaagccgtgccagtggcagagctcgagctcgacgggtattggtggaggccatgtccttgaagccttgtttggatcatggactggcagaatcggtttcattgtgcgctacgcatgccgctctcttggctacatatgttcaggacttcagatcagctccgagctcgttgatacataatggaggtaacacgtgatgtcgcaacaatctttttccctctgcttatgtttcttaggctcaaaagatgaactgctgaatcatactcagcgaccttatcatcttcttatcctcaacatttaggcaacagcatctagtagttggtatgtaacatcacatgcttagattttctgcatggtcgatgtcacagtttgctccactagctcgtaatcacagactcacagtactaccaaatattacaactgtggagccaaagaagacttgacttgcagtctcccatcggctgtgcagactacacatcattcttctttggctcttatctcatttgctccgtaccttctcagttgatcccatcttctttcattgcgccactttcgtctagatccatcctcttgtgcaagggttgttcttgctgctgctacaacctccttaggtgcattggggaacgatgggattggtttccacagcagctgaggctgcaataggatgggtggtgcaaagcatactcgggagtttcttcacaggacagatgcaagtgtggactcgtgaagttgggctcgacaaacaagtggaggagcttgagactgagatgagaaacatgcagatggtgctcgcagaggctgagggaaccaagattgataataggccactgtccgagtcactggatgagataaaggagctgatttacgatgctgaggacgtgatggacgagcttgattactaccggctccagtgacagatcgaaggtggtgccaaatctcatcaatctttcattccatgtttattgttttctaggagcatttcttttgtatttggctatgcaactaagagtagccgaataccatagacatcaccagtaggtttgtctcttggttaagtgcgaatgt

SEQ ID NO: 64957 - DNA, 2655 bp, Oryza sativa
tgctgcttgtactaaccctgaggaaagctctgcatcttcatccactccatcttacattcaacaaataagcaacaggatgaatcaaaatattagttgggttatggatggcaaaaaaaggaaaagagaggaagaggaggagccaactcatagcgtcatgctgcctcctgaggttaaacatggcatttctgagaggatcaatggaatagtgaatcatttacgcattaggggcaatcctgtacagggggttcttcagctagagattttacggcaaattgctttgccaaagcagagtcagaacggacccaggaaatcacgcctgacaatttctcttatgactgaacacaaggtttacgggagggatgcagagagggacaacataatagagttgttaacgaaggggaaatctagtgatctagatgttgtgccattagttggcgttggtggagttggaaaaacgacgcttgctagatttgtatacaacaataatagaattgaaaaccattttgatttgcgaatgtgggtttgtgtatctgacaatttcaatgaaaagagcctaacctgtgaaatgttagaccatgtgtgtaaagatagacaagagtacggaaatattagcaattttgatgcattgcagaagatccttttggagaaaattagacacaaaagatttctgctagtattggatgatatgtgggaagatagggacaggaaaggatgggaaaatctgttagctccattgaaatgtaatgaagcaaccggctgcatgattttagtgacaacccgaaggacatcagttgcaagaatgactggaacaatgagtaagatagacgtgaatggtttggatgaaacagagttttggtcactcttcaaggcatgggcgtttttaggtaatgagaaccaggagcgtgatccaactttgcgatccattgggcaacatattgctgaagcattaaagggcaacccactggctgctcggagtgttggtgcactgttaaactggaatgttagctttgagcactggaggaaaattcagtacaaatggagatctattctggaacaggatgatgatattctagccatattgaagctcagttatgaatttctgccagtccacttgcagtactgtttctcatactgctctctgtttccaaaggaccacaaattttgtgggaaaaaattagtccgtgcttggatatcacaaaattttgtgaagtgcgaatgccataccaagagattggaggaaatagggaagcaatatttggataagttagttgattggggcttcttagaagaggttgagtcccactatgttatgcatgacctaatgcatgacttggcagaaaaagtttcatccaatgagtatgctactgttgatgggttggaatccaagaaaatttcaccaggtgttcggcatttgtctatcataactacttcttatgataaagaagaacattgcaattttcctagcgaaaagtttgaaaaaattatacagaatatcagatctttgcaaaaattaaggaccttgatgttcttcggccaaaataacacaatgctattaaggttcttacatactttatgcaaggagtcaaaaaggttacgattgctaaggatttatttatgtgacaccttcagacatcagctctacacttaatttgttaacgccatatcatcttcgttatctggaattcattgttatctacgccaggtcaacatatggatatctagacattgtaaatacttctattcctcaagctttgacaaaattttatcaccttcaagtgttggatggtgatagtacaggcaatcttgtagtacctattggaatgaatgatctcattaatttacggcatcttattgatcatgaagaagtgcactcagcaattgctagtgtcggcagcctgacctctctccaggaactaacattcaacgttcaagccgctggtaattttagtatcggacaacttagttccatgaatgagcttgtgacacttcgaatctgccaacttgaaaatgtgaaatctgaagaagaggccaagagtgcaagatttatagataaagagcatcttgaagcgttatcattcacatggaatgatcttagcatgacctctgaacctactgcagagaaaacaacagatgatgtacttgagggtcttgagccacaccataacctcaaacacctacagttgactcgatacagtggtgctacatcaccaacctggcttgctagtacagttacatcactgcagggacttcatctatataactgcagagaatggcgagtcgttcgatctcttgaaaagcttccactacttcagaagctgaagttggtcaggatgtggaacttgatggaagtatcaattccttcttatttggaagaattggtcttagttgatatgccaaaattgaaaaaatgtgttgggacttacggtcaagatttgacttctggtctaagggaattgatggtgaaggattgtcctcaactaaaggagttcacgcttttccatagcaacctttttcactcccagcagaaatcatggtttccgtctctcaacaaactcactatcagtcattgtcaacatataatgtatttaccttatttcttgttaatcttgcttgttcaatatagtttcaaaattattctgcgcttactttgcaaaa

SEQ ID NO: 64958 - DNA, 2346 bp, Oryza sativa
ctcacagaggaacaggagagagccctccaacttctcacctccctccaacaacttgaattttccaaccaccattatcttgagtcacttcctgcaaatctacgaagcctcgactccctcgaggcgttgcatatcaatgggtgccggagcattcgaaggctaccagagatgggcctcccgcccttgctcacatgccttaatttaattggctgcagcaaggagctatgtttgcaaggaaaaatggcacaaacggagaagctcatggtctacactgcctgatcgcgtaacacttctgtcttaaggtacatttctgtcttaacaagtaatcgatgcacttacactttgcttgcttaaaagtagattatctttcagcagtttgagtcagtatggtgtatcactgccttgtctgacatcgcgtggctgctggccatcgtcatggacttagggtcgcttaccttgagttcaaggctgtcagagaaagctaaaaaggggacatcacgtttgctctggagacttcgaaattatcatgttaaatggtgaaaaaaaggtaaagatctacaccatctgattgtggtgggtttagatttaatggtggggattggtcgaaatagttttatacttgtattacataaatagaaggttgtatatccaaatatgaaatagaccatgagcttctccgttagtgccatttttccacataaatagaaggttgtatatcaatttcccacacaatttaaataaatttcctacacaatttttaaatatactttaatctagctcagtgcaaaattgtgtgggaaattcagttagtctagcattagcgaccaccattttgtattttccatttgttttcctcacttccctggagtaacagaaaataaggaatggcaggtatgatgtagtttggatgaaaaatataccattttgattttgcaaatgtgggtttgtgtatctgataatttcagtgaaatgagcatagcgcgagagatgttagagtaggtgtcaaatataaccagttttgaggcactgcaggagacccttttggaggaaaattagaaacgctagatttctgcttgtattggacgatgcatgagaagatagttccaggagcagtcgatcaggtgcaatgagctattaactatactgagaccattttcttaaaaaaaaagctatattgagacgtaatgaagcaaaaggctgcatgaagtggtttcagtttgttattgtccgcttataatcaatttcaaacttcactggagtatagaaaataagaaatatatcgagttatatagattgtgaatgaaaaattacaagatggttgaaaaatacattaacacaacttagcagtggtatggacttgtatgggcattaacagaaccagctgggagatagcattgagctgactttttatttaattgtttataattgtttgacagtggattattgcattaccctgaattcgttctgtttatgactgacatcaaaattaattaatttcatgatcttgtagtacttggttcaagttcttggcagagtcatctacacaagatgtaacttcatctggccctgctgcagctgatcacgagacgacagtatgagcatgcagcagagagcagctgcacctgctctcttgccttctctctctcagctcctctcactcaccgctgcataggcagaagatgttaagatcgggtcaatcacttgctctgcacaagcattgtgcaaattgagttgacaaatgcagatgaaaacgaaatgcatggacacctgtgagcagctcatgtgatagcctataatcatgccacgccgctgccagtgttagtttatatctctatgcgtctgctggtttttgttccagttcatattttcagaagcctaaaagaaattagcatgaaacttgagttttctttcttgaagatgaccctatgtagctccacttttgatatattgatgactggttctttggtcagggaagttatctcataatttcattgagggcttgtttggttcataaccttgccaaccttttggccttgacaagagttgtccgttgccaaaatttttggcaaaatttggctaggcattcatttactttgctaccaaagttatattggcattcaactaatccaaataatttagtggtgccaaattgtaagctacaaaccaaacatatcacaaactttttggcattaccaaaatattggcttgcttaattttttatccctattcttggagtgcaattcagttgtccatgattcatctcggtctggagtgccatgctgttgccagtgactgactcggtagtcggtaccaacgttttattttcttcttttggaagggagcaaagca

SEQ ID NO: 64959 - DNA, 6056 bp, Oryza sativa
ctgcaccccgtccaagcctcggtcttcgtccttcacttggcgaagtgtcctgttcggaagagagttgctgaaaaaaggggttcgttggggtgttggtgaggggagttgtattaaaatccttacggacaattggatccctggcttcccgcttgttacctttgccaagtgaggttactgtggccttcttgatggacgatgtgtccaagacatgggatgtagacagagtgaatgcttttttttgaagaagaggttgccagcgctatttttcaggttcccatcagtcgacacggaggggaggactttgcttcttggccacatgacaagctaggtcagtacactgtcagaaaacctcgtcatctttcctagctgcacatagcagtaatggaagaggactcccatcagttctagatgaaactgtcaagaaagggaaggctctttggaagattaaggcaccaggaaagatgaagataaatctgtggcgtgcagctcatgactgtctgcccacgggtttccaactcagacgacgccatataccagcaatggagggatgcatcttttgtaacagggacgatccaattgaacatgtgctgcttttttgcccctttgccagtgctgtgtgggatgaggtcaggaagtcttttaatctccaactgggtcgggcagcactgagtaatatgaagcaatggatttttgactttataagccggggctctgagctacagaacaaggtaatggtggtcacaatctggcacatttggcaagccaggaatgaagcgaagaacaacaactcccctgtgaatccacgtagagtggcgcaatcagttgtggcatatgtgaacatgcttactcaattttgtttcaatctctgtcctgctcccaggtgtgagtccccctcttcagttgctagatgggttccaccgccggcaggaactttcctcatcaacacagatgctgctatcttcaaatctacttgccctctccattgcctgggaagatggtatccaacgggtaatcctggcttccgactgctcttctatcatcagaagaatacaagcctgggcaagggatcgttcttcggttggttgtgttgtctctgacttcaaggttttggcttccaggtttttatcatgctcgttcaagcatgtgaatcgtttatgtaatgctgcagctcatgttttagctcgtcgggccgagcttaatccttgtaattctcaccgtggtgtcatcccggattgcatccaggatgttctatgtaatgatgttacttaatcaatgaaatgctgcattcatgtcaaaaaaaaaagtttaacaagataaacgcctccttgagaaggaattctatagattatagctgcaaaatttgaattgattctcgtcaaaaaaaatgctaaaatttttgtaaaattcctgcctttcaaagcgccacagtgtaagataggagtatagtcaatgaattagagaccccgtacagtacagtattcgttggatgatgctggaaaaatctcttacacgtaaaatagaacggctcattatattagttctagctaactttttaaaaataaatagattaatatgatttcttttaaagaaatttccctatatatttatttttaaaaaatgagatagtatgtgagttaggaacgtcggctgcttgtctgtactgcgctgacataagtaaatttcatcatgggctattttctttttaccggcgtttcactttgggctagagctaaatcaagattttcactttacaccatgtttctttgccaagaattgcactttggggcagggtatgttcacaatctgggtatgtgcgacctcaccgtagatattctgctgttgtggctcttcgccatgcgacagctatgtatttcgttgtaatggtgatgttcgacctgactggcggcgtccggtccaaccggggaggatgcacgtacgagcatggcggcggggcatggcactcagttcaaacaacttcttgatacacggcgtggcacgaacgccttaatttgacgagcatcttgaggcggccctcaggaagtatgaactactccccagtgtaatttagcttagcttgattgctggtcaccgcagccagcgagagggactgtcatgatcaatcggatcatgttgccgcgttgcacgggacgatagtgagttgaagcaaaatgtccaccgcgctgcgctctcaccaggacatggcggcgtatggtcagctagttcacgctcgatctttaaggacgagccacgcgcggttgatacatacgccatcccgctgatgtacagccaccgtcgactgtctatcgtcggccaatattccagcgtgtggtgtggacgctacactacccatcgtagaagaagatgtgtgctatcgtttcatgtatgcagaacttcctttgcatatctaggtgttgccacattgcaatcatctctattgcaagcttgccgatgcccacaatccaatcatctccatcacaagcttgccggcgtcctccctgctctctcttttatctcctgatctactgacatgtgagagtagtacaaagtgaaagcttttggtaaaagaaactagcccaaagtgaaaactttgtctttagaatggtccatgttaaaacttgggtaaaaataactagaccaacgtgcaatttacttaaaaaaaaaggaaagaaaatcagtccttggcgcgcgccactccgtcgacctcgtctccctcagaatcggcggtcggcggcgtctgctccactgtcaggcaatgcaagcatctaccgcatcttcctctcccggattcgctaatccggcgggtgccccgcaacttctcttctaccggcctctcctctccctgcagcgagctattcgtttgcacagtgctctctcaaagctgccgctgatggccacgggtggtgggattccgcgccggcgaaaatcgccgctcccgtccaatccaaaatggaaatattgcagttcctattggtatgaataagcttattaatttacgtcatcttattgctcatgagaaagtgcactcagcaattgatagtgttggtaagttgacctgtcttcagaaattaattttcaaggttcaagatgctgatagttttgagataggacaacttcgagccatgaatgatcttgtaatacttggaatttctcaactcgaaaatgtgaaaactaaaaaagaggccagaagtgcaaggttgatggacaaagagcacctcaaagagttgtcattgtcatggaatgataacatgagctctggacctactgaagagaatacaagatatgatgtgcttgagggtcttgaacctcatggtaatctcaaacatctgcaattaactgggtacagtggtgctacatccccaacttggtttgccagtaaagttacctcgttgcaggtacttcatttagagaactgcacagaatggagaattgttcagtatcttgaaatgctcccactgcttaggaagctgaagttgatcaggatgtggaacttggtggaagtttcaattccttcctatttggaggagttggtcttagttaatatgcctaaattggagaactgtgttggcacgtacggtatagagttgacttcccgtataagggtattgatggtgaaggattgccctcaactaaacgagtttgtgcttttccacagggatcattttcatgctgagcaaaagtcatggtttccatctctcaacaaactcatgataggtcactgttaccgcataatgtaaactatctattcccatcaatcttgctttagtacaattgcgaattttgttgtgcacttactttgttaaatgatttttcagaatgtggaaaatccttcctctagaagaaatgcgagcgctcaaggagttggagttaatggatgtgcctattgtcgaagaattgccagttccttctctggaaaagttggtgttaattcaaatgcggagcctgcaaatttgcagtgggataacagcttcacctgtacaagtttcgacttcccaagtggatcaaaatgaatggatatctagtctccgtgaactcactatctatgattgctccagtttggtagtgtcccttcctattccgccctctcctcttatgtcttactcgtccatcaagagactttcagcatttccaacaatggagataaacaataggaagttcactattgaatctgacgagttgagtgaactggatggcaggatcttatcattccataatctgaagggtgttacatcgatctaccttcgaaggtgtccaaacttgactcgtatttcaactgaaggtttcaaccagctcatcactttagagtgtctggttatacaaaagtgtcctaatttgttccagctacagatctcagatcaggcaaataatacttcatctgctacaaacatccctgccctcccatctctcaaatctctcaccatttcatcatgtggcatagcaggtaggtggttaactcaaatgcttcatcatgttaactcccttgagaagttggacttatttgattgtccacagataaagtttctattaaccaatcaacctacagaaagggaagtaaccagcagtttggcttcagcagagataacctcagcaggggatgaacagcttctgcaaattccatgtagtctcctccattctctaatgtggctctccatttctgaatgtccagacctagagttttgtggtggcagtggtggctttgcaggattcacctctcttgtgcagctacagattaagaattgccccaagctggtctcagcattggtgagcgaaacaaatgataatggattactcccaatgtcacttcaagatcttagcctcagtcctctctcagtctcagaaaacttgcagtccttctcccctgaaggccttccctgcctaagaaggttaagcctatgtaggagccagcatttgaagtccatgcagcttcattcctgtacatccttggagtatctgaaaatctcgggatgccgatccctggttgtgttggagggcctcagctcccttcgaagattggacatccagatgaatcctgagctgtcagctgcatggcatctcaaactgcaagaacaagaacaaggtggcaatcaggctcaggtgtttcctccatcacttgttgaacttcacatctcaaatctcgaaggaagcatcagttcgcaatttctgtgtcttccttcagtaacaaaattagcagtgcgagatagtccagccttgaagtctattcagttgaaacactgcatgacactggaaaagctagagattatcaactgcaagttgcttgcttcaatcgaggatttccactcaattagaaaccttagatccttgaaggtacttggcacccgcagcttatctccatatctgcagcaagaggcctctgggatgtggttccgactggaaagtctaatgattgatgatgcagctgtgctctctgtgcacttatgcatacagctcacatctctaagaatcctacaattctggtctatgggcatggcgagcctgacggaggaacaagagagagcactccagcttctcacctccctccgacaacttggtttctcgcggtgccagaagcttgagtcacttcctgcaaatctacgaagccttgacttcctcgaggtgctacgtatcgatgagtgccggagcatccgaaggttgccggagatgggcctcccgccttctctcagttaccttgatttgtacggctgctgcgaggagctctgtatgcaaggcagaatggcagaaacggagaagcttaaagttgagattatttacaaacagtgaatcgatccctgtaagacactccagaggtacacctttgtttcccacgagtcacatatttagatcatctttcttaagatgtactgcagcaatgccagtcaccgtatgttgtaatgctgccttgactgacatttcagtgttgctgccagcatcggtgtggtcatcttgcctgtgttcaaggctgcctagtctagattatttctacttataatcaattgcaaacttcgctagagtaacagaaaataaggaaattgttagtgtattctttctgctggtgacttgac

SEQ ID NO: 64960 - DNA, 11682 bp, Oryza sativa
tccagcttactcggcaatcagctgggagcaataaacaacaagcctgtaaagtggaacaagggcatggcaacatccacaggctatcacattctggaaacaaacatgaaagatgcctgcactcctggagagatggagcctagacattgcatggtcatggtgaggcttcaaatccatttccacctgatgaatcgtccattgcatgccctccagttttggaggttaaaatgggttgtcaatgatgcataaaacatggtcctcattgataatgatgaagatgagtcaaattacctttacaatctcatggtattgccttgcaattacatcaaagggtggatctacaccttggtactcgcgcaaccgtgaaacctggtgcaagataaaacgacactctagaatgtaaaaacaaattatgggaaagtcgactccttttcaggtaaaagaggatactgaaagatggcatacattgtttatagaaattcagttgaaatagataactacagagctctagttactagatttccattacagagttaaggactagatattcagtaaatgagtaataaccattgctattaaggatttaatgaccaaatattttgaagattacaaggggaaagtaagatgggtgtatcataccgcttcagtataagaattggatgcttctttcgtggcctctactagatatttcctgcaagaaacggtaaataagtaaaaaatgcattttcctgaaaagaaaagcactcaacatattggatctgttttgagaagatgtaccacttaactcaagatatcatgtcagttttttttaaatcaattaaactggctttacctgatcctatgtagtgccggtactgtttccttggtataggtgtcacgcaagagatgatgctcaagatagctagaaccatgttaagaaagaaatagttaattaactctgttttgtcccatcgctgactagcaaataactcaattagaagactaactatgtttaacaaagtacaaattaagatccgttattaggtgatgtatgatggacgtagatgcaggtaccaaccttaatttagcattcattgtccggcaccttttaataagccaagtcttcttcagatcatcctattagcccacaaagacaaagtaggaggattaactatatgaaactgaaaacactccatgttttcaaagaagcagcatcataataggaatatgagaaagcttacatattgatgctgatgttccaatttcttgtctttaacgaactgtataagtacagcaagaatttgctccaggaccttttgaaatttcaggagccatcagtaagtggatataatccagaatttctactagaataaagtgagctaactggctatgtggagtttgagcaatcacttaatatctacacacgtacattatagtgttcggcaaattttctatccatcgaagcaagatcgtctagtagaagggcctcttccttttcaatctcttcaataattaacttcaccctgccaaaagggaaaatcatattgtgagtaatgcgtctcatgaattccctgttattaatattttaagtccaaacaagtaaaggttgacaattggacattgccatcaagaactgagaatgcactgtgagtgatcagagtaaattattacagaagcaaacaaggagattttttttcactcaaaatgttatgcttgacctaagagagttttggcatatcaagcatttccgtataagtaaaaccattgcaagacaggcaaagatatgaaatttcacctttctggaagtctggcacttgaaatctgactaatggatgatgaatctgcagcacatttgaaatgttaagctaaaacaataatattgaatacaagatgtgtactgttgtctaaaactaagttgcccaagttgcattgcataaaatggacaggaacgcagggagtgaaattggtagtcatagcaagattcaaaaactgacccctttcatccattgcaaacagatcagctaaagcatcacacttggcttctaagcgggcctcaatctctcttgccagagttcgttgatagtcaaccatgtcctgcaacgggaaatcagaggtacatgctgtaaacgtttaaacagcccggttttgaaaagaaacaatgtatgtcctgattgctcttcagtaaatggtaaacaaagataggaagcagtgaagcagtaattgtctgattccccaagaaacatacgataatatatccaaaactaaaatgaaacttgaacccaccaacaactggttcacacgataaatttggttgcaaaagattatacataccacggtcatggctggctgctcttgctgcacctggtagagataatccgatgtgattccaagaaaacgatcaggaacaccgccaacaccaggctcaactggctccgaaccaccagtaccaggggccgcagcaacagtggctgcacttgcggtgctgctgtagttattgtaactagtcgagattgaactcgagctaggtgcggcacttgtcatggtgctatcgaatgagctcctagacaaggtgctcagcttctctatctcctcctcatgtacatctccatcctgcgagagcagtggaagccttaacctctgcgcagcctctgcaaccgccaaatggtgctccaatgactcgtacacctacatcagtccatacaatgctccattttcagtcagataatttctcaatttagcagcaaaagtttcatctgcaatcaaccagttgaattcacatttgcagctttatgtccaccattcactgaaagacgcaaaaatttaaaaatgcgggagagaagtggaacctgcggggagcagttgagcttcttcccagcgttggcgacgccagtggagatggcgtgctgatactcctccaccatagcaatggcctccgcgtacacagcctaaccacattacccccagatctgatcagaaccccaacgggaaaccctaaaatcccagatcccacgagaagggacgggcgcactcaccagtgcctccaggtatcgcgcgcgctccgacgcgacctcctcccgcgcctgcggcgaaggaaagcacagagacagcagcgggtgagatcgcggaggtaggacatcgagttcgcggaggtgagatagcgtacctggaggaggtcggagtgggcgcagctggagaggagggaggcgtcgggggcgaggtggtggcgctggagctgatccaccaggtgcgccacctccggcggcggcggagggagcgacgcggcggcggcggccttggacatcgtcgtcgccggcgaataagaggttcgttggtggtggtttgaatcgtgtcggggaatgtggggtttcgtttgtgtagccggatttgggggggctaccagccgttggatcgtgggatgacggatgagattacggctgattcattcggctatcagagacacggaaacaaaaatgcctctataatcttctgaaattatggatgtccactataatctccttcatcaaattcgtcatctctccggtctttcatttcatacgctgtttgttatttttatttgccgaggccaaattttaaaatttttaagaaaattagaattgagagttgatttttaggggtttttcatcgtggttcattttaagttgacttaaaaaaaacctgtgaacattattatttttatgcttagttcttttttccatggcttatgagccgtaaatcaaacaatgtgtacttcgattttaaaatgagatggtaaatcctagtactatattttagaaacagatttaatggctaggtttcgttatgctcgagcataccctcaaatgtttgcataaaaatttaaaatagatgatatctctttgtgattggtgttggagaaggattatagaaaagaagaacgggtgtttgctcgtcctggaagaagaacataagcaacacaatgatatgattagaactgaaacggtataaattaaacaacttactccctccgtcacaaattacttgtctctttaagatttaaactttgtctcaaaatggttatcataataaaatactatttgttccatcaatcgtttctaattcaaatttatcttttttcttgcccctaaccaacctcctacatccaaccatacaatatttagttaagggtattatagttttttttcttaaatcttaatctatgctttaaaaaaaaggtaaaattgtggcacatcaacgtgcatgagcttaataatttgattagatcaaaataccagcccatatccccatacacatgtggtcaggtagatggacgaccttcaagtttgttgttttcatgttcaggcttgcatgatacgattacgatctgccatgatgtctttttctcgagattatggtgtcgtagtcgtcttcaactacagtaaccagacttttatgacagaaaatggtgcgccaaagcagccataccatatgaggaaaggaaaaaaaagatagaaaataaaacacaatattgaataacttgcaaatattgtattgtataacaagatttgtccttggggaccttttattatgcgtataattagcgtgttttttttcgaaagtatttttatcccgaaaagagaagcactagaaaccaaatttcaaaggaatgcgacaagatttatgatgatagccttactggagaggagcatcatgaaatcatcgtgaatgcgacttgaattgaattattatgctcatcgctttcgcataacctctgtaggagtacaattctttactgtactaaccacttttgattaggagtaggagtactgattttatttcaggataaatcaaagcaaaaggaaatatatgcaccttgtcgggtcatcgtggctgctttgatgatgcactcatcaccttcacacgtcggatctaagagaaaaacggccactaaaatgcattatacaattctaataggaattctcccagtcgaatttaagagagaatttggtctcgaactctcaacgaatgaaaaaaaaactctgtttgaaacgacttcagttttatctttgaaccaagtagttgtctaaaatagcgacggataaaatgtttgtgcaacaaatgtattattactatctcttttctacacgataaagatttcgcatgaaaattgaatgtttttctagtattctcccgtttcatattataagacctttgctttttttttctaatctggctttgttaagtttgactaaatttataaaagaattaataatatctaaaataaaaaattagttttattgaatccaacattgaaatattttaataatgtgtctgttttattgaaaatattactatatcttttacaaatttaacttataatatttttaactaaaatgaaataatatgaaacatagtgagagaggtgagagagggagtagtaggtttggagtggataggtgagcctgaacatgaatgagtcagcgacgagtggaacaaacatgtggtgtgctgctgccttgtcgtcatagaacaaccttctcttcccttccctcacctttcgcgttcacctcagctcagctcgtctctctgactctgatctcgccgtcccgagttcgccggacacgcacgcacgcggccacgacggcggcgatggagggcgccctgctctgcgccgccaaccacgcgccgctcacgcccatcaccttcctcgaccgcgccgccctcgtctaccccgaccgccccgccatcgtcgcctcctcctccgggctcacccgcacctggcgggagacgcgtgaccgctgcctccgcctcaccgccgccctcgccgccctcggcgtccaccgccaccacgtggtaagattcacctccgctcgccaccgcaatttctacagtaacttgattctcaccattgattgattgggttttctccccaatctccccctctttttcaactgtttgttcatgctaaaacccccaaatcgcttcgaatttacttgtaatttgattcggaattagcggtcgagtgattcgcatttttctgtgtaggttgcggtattcgcgcagaatattccggcgatgtgcgagctccacttcggcatcccgatggccggcgccgtcatctgcacgctcaactcccgcctcgacgccgccatggcctccgtcctgctccgccactcggaggccaagctcatcttcgtcgactgcgcgctgctcgacgtcgcccacgacgccatccgccgcatctcccaatcgggcgccacgcctcccgtcctcgtcctcatcagcgagctcctcgacgacccatccgatgccaagctcccgtccggtcgtgtcgactacgagtacgagcacctcgtcggcaatgccgggtcgtcgccggagttcgcggtgcggtggcccgccgacgagaacgagccgatcgcgctcaactacacgtcgggcacgacgtcgaggcccaagggcgtgatctacagccaccgcggcgcgtacctgaacagcctcgccgccgtgctcctcaacgacatggcgtccacgccggtgtacctgtggacggtgcccatgttccactgcaacgggtggtgcatggcgtggggcgtcgcggcgcagggcggcaccaacgtgtgcgtccgcagggtcaccgcggccaccatcttcgacgccgtggcgcgccacggcgtcacccacatgggcggcgcgcccacggtgctgagcatgatcgtgaacgccacggcggaggagcagcggccggtggcgaggagggtgacggtgatgaccggcggcgcgccgccgccgccgaaggtgctgcaccggatggaggagcaggggttcctggtgatccactcgtacgggctgacggagacgtacggcccggcgacggtgtgcacgtggaggccggagtgggacgcgctgccggcggaggagcgggcgcggatcaagtcgcggcagggggtgcaccaccacggcctggaggtggacgtcaaggaccccgccacgatgcggagcgtgccgcgcgacgggaagacgatgggggaggtgatgctgcgggggaacacggtgatgagcggctactacaaggacggcgcggcgacggcggaggcgctcgccggtgggtggttccggtccggcgacctggcggtgcggcacgaggacgggtacgtgaaggtgctcgaccggtccaaggacatcataatctcgggcggggagaacatcagcacaatcgaggtggaggcggcgctgttcagccacccggcggtggaggaggcggcggtggtggggcggccggacgactactggggcgagacgccgtgcgcgttcgtgaagctgaggcccggcgcggcggcggcggcgaaggcgggggtggtggaggaggagctgatggcgtactgcagggcgaggctgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagtgtgccgtgcggttttgacagtatactgtcatcgtgtgggcttgccatatgatgtggtaacctcacacggtgatacattttcggtttttgtcggtaactatacaattagggccttcactgtgcgaatacgtggcgagttacttcgatacgccagctcggagattcgtagccacgtctatatcagtcggcccccttgtgaagagcggcggatctcaatgaagttctgtgttcctggtgctgtcaagattataatcgtgggccctgtgctgccaaagtctaattcaaggtcatactacctccgtccaaaaaaacaaaaaacgaatatggcatagtattttagcacagtgaatctggacagatgtatgtctagatttatattactagttttaggatatgtcacccagtactagttggttttttatgggacggagggagtactgcactatgactaatatgttgatcggttcttagattgaaaaggtggttcgacgcacgatgctttgactatggatggccttatcatgtattcgtattgaccgtgatagtgtttggtagtggttgtctgtactcaaccaaacttatcctatcaaccatttcattttgatttagacatggcatcagaacaacctgaatttcgcttatgtacatacgttgcttttaccactaaaaggccggtttgaacttaaacagagtagcttgtttatttgaaacatactctcttcttcctaaaacaatcaattttttatataattcgttcacgtataaagttgtctcttactcaaattcacgtataaaagttgaattttttttctgtaatagaggaagtatgattttatattagggttcttgtacagtttaagcaccgacaaccgctatctgtaactgcaaagggaggaaaatgagctagcttttatacatgcccagctcattgtttggcttatttaaaaaataaacccaacggtatatttgtaaacgaaaactaatttatgaataaaacttttatatacatgttcttaacaatctaaaagtaaagaccgaaaaataaactacgataaaaaaatctcaaaatcaactttaaatttaagattaagaatttaaaaaaaaattaaaatttgagttataagcataagcattagctaaggctgtcaatgtggctatgagagcgagacagtggttgagtgacccattgagctgggcaaacgatggtgcaccgcgaacgaaccaaacgcctagtacagccatagcccattttggtgttgtgtcgccaccaaaggcgattttttcctccttttttttttggtaaatctggagagcgactgacaaaggggggacgcggccccgactcggcgactccgaccgacgagatcgccgtcgctccatcccccatggctgcctcctccgccccacctccccctccccgccgcctcctcgctctcaccatggcgctcgccgccgccgtcgtatccgccgcctccgccgcgagggccccggcctccgtcaccccgatctcccgcaccctctaccactccaggtgcgcctccctcccacgaacgaacccctccctgccgtctactcttctcgggggggtttcgattcggaatttgggggtgatttcataccatttcgaacctaggtcgatgccctgcttcagtatactatacctcgtggttgacgaatcgagagagtgtccctgtttgcttaggtatcatttgctgctgcgcgtgatttcactgcgatttgttctcgttttccccctcattaagtgtagtctcagattggtgtggtggccattgctttgtataaacggcatcatacatcggtcctggcaccactaatgtggtggtttctaggaaaaaaaaagaatacgattctttttattttttttcagcaagtggtatactggcaccacaagcctgtatcttaatgcaaacgtttgcaggcctagttgtgagcatgtgagctgatctgaattttgtacgagtgtgttcaaccttgcattgcttgcttgcttgagccggtctgatgaggagcatatagatacaatgtatcggctttttgattctgtctcctgtgtgcagagcatcatgttaactgttccttttgtttttcctcttcagtgattcccttctgagtgatatcaaggccttggttgcccggcatccagacaagttgagtgtgagtggtttaactgccctatttcagtcattgttggccagtttgttttgttgcatactagtgtttcttatgaaattttgattgaatcgttgcagatggataccataacagcaagtaacaaagggtattccacagacctctttatcgttacttttaatcatgccaaggagagcacgtccaattcttcaaagatccatgtccttctggttagtttccaacagaaattaactcacgctggatcattctgtgcacactaagttatttcttaccactaatatttatccattgtcccaaagcaaatggtatttgtttcactgaaactgttgtcatttccaacctcaattaagagaaatcccaaagcaaagcaaaacaaaaccaactttttgataatttttacacattggcttgtaaattaaattattgatgtcttgcggttttgacagaaaggttcattgtcttccagagctttgggcagcatggcagagagcttatcacttctgaagttgcattaaacctcctctatattttgaccgagaagcggaaaattgctggtgtcgatctatcatcctttgagaagatactggagaatcttgtaatcaaagtacgtccttttgtaacttgttttgacattttcacctcctgacccacataatcattaggagatatatcaatacacatgctcttttctggtatgctctgcatggaattactagagcttaagggcagtctcatttattaggaataaagtataagatagaccaaagttagttatttcctttaagccttgtctgattccatctttgttctattttgacatattttttttactctctttgtttaaatatttagtgcagtgaacacgacaaaattatggtttaaacgtcattactaaatgtttcacctggcatatggtgtttttctcctaaattactctatgcgtatgtcattattctaatatatacaagcttggtttggcttgctaagtaaaatatttcatgacatgaagttcttagggttgttaacctgatccatgctctttagtcttcttaacttgttgcttcctcttcccctcttttcatttttgttattttttatatttctatattaacgaagaatcagatttcttaataatcagttatgattttttttaatgtggctttgatctttaggtggtgcccatggaaaatttaaatggtcgaaaacgtgttgaagaaggggagctttgtgataggagaaatggtgatcaatcttatcttgtaaattcatcacttgatgcagttctatgccaacttcctatattcatgtttttttcatttttcaggaagaggagttgatcttaatagaaattggagtgttgattggggaaagaaggaaaaggttgttttctcagcagtttattttatgcacagggaaaactgtttccttttgacttactgtagtgtgcatgttgattttactgaattgcgtcttaagctaattacctaaattcatatggacaagaccgtagcattccctaaacttgctcgcttgctaccattgattgacatccttactatcttagaactatttttaatttagatctatagagaatttagaaaatagacctctgcatatgctatggttcattaccatgtatcttagtttgtcatccttggctgttactacgcctgtatatggtatggttcagtggttcactatcatttatcatatgcgttaattgctgattgttggattacttaacctcagttatgcaaatgtagtgtacatcatatcaatattttgagctatatatgcattttacctgtattataggactacgacccatatgagga

SEQ ID NO: 64961 - DNA, 1032 bp, Oryza sativa
cctgcaccccttgtattgtcatgagctgcttcattacggaccagtgacgtttgtatcccgacagcctgagcaaacctttttttttcccagaaaatcactcaagtttaacatcaatatgcgtgttttttcagtatgtttagaacacttgttaaaattcaagtctcgcaagaataagaatttgtgaaaagattacgacagaaaggcaatacgctctatacaaattgttggcaagtgtcaatgcaacgttgcaacatactttttgcacatcttctgaacgaagatttgttgcaattatattccattttccacactctcacgaaacagagatgagatgggagcatccacatctttgaaagactgcacatttcaaactgatttgagttagacacaggttacaggtgcttgatgagaagccaagcaatgaccgcaagaaacactatagcaacgacagatatcagcagggccatgcacgagcagccacctttgacgcgcttattcagaatagcaagcctcttttgcacgcgctgaatcaaagaaagatttatgtcaaaattcagttcgcataagcttgaaataactatataacagtgaaactttcctgatgattgtataaagaagtaccaaaaatatacctgaagacgtgagtttgtaacatcaacataatcatccaaatcatcctgcaaaaaccacaatagatcagttgttatcaagtgctaggaacataaattcatatggttttgtgagaataaactaacaatcaatcttgtatgcagggtaagttcttcattgactgctagagcaatatgttttgtgctcagtactgtctcttccagcttctcaagaccctcatcttgttctgcggattgttgcaacaggcaagataaatgaattagctacaatgcaataattgtttcccgtactaaaagctactgtttgtaaccatctagatatatacaagtaaatacaaaatgcaactctgcgaacagatcgggccacttagaatatatcaggggtgctttactggggtgcagg

SEQ ID NO: 64962 - DNA, 4865 bp, Oryza sativa
  unsure (1)..(4865): unsure at all n locations
nnnnnnnnnnnnnnnnnnnnnnnnnnnnnnnnnnnnnnnnnnncacagaattcctgaattgctgtagagtctggcgatttgttctgcgagaagaattcaaaggcgtcattcccaccagcactgatgaggaagatggattttgacagcaatgttgacgctttttcggcgctcaatatggtcgaaatctggtctctgagatctgagaagtactctatctgctttgtcatgctgattgtagtcccctggtgcaatgataatttgttaagtcagttgtcagttgtgtgcagtaaactgtactagtagttgcactttggaaaagtaagtaaccaaattttgaaccagggagcagaatttatagctttagttgaaggttggaagaaaattttcaactttaggtagcaaccatgctcctaccaaacttcctttttttctggtgatcataaatatataggacttgaaattcaattttgtgtccaacaaaattactagcattacatgacatcacaatccacaaacatatccatcataataacagaaataacatgcaggatcaaaatggttttggagaattttatgcgtactgtggaatcaagaacaccggagcctccggaagcaaagctggctcctttcatggcggatgcagctgccatcatcatgttgctcatcacctcaccactgctgttagcatccatggcgatgagagagaggtaaggtggtggactcctggtgaaccccatcgcagccgctacaaatttcattttcaaatattcttctccattcatcagaatttacatattgaatttgctgaaatttgttaactcaagtgacgacgagatgatcacttacacttactttttttccacctttgcatacaattgcaaaccgcaatgacttcaattattttcagtgatgaagctacttagactactactcacctatgaagtcgacgccgatgaggccattgctgaacctccccgtcggctcgccgccggggaagtcgacaccgttgtgagggaagtcggccctggcactgattccggccaggtaattgttgttcccggcgtcgaccgtcgagtcgccgaacacgaagatcgccggaaccttcgccgcgccgccaccggcagcgcccctcgccgtcacagcagccacggccatggccacgagaagcaaccggagctcggtagctcgtagcacagccatggctatgagaagcaagtgaccttgtgacaatacaagcagatcagctagttatatatacagagaagagagagagctagctcagtgcttaattagtacaggatttgggttggaatgtgattacattcacccttacagttacttgttactacaattaactgtactcagtaactaccacaaggctcaagagagaacaaaaaggaggaagccagcttgtctggaaagttcttgattcttgatgcccaggacaaaagcactaggggataagaaaaattggagcaagatccaattgattgtgcattttacaagctatgttttgataaagatgtagcagtgcttatattttggaacagaggtgcatcttcaaatgagaatagacaagttcactccaactctccaagtgtcatcatccattcagcaaattcaaatcatgctttcagagcccagtacatcagctcacccggagagaggaacaataatctattagaatataatagtatgtatatataagtttactctctctctcaaaaaaaagagcatgaataatatgtaaggcataatgagcatcatttttagcataaattgtacacctgcatctcaggtgatgctacaatgtaaaaattacaaatgtatcatctgccaatctgctcaacatgtacccccaaaaaaaaagttttgccgagcatcactgaattgaagttctaggtgatacaacaaacaaaatccaactcttccaaggacgtcgtttccttatcagcacaagttctgatgataatttcaatctcggataatagcaatcctgggaataacaaatgcaaatatgatctgaagagcagaatcttcatgaagaataattgaaaatatttgcctttttgcgcaaatataacatatgattgccaaccagagcaaggcaattgtggatggttcacaattatgcctttttcctagtgatcctgtcaccacacaaaaaacctcgtgtcaaacatttgatacaaaatggcagaaatgaagtgcatagcagtgactaacacaaacctgaagcaatgaatcccgagagcattggtgatttcatggataacagatgtagcaaaatgcatgtagagagccactgccaaaattgatcaaaatagtgagatcaaacatacgtggaacaaaagggcttgtacaaggtaagatatgctactactgtaaaaactattgaaaagaaatcggtaaaaactactacttcaagcgccatcggtagtaattaagttctggaataatgtagtaccggtaaataagcagtacattaggagaactagctgctcatcaacaagggggtttctgcaacaacaatcgatggccaaataaggttggtaaaaagagttatcatgtagaggataataaaaaggtagttaggcacaaacccatcatcaagccgtgcagtcagcgcatttgcaattgcaaatgggaaatatgctagggactgcaaagggaggcacaatgtttaatcataacaaaatatatgcgtatcatcatatattacttataaaaggtggtggaaaacaaaaccaaagaacaaaggtgattaggcaacaaccatgcacatccctgtcttcagacctttgggctcatcacataagtgagccagaatcattctgccctgtgcataatagaagtagatattaggtaatgctcataagagtgtcttttgcaacaaaagaagcatgtcagaccaaaatatactggcttacataaactatttttagcatgacagacctggaacgatacaatgctaaaactataaagtgatcatattataaactgttgcttagagttgcacacctactctgaacagaatctttaacacaaaatatcaaatcatgccagcatggtctattgagaaataataagatgagcaatattataaaccattccatgcattaggccaataaggcgattttcatagcagcaggcaggatgacagacagaaatatatttcacaatgacaggaagttaaaagagaaacatccacaaaacaagtatttgcaaggcaataaatgtatgagttatagcacaaggccttaccacaagaaagccaaatgcaaaaccagttccaataactagaagatgtggctggtttctcattatatctgaaggagataggtaggacctgaataaaaatgaaaaatccttcagtgacatgctggaggattttttaccttaactgctagcttctgttgtctagctcaaatttaataaattaatagaaagaacaagaaagatatatacaactaaactagaattaggtgaacaggtataccagacaagaactccggccaacagcaaaccaaaaggaaagagctggcacaacaaaatagaatatcatttgaaaaaaagagagacatgaatacatgataaaatcacaaaatgacatatttagatcttaccattgctagtgccagcagcatgcttccttttcttgcctcgaccactttgtacacattgtgaatgctgtaggtttagaataatgcaaattgatcataggttgaatgtttatcggctatcaaataaagaacgttatgatatttttatttaaattcaatagttgcctcgagagtgaattgataaataaaacacaactattttttcagttgattccaagagaagcttgctggattcatatgctccatagtccatagatgactaaactgacaggtaatataaaataattcataaagtagtacatgctgtgcagtaagaacttacttagatccaatcgtcggaattacagcaaaagctatcattagaaacagtgcaattccatatactgggacctctgcaaagaagcaaccagcaattaattatagtataggcaatgccagcatttgtagctgtccaaaaccctacgtctattgcacagtattaacgaaaaaattgcactgatatagatgaaatagtatgctaaaacaattgagtaccatatgattaccaaaacaataaatattacgaaacgattataagcttgctagtccccataccaggaacaagaggtacccagtttagtaggggtattgacttccggaaatcttgtgcccaccattcagctcctgtgaaaggaaagatgagctattagtattgctataaccacatggcttgaatgtgactggctgatatacatgcacagtaaattgtcagaataaaaccacaaagatttacaggctcagaatagatttgattagttaaaagttgataaaaatgggaataaaatagtacctgtgaagaaggtgaaaaaatggcacaaatagattagcataaggccttcagtcggtccgttgactataggaagaattagtgtgtttgtgaaaaagctgcagagatgacaattaagtgtgaatagaaaggtactactcaaaatctatgcagtgaaagtctcttaatatcaatgcaaatatagaaacaacaatgagcagagtatctagtttattagttcttgaacttgaaaaaaagtagtgcttctatcatctatgttcttgcagaaactaaattgaattgggccaatgctgataaacccttgattttcttaccggtgctttcgaattctttaagagcactaaagcattccacagaccatttcacaatagatgagtgagcataaaaaattggttcatagtgtagttgatgctcta

SEQ ID NO: 64963 - DNA, 1946 bp, Oryza sativa
agcaaatgattatgtactgatattacagtaaccattgtttcagattacaccctcctgtaggaagcaaaaatgaccagagatgtaaaaatgaagccatagcactaatttttgtaatgaacctaactttagcatgttagagaaaaggattaactaatactactgtattgaataggagtatggaataggatgcttttcagtgtccagcaaggagaacaaaagctgacattttgatgtccactgtctgcagcccactggaagatgctctctaaactaaaaaatgactccacaagctaaagaaaagcttgggattcctcatgcccatgctatgtaactgtgagcgccataagcatatgcgataactgctaacccagttgaacgaatcaaagaaaaaactcgaaatgctactgtccctgtaggaaaaaagaagaagaaaaaaaaaacacaaaagcgacttgtgcggtggagaagaaaacattgtgaacaatcatcttaactagtgccagtgtttctctttgaagcaatcatcttggcgaaagccaggagcttgacaaggcacggatcaaaacactggtggaatggaagaaaagaaaaggaaaggaaagaaattcgagggggcgcggcgcttacgggaaccagagcgggaagaggttgacgaatcgtgaccagaagggctggaggatgtacttggcgacgagcgagtggtcgacgccgctgtacttgtacctccgcagcgtcgccaccccgtgctgccccacgtaccccatcctctccctctctccgcctccgccgcggccgctgcctcggaatccccaaatccgaatccccgatcggaacaagaaagaagaataagaagaagaagaagaagcggatgaatggggaaggaaggaaagagagcgggaagaatccttgggaatcggaggaggcgatgtgattggcgcgggggagggggaggatctggctggcggcgaggcgatggtggtggtggtggtggtggtggccgccggtggtgattggttgatatgctgcgagaccccaaggaggagggaacaaaaggaaagagaaagccgcggcgattttacggtttagtcccttcattttgggaatcatttgtcatctcaaataggagaatgaggatagtgcgagggcacatttcaaaattcaagtgaattaatacttgaaaattaggagtactactatacttcctctatcatagttttacactgtttatatttaacatttgatcgttcgttttatttgaattattttatgattaacatttttattgttattaaatgataaaacataaataatattttatgtgtgactaatttttttaaaaaaaattataaagatggatagtcaaatattggatatgaatatctacagttgtacttattttttcatgtgtgtgtgtggagtattaaatttgaaagtgcaatagattggataaataaatgtaatccagataaaatataaactaactttgaaacaaaggttgcctatgtttggtcacttttggtggtgtgcaagtggagtggtttataaaattatgtcatcgtgttgctcgcctctcgtcgtcttcccctcttcccacgcgcctctcccgtcccgtgtcccacctgcgtggggtcaaccggtcaacgcgccacacgctttgcaattttccactctcacccctcctccccccaaaaatattcaatctggcccaaccagtacaaggctgacatgacatacatgggcagggaccacggcccaataatgcaaagcccaacaaactccattggcccaaatacggcccactaaacgaaagcccaataatatatctcatgggccaaaagcctcctccttcccgtctccttctgtcaccattcgattcccaaactctcgccgccgccgccgccgccggggacgatggggaaggtgccgcacgccatgcgcgccgccaa

SEQ ID NO: 64964 - DNA, 2025 bp, Oryza sativa
cgcttgctctcctcgaggagatggaggccaagggatgcgagccgaatgagcgaacatacaacactctgctcatggggctctgcaagaacaagaagctcgacaaggccgtcgatgtttacaaatccatggttggtgccgcgatgaagcttgaagctccagcttatgcgacattcgtcagggcgttgtgtcgtgcagggagaataccggatgcatacgaggtgttcgactacgggatcgagagcaagagctttgcggaggtgacgttgtatactgagctcgagaactcgctcaagtggctgcaccggatgaaatcataaagtaggctgcatggccagtatctttgtccctggtacttgcttcagccttagtttttttttccatgaaaagctagttgcctgccttaatttgttgtattacaatgaaatatgcaaattcagagaatctgtgatatgattgtttgatctaccaaaatgtacaattgaagctacaaaatcttgaatatgctcttagtccttgagaatcaaaaatggcaagagccctattctgatctgtaccaagcttttctagcttgattcgatgcttttgtgtaaacaaacacaattttttttcttcaaacgatttttttttcaggtgtgaccatgaaaaacatcaacactatgaatcagaatcactaaaatcaaatattgtatctgaataaattatctagtagtgaattgcatgagctaatcaagtacatggatcattagtgcagtgtttttatcatgtacaaaaagcatgctattggactgagattttagctgcttcggacatcttacctattggtatatccctatataaaatcaatgcaaattgacaatagttttctcacagcttcagcaaatgttccaataatttttgctatgctaagtttacatttgatatccacattgtattgttttctcctgactacggtagcactttagttattctctgtgttatattagtgagttcaattgtcttctgaaaggcatttggtcattctcatgatgaacttaatcagttttattgtattaacatcccattggtttgcacttgctagcaatactatgtttctagtgtttcttcaaatcctccaacaaccaccgctagggttagttgtttgcggcatgactctgctgacatccattaacatcttcctattgacagtggagcaccaccttgtgggttagttttggtatgtagtgccccctagcaagcatacaagattaaaaaaacacacagaaaaaccatgcagctgtcagataaccagagatgcacccttttttaaaggcatttctcagccttcattaaaagcataataggtttttcactgaaacacagtgagtttcaggacatcttgaagaatgtggtaaattactcaaatcttgtaattcactaggtactgcaatggttcatgctagcatgggagaaaactgagtcatcatgtcctgccttttccatgaccggcaagctcaacagaaaagatgtccgcagttgtatggttttctgctatctctatattttaaatacctagctagcacaattcatttgttccctttttgcagatccaatatttatgaaagcacagcttgattacttgaatggtctgcatcagatgtttatacccttttgttggtaccgactactgagcaacttcatactccctccgtcacaaaaaaaaaaagacagatacatagtcagggtttgccttttttgagacggagggaatactttggaatgctcattagtctttatgcagcagtggaatctcatgcaaaagaagggatattgtactagaggaatatattggtctttttctattggtgtccccccactttggtccctctgggatcagttttcctgtaaatgtctgaataaatcatccaaatctcaatttctgaaggtccatatggtccatctgtaggagacattaagcttttagtaaactgactgttgtctactggagtaaagcaaaagatttgtggaaataaaaaaaaatcctgcttg

SEQ ID NO: 64965 - DNA, 702 bp, Oryza sativa
tcctgcagcccgaaaatgacagcttcctacatttctttaggcactgcaattgcgaaagtagatttatttctgtgcataaagtgaaaagtgaaaaaaaagggaaaagttggcattttctcagcactaccatggcatctacctgtaatccatcagtacttaagcaagtaagcatgctgatgcgatttgtggcctttctgcaagtagctcgtggttttgtcaacccaacaatcgattcggaaaaaaaaatgctaaaatgtcaagtatgtcgaaatgttttgtcaaccccacaatcgattcagaaattactatcagatttcttttcgcacttcatatgttccatcattcttttcttatatactccctccatcccacaatttgtttagaatatactattaaggtttaatacaaaagtctataataccccttattaaataatatatgatgagaagtggaatggttattgagggtaaaataggaaaacttttgacaagtattctgggatggaggtagtacttatcatcgtaaaaatcatgcacataaatatatagatcaatggagcacttttgcaagttgtcacttttagggtaagtcaacattaagtatcagctattatatatctgtattgcaggtgatagagcactcactctagtttgctagttgccaaaaacatgcattttgtgcaacacatatagaagcattatt

SEQ ID NO: 64966 - DNA, 2572 bp, Oryza sativa
tttattgtgaacaaagctgacaaatgtgtgtactatcgttatggtgggggagagggagtgatcttctgtctatatgtcgatgacatattgatctttgggaccagcctaaatgtgattgaggaggtcaaggactttctgtccaaaagctttgaaatgaaggatttgggagtggctgatgttacacttgtgcaatcccactatgtggacaaggttttgagtcgctttggctatagtgactgtaagccagctactactccttatgaccccaatgtgctattaaggaaaaaccgaagaatagcaaggcatcaattgagatactcccaaatcattggttcattgatgtacttggctagtgcaacgaggcctgacatctcatgtgatgtaagcaagctgagccggtttgtttcaaatccgagagatgatcactggcaagctctggaaagagtaatgcgctatctaaagggcactatgagctatggaattcactatactgggtacccaaaagtactggaagggtatagtggctcaaactggatatctgatgctgatgagataaaagccacaagtggatatgtgttcacacttggagttggcgctgtttcctggaagtcttgcaagcagactatcttaacgaggtcaacaatggaagcagaactcacagcactagatactacgacagttgaggccaagtggctttgtgaactcctgatggatttgccggtggttgaaaaaccagtgccagctatcctgatgaactgtgataatcaaattgtgattattaaagtgaacagttcgaaggacaacatgaagtcatctaggcatgtaaagagaagactgaaatctgttagaaagcagaaaaactccggagtgataacactggactatgtccagacagctaaaaatctggcagatcagtttaccaaggggctaccacgtaatgtgatagacagtgcatcgagggaaatgggcttgagacccacttagagatgcacaatagtggaaacctgtccattgtgatcggagatcccgtgaatttggatggtgaaacaaactactgtgtaaccgagagaagagacccttaaatgggctcattttcatgatgtacttctcttctattttgtatggtaggatggcttatgcctcaatgtgttctgagtggctttcattaagcagagatgttaacctgcagaacatcttagaaggaatacacctatatgagttcgactactagtcacagtctatgagatatgggtaatctctagatactcatgaaaggcctagagtatgacttataagctccaaaccgagggaatactaacggttgcctagtatcagttatggaattgagtgaaacctaactgcacaagactgacaattcaaggcatagtccattgttcagttgtggttaggtgcagctccttttctaggtggaagttcaacttaactatcacgcccggaaattcacaagtaatttccaaactaatttgtgcattaaatcatcgtccaggaatcagccgaggtacacaaactcacaatttaatatacagattcatcaaattaactaaaacgataaatacttacttaagaggcacttagtcctcaccatgaagaaaactgcagcgaaaaataaaatctagcgaagctccggctccactcccacaggcagctcaactggggtataagccaaacgtcttctcctttgcgacttttcttcaactgaggtttgattgattattgtaaggtgagcatatgacatactccgcaagccacacagcaagtatgcaagtgcacaaggataccaaagaatggcataatataggactcatttgcaaaagcagcatttagcaaagagttgagaatttgtaaaacaatagagtaattaatcatcaatattaatcaacactgaacagcatacccatgctgcataggcccaaccatcctaaacaaccatacccggctgtacagatctatctccaaaccaagaatgtaccattccaaaccaggagctaatcaaattattaccagttatagcatcatttattatggtgagaagtgtgagactaatcacgaaagacattgttagacccgcccataaccgcgggcacggctattcgaatagtttactctggccagaggtgtaccactgtacccacaagacacagccccacaatatgtcaccatgcgccgcaataccaccacggtacctcggaaaggagctgtgacagtacccctcgcataacacaatccaccacaacgcaccattccttgatcataatcacccccttataaacaaggcatggactccccagcgacccccgtgggcttatctccgccacttctcagtctggtgccccgcaatgaaccatgctatacaaaaggtaaaaccgttgcccatgcgggcatgtggttggcacggttaatgtttcacaaccgaaactcgtgaaccggtccttaattgtcatgagcatgaccatcaaaaccatgtgctcacaacccaccattatcaagttttagttggcaaattaattaattaaccaatcactattaaccaccgtgagctacaattaaatat

SEQ ID NO: 64967 - DNA, 8807 bp, Oryza sativa
aaccttcagggattttctatgttattggggtcttcgtagtaatagtcataagggtcctcctcttgacccagatctgaaaaagggtttataagagcaagggtgagtatttacaatacttagcaagttatcacgggaatatgttatgcattgacatataatagggttctttgcaaaaagcagtattagacaatctaaaaaagttatagcaggaatttataaaacatataaactttagatttctaaccagggtaccatatgattcccggtactcaactccatgagtacagctattcgaatagtttcaaagatattctactgcagcagatgtacgctttacccgcagtccacgacttgctgataatcattggctttagtcatggcccagtattaagtcattacaaattatggcacctgttccatgaacttatatcctcatatgctctgaacgtaatgttaatagcagcaagaggagttctggcgttcccgaggtatttaaggggaactgatcgtttgacaccacgtcatctcgatcagggtttagaaatataccatatagtttatactcgagtatcacaaaccattttacctgtacatggtaatggttaaagttgcccttcgcggctatagttgcctcctgcgcgaggacttaaaaataagaaccactatacagaggtgccatattgccaattaacctaataactaggtctgtccccattctagaaactgcggtcgtacccgttcgttcgacataagtacctggtaaaacttatatcgattgagacaatactagccacccggaaatcaaccaaatcttacatattgtcccaatctaagtatgaggtattttaaccatattgtaagcaaaaataagcaatactaaattatctgggtttctatgaatgatttatgcatagaaaaatagaatattgaatagaaggctataaataaataatttgtaaaatataggcttaaatgatcaacaggtatatggtaacttgccttgctcgatgtcttgagattgattgatattatctagggtgtcagaggaatcctcaagacctagggttagacatataaaattcaaattcaaaaggagtttaaataaaatccaaaaataagaaaaaatatagaaaataaaataaaaaacaaaaatagcaaaaaggggcccaatagatagaggatgattttagaagaatattggtccaagtttcattgaaattggatctatattttaaaagatatgggcttctaaagtttgaaaatcaaataaatgtgaaatggcactatgtacaggtcccacctgtcagtctctctctctcttctcttcttctacctccagccgatccccaaaagcgggctagccacgctagggtttgggattgcagtggcgctagagggagaaagtggttgcgaccgaggaggtgagggagctagggatctccggcgacggggagcggcggcggtggaattaatttgatgtgtggacggcctaatggctagggcggcggtgacacggttagactgagatggcgatcaaggtgataagagttagacatggctacgggaggggttctagagcatctacgaggtgtctagagggattccggcagctagccaacctttggcaaggcgcggagcatagttgccgacgagcgcctccataggcggcggccgtgctcacgtcggcagctcagagggtggcatgatagtgcaaagggattgctaaaatggaatctaggtagtatgtagatggttgaaacggaagaactcaccgagatcggttgaaacgacggattgcggccggaaaaacttcgcggcggcgaagaacagagcagcgcgggggcggctgtgctcggcttggtgcgacgaggtaaaactcgacgcagagcttcggttagggcttactatgctagaacatggtagaatataggtgttctaaaggatatttagggcggaggatggatggagaggggtggagtcgatcgcgcacaaggtgttcgaccgacggatgatggtggttgatgagatggattggtgaagcagagcttctgggttgtggggctatggttgttgatgatcgatgatggacagggaaggaattggggtcctatttatagggctaggaggagcggatgagctccggcaccgtcatcgccatggatgagctcgggatttggatgaggcaaaggtggcaggggctgagagagggcggataaaatcaaattgagtggcgggaggccacgtttgaatacttaccggccaagtattgacttgaccgcggttggaatcggctggcgacttgttggcgccaatccgggtgcgacgagggtgaaaacggctggctcgggggtgaatggtttgaattgtgagaggggataccaccatctatgtccaatccaactgtgcggcgagaattggcgcgattcacccagggtagaagcgaaatcgcactcggtggtggcttggacgggagcgcacggcgtcgagcagcgattccttgcggtagtcgtcgtcccggctttgtcgtcatcaagattggtgcggcggcggtgggctgagatcgtccaacgggcgacggcgcgccaaggcggtcgggcacacgtaagcggctccgaggccgacgcgcggcgacacggcgcgcagcaaagtcggctgccagagagcacgcgtgaaggggaggagaaggccaactaaaccacggtttttgagtggggtgtggtcccctaggatcaaatctaaactttgtgcaagattggatagagttgggctgctctagttgggctaggcattctgtcgagcaccttgggtgcaatgaacagtaaaattcaggaattttggatattttccctagaaagatttgaatttaaactatggttttgaaaagctttcactaaggtttgaagtatagcaaatctccactaatattaaggtaagttaagaaaataatctatggtttgaattttgagagaatttgctcaaattcactaaggtttggaataaagggaataattagagtaaattggtagggctctaatacttgaaccaatttttaaataaaaaacaaatagatttttgaaccaaacaactttaatcaaaagccagcatgatgcagtcaaattttagtttaaaatttaaggatgttacacaaaggaataagttcacaccacctgatgacattcaaaaataaatgcacaattgaaataaatagagaatttaaatataggatcaacatgctcaaaggaattgtgtttgggatctgtgtgacttaccttgcaataattggtcttcaataagtcttcttgaacacttccgacgcactcacgatccttcaaaacgacgaaaacgacaagctaacacgcaaaacgaggaaaaagactaataaaaaccaaataaatagtacatttaaagtaaacaaacatgtagatcataattttaaatgactttagagacttgaacggcctcattctgatttcatatgaattagttacgaattgtacaagatttaattccaattaaacctattaaagataagactattccaaattaattaaacaatttacaaatgatttataaccaagataaaagattaaaacaatctccggaaaagattagattatattggtagatgacatatgataaaaaggactaatatgccattgaaaagagagaacagatttatattgattttagatggctgagattaatcttgaccgagtcgaccaagatcgaatggcttggattgatctggcaagcgaacctcacgagataccgactcaacgagtcaattctacgtgacatgagatcacccaaatgatcaaccgaaaccggcgaacggaaccggcggctctgaactaaaggacgactcaacacggatgaacgaacgaagcacgaggaacacctcattcgaacgaacgagtgaatgactcaacaacggctgtggctaaaccggtgggctagacacgattcacggtaaagccccggtacgacaaacgataggccggtaggaacctagggttgcacctacggctagacaactcaactaccgagcaacgggctaaagcggcggctaggtttaagcggcacatagttgcgacacggcacaacagcagcaacacagcaatgactaggcaattagcggcggcacagcggcggctactcgatgacacaaacgagagattaaaacctaaaccaagggaacagagatagaagtctcaccgaaccaaacgattggagagggagagatgacgacggcgacccggcggcaacacacggagacgacgacgatgctagacaaacaacggattagattgaatttgatctagggtttaggtagacgtggcaatgataagacagccaagcgagatcatcggataacggacacaggaacgacgatcaccggcgaactacggagcgacgataaaagggaggacaccgggaaaaagagcgcaaggcgacggtccttaccaacacttacgcgacgacagacggcgacggaagatggccagtgacaagcttcgaagggcggcaaggtactgtccacggcggctggagcggcggccggaggtggagagagagggagctcgcggggagagcgattccggcgatggcggaagacgggacttgagaggataggtagaggacgactagggggtcatttatatagccatgggagcccgggatcgagtccacatcgacgggaaaaactctggaaagtttgggatcttcgccggaaaaaggaaagattgaaccgtgaaattggaaaggatttccatagaaacttttggggatttcttggggaaattgtagaggagattgagaggattccgttctcgcaactaatttggaaaaaggagcaacggggaggccagattcggaaggggatcggcacggctgcagcttgggacggctcgggctctgtccagatgttgaagacaacaatgtagcgagagggaggacaaacagacttctatgcgggctgagaggaagggagagagaagagaagggaatgggctgaaaagggcccaagcggaggaggaagattttattacttttccaaataaattaaccaatgagatgatctttcaattgttaaaaatatttccaatgctcaaatagttccaagaaaattcttgaacatacttggacactcaaagtatttaacaaaactgtaaccagctcatttaatgattaatttaatatgtgaataattactgaaatgttctttgtattattaaaattagtaattgagctccgaaaaatccgagaaaattccagagagtataattaatcatggagaatttaataaaaattaaatccaaccatgatttatatttaggagtttttacttcccacatttaacttcacttgtaaattaatgaacatttaatataaattctaatattaatttactaaataatttataaatcctgagacagaaattcaggctgtgacattaacagtcttgaccgaaacactggtatataaaagctgctatggaatagagagcattctcatgagccttaaaatttggtggggattgttagatttaattggttaattgatccatttaaatcaattaaattaaataaattccaaggctcattatgctaggaattcatgtgtattcattctctaatgggatatcaatgggacgaggagttttgagaattaatccatttgattagtgaattggtaacttatatcaattactcctaattgatggatggttgatggttgtatagtggaggatggttcatcactagttgatgataattagttgctctattcctctttctgttctattggtaacctacatcaattactcctaattgatggttggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccgacgagtgtgtgctcacgcgttgggagagtaggcctccgaaaccacgtactgctgtgacgtttgcacggacaggcgggcgattaggtttttggggagcgcaatgcgcgactactcactattcgtcaacgtctacttcgtcttcaccaatatgtcgaacactggagacaacggcaacactggagacaagtagaaggaggttcctgtcaacaacaatagaggcaatacttcctcaaactccagcggaggaccattcttggggtataaccttcttacattatttcaattagaagttttactactaatgttcatcgcagtgtcaacattgcgttattatgtgattgttgatgcttcttctacgttaagcatgctcatgttgattacattcaccactatcactggatcaaatcccattgtaaatatcatggtaattatcttgttattttggattaaaatatgccgaattatgaccaaatttccaataaaccaaaaacctaattggtcattttcggtagttggctttgctacaacactgaaaccacatgcttttgatggttctaattataagagatggaaagcacatgcactactgtgtttgacagcgatgcaatgcttctatgtttcacggggcaaacgaagtgaaccacctctctctcctgaggaggaggctaagttcgaggcttcggattgtctgttccgtagagcattgatcagtgtactcgctgacaatatagtggacgtgtacatgcacatgccttcaaggaaggacatgtgggatgcgcttgaggccaagttcgaagtttccgacaccggcagcgagctgtatgtcatggagcagttctatgactacaagatggtcgatgaccgttctgtagtggaataggctcatgagattcagatgctggcaaaggaacttgagaacaacaactgtgagttgccagacaagtttgtggcgggtggcattattgccaaattgccaccttcttggtcggactttgccacttctctaaaacacaagagacaagagttcagtgttaccgatctcgttagctctttgggtgttgaggagaaggcgagggcaaaggacaactggggcaaaaatatcgagggaggttctactgccaatttggtgcagaagaagaaccctcacgcttctcacaacaacaagaaagtcaagtctgatgtcaaacccaaggctacaaccaattttaagaagaaaggcaagggaaaggcaaagggagattgctttgtgtgtggtaagcctgggcattgagccaaggattgtcctgagcgcaaggaccagaagtctgccaacatggtcattagcgagggcggacgaatatcgtggtacggtaaatttttacctacagttctctctgtttttcattcacctgattggtgggtttatactggtgctaatattcatgtgtgtgctgatatttccctgttttcttcttatgaggtcgggagaggttcctccatgttgatgggaaacgggtcgcttgcggctgttcatagtgttggtacggttgatctaaagtttactttgggaaagaccgtgcagctgaagaatgtgcagcatgtcccttcaataacggctctctactgtgtagagatggttttagacttgtgtttgaatccaataaatgtgtcgtatctaaatatggaacttttattgggaaaggttatgacagcggaggcttgttccgcttttctttggatgacatgtgtaataataataatgttgtgaaccatattagcgagaatgatgagtccaatgtgtggcattcgcaactttgtcatgtgaatttcggttgtatgacgcgcttggctaacatgagtttaattccaaaattcactttggtcaaaggttccaagtgtcatacttgtgttcaatcgaaacaacctcgcaagcctcacaaggcatctgaggcgaggaatttggcacctctagaacttgctcattccgatctgtgcgaaatgaacggcgtgttgactaaagggggaaagaaatatttcatgacactgatagatgattgcactagattttgctatgtgtatctattgaaaacaaatgataaagcattgcattattttaagacctataaagctgaggtagaaaaccaacttgaaaggaaaatcaagcggttgaggtctgatggggtggagagtatttttccaatgagtttacatctttttgcgaagagtttggaattattcatgagatgacgcctccctattcaccccaatcaaatggggtagctgaaagaaaaaaccgcactctaactgagatggtgaatgccatgttagacactgcgggagtttccaaggaatggtggggtgaggcaattttgactgcttgtcatgtcctgaataaaattccaatgaagcataaggaagtatcaaaattcgaggaataggaaaggaagaaattaaatctctcatacctacgcacatggggctgtttggccaaggtaaatgtacctatagccaaaaagcgtaaacttggaccaaagactgttgattgtgtgttccttggttatgctatccacagcatgagttatagattcttaatagtaaactctggagtacccgacatgcgagttggtacaattactgagtccaaagatgtcacattctttgagagtgaatttcccatgaaaaatacacctagcacttctagtcaagaatttgttttaccccatgagcactttgcaccgatagaacacaatgatcaaacgccttaggaaaatcctgagaaggataacatta

SEQ ID NO: 64968 - DNA, 901 bp, Oryza sativa
tggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccgacgagtgtgtgcacacacgttgggagagtaggcctccgaaacgacgtactgctgtgacgtttgcacggacgggcgggcaattaggtttttggggagcgcaaggcgcgactactcactgttcgtcaacgtctacttcgtcttcaccaatatgtcgaacactggacacaacagcaacactggaaacaaggacaaggatgttcctgccaacaacaacggaggcaatactgcctcaaactccagcggaagaccattcttggggtataaccttcttacattatttcaattagaagttttacggttaatgttcatcgcaatgtcaacattgcgttattatgtgattgttgatgcttattctacgttaagcatgctcaagttgattacattcaccactatcactggatcaaatcccattgtaaatatcatgctgattatcttgttattttggattaaaatatgccgaattatgaccaaatttccaataaacagtagggttgttactacaaatcaaagtaaaagaaattcctgtggtactgactgaaagtaggaacatttttttgggtaccgagctatgtgctatcgtatggataaaaaattttccatcataggaagcagtgtcttacgtcacagatgtgagcatctcccctatcaggcacgctatggaaatctatcaacctggcaatcaagaggcaagaaatagct

SEQ ID NO: 64969 - DNA, 4247 bp, Oryza sativa
ggtattggtacatctatctccagtcaaacagttgcccatttctgtttgctttctcaagtagtagatcctaaattcgttggagccttggaggacggatgcccacactgagatttcagtcctggtccagatggtatactaaaaggaaaccgatcaacattataatgggtaaaagatcatttttctcctcatcagttcgaatttgcagatttagctgaactcgttggatgttggacagggcatggtgccagcaggtaggagaactattttgggggctcgttttattgtggaagattaaacgaaaaatactttacggcctgtttggttggagggagtttttaaggagggattgggagtttagagagatgaggctattaactgctttgtttggttgggatacatgagaattttggtggaatggggatggggaattgaggaagaaactccctctttttagtacctgggtagtaggtggtaattaggagggaattcctcctttaatttgcctaaacaattctcagccatccgttttcgttaatgacttaatcttcaactaaactccctatcaatttccaccacctctaccaaacaagatactgggattaaaaatcaaattctcaccttaatctcaccgtcaattccctcgtgtaaactctcaaccccttccctcgagttgccaaacaagccgtacatacggttacggcttcgggtgcggtaatcagtaggtaaagaaatagggctaggtatttgtttttttgtcactaccacacaatcgatttttccagatgagaccccctctatgttacaggtggaccataactactcccacatgtgaaaatcccttccgcgagggcggttcaagaatcgcatgcgataataaacatatttcttaggcccgcgtgcaattttttcacccaactctatttttcccatctctctccgtctccatcataccctttcctctcttttgtctgagtctctttctcctcccatttcctctcattcctcataccacctctcctcaccctcacacatgacaggagaggccccctgcgggtgacgatgacaggggagactaccggcctcgagcaaatccgccaatgccagcctccctctccctcatagatccggttgcgatgttaggagaggtgcggatccgtcgtcgccagcctcaccctcctcatggattcagtagcagcagcacggggacgcgccgatatagtgacaacaacaatgacgacgatgggatgcgcagtcctccctcgcagatctggtgatgacaacaatgatagcaagccatcgggcggcggatctggtgagcccggccctaggagggatggatccgcctacgtcggcctctggtgcagccgggtctcgacgacgatggtggcggcggctaggacggatttgggttagggtttcgactttttgttttatttttttcactaaaattttgtttgcaagtgatcggcataggtgactgtatgcgaaaatcctatttttgcttgctgttgcgctgccagcatagaaagatgttgattttcgcatatacctaggtgcatgcgggccacccagccgacaacaaaaacctgttttagccatttgcaaaaattattttttactagcgtgttgggctagaattagctgcccgtttaagtgtacagtgatgatgatgtgtagataactttatcgtgacgttttaaattattatatttattgaactcgaagtatatgaagcaactagttaagtgtttgttggtatcaacatttgttgagcattgtaacacactcaaaaattaattttagaaaaaaaaacatgttaaaagttttatatttaaatgaacgtttggctttctatcatgtgttgtaaggcttcctttcattttttttgtttggtgtatgagaaaatattgaattaagcctaaaggagccaaaagccgctacagaaaaatgcagtaataatgatgatttcgccagtgtttggggtggggaattcctcaccaaaggcggaacaccaacagatgatctcctggaaaggaaaaatgttgtcttgctccatctctagcaggtccttctccgcattagacatgtcggggatttctctctcctctgtcagttggaaaggaaaggggaagctccgatctaggttttttgggtgaagattgacgtgggagctaaaggagtatggaatgaggtgctgcgccgcgcgatttgtgtgaggtttcggaggtggaggcaaaccctatgattttggtttcagcaactgaatgcaggcggtgaacaagagtgcggaaggggaaattttcggagagaagatgaagcggtggagaaaacggagatttatacacgtgtcaaggtttcggctgttgtactggaccaaggcttggtgcgtttgcatcacattcaatgaacaggtgcggtagagctgcatccttattgggccttggtggttattgcttcggcgatacatgtgcagtatgagcttgataccttaaagaattccttattccctgcaaagtggttttctatcaaggtcaatgcaatgtgatttttgagggaccaaaatcctttttctataaagttcggtgctgattgatgatatttcttttatataagcgatagttgccgactgctacgcgtattttatgcacggttggcctagcgctacatgatttttttctgttaattaagtcgtagttgactttgaactatgcacggttggcctagtgttatgcgtgtcaaattattaataggagaatggtatatcactcgagcaatagcactcagtgattggcaccacatatgctttaatgcaatatgaaaccactcgaatggttatctctttaggattttttactatatgtttagttgagtttcaactaatcatatagtcggagctatacctattaggtgcatctatttagagctagtatgggtaactatgctttaaaagaatctagggagatactttaaaattaagggcctgtttagttcgcgaaataaaaacttttgggtgtcacatcggatgtttgaccggatatcgaaaggggttttccgacacgaatgataaaactaatttcataactcgcctggaaaccgcgagacgaatcttttgagtctaattaatccgacattagcacatgtaagttactatagcacctatagctaatcatggactaattaatctcaaagattcatctcgtgatttcctccctaacttgcaattagtttttcttttaatctatatttaataatctatgcatgtatccaaagatttaatatgatgtttttggaaaaaaacttttaggaactaaacggtcgtaataacctacgttggacaggggcttggaaggcatcaggagcattcgatatgccaagtctttattatgcgcggaagggcgagactcaacgctgtcatggggcagcgagctcagagtgctcatgagagcaagtttaatactatagccaattattagctctaaattatctatagctaatataatagccaattcatacaatagtttcttactatactattaatatctggtcctacctgtcactggtggagaagtgctttttagtcccggttcgtaacccccctatagtcccggttttcaaaccgggactaccaatccgggactaaagatcgctatctttagtcccgggtgaaaaaaccgggactaaagatcgatctttagtcccggttgatgacagcggcagtctatcagctagtccttttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaaaatcgactcactggccggcctcccatcccgccgtcggccggccacccatctcgccgcttcccctccggccggatctgggggaggggagggcgaggccgccggcgaccggcctccatcccgccggcccgcgccgggccgccgccggccgtcctccatcccgccgcttcccctttggccggatctggaggaggggaggacgaggctgccggcgaccg

SEQ ID NO: 64970 - DNA, 14656 bp, Oryza sativa
ttgtcccggttctaaatcagtcaggcctagtcaggccccccgatatctttagtcccggttgataacaccaaccgggactaaagatcctatctttagtcccggttggtgttatcaaccgggactaaagatatcggggggcctgacaaggcctgacagatttagaaccgggactaaagatcatttttagtcccggttggtaacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgtgtcataaacacattacgtcttggagtccgtgctgtagctggctacaaatttgcagcccgctgcttttctctatctccttttatctctttaaaatatgtttatagctggcttatagcctgctattgtacctgctctgagggattaacttatatgtacacggatcatgctaatatcttataagagcaggtacaatagtagactataagtcaactataaacatattctaaagagataaagaaagagagagaaaagcagcgggctatgaatctgtagccagctgcagcgtggactccaagacgtaatgtgtatatgacaggtgggactaaatattaatattatagtaaacaactattatatgaattggctattacattggctacagatgatttgaagctagtatttggctatactattaaacttgctctaaatcaggttgcagttgagtactgaaggttttttttttaatagacctgtgtgctgaaatggaccgatcgaaaatcagctataaatcttcttaatttcggcccataagaaaaaggaaatgcattgtgcttgaggttttttcctttcatgttctgaaaagtaacatatggatggcaatattcatgaagcgcagtgtgcagttatatatgtttactttaacataaatttatgccaataaatactcccttccgttacataattcttaatgttttctatattataataatatactccctctatctatttttgatagtcatatttccaattctgaaaaataaaacaacctatcatcttaatgattttctcggatttaatgcgtgactctctattcttccacacatgattgattacatgggcattgagaaatataaatattaataaatcgcttgcttatgagaaatggctagtagcatatttaaatggatgataaattgataagtagaattacttatcattggtctgtgtgccaagatgaaatatgactatcaaaaatagattgagggagtagaataaaacaatagatttttactatttcattactttataagataaatattatattatttatatagagatgtactatactacaccaattgggtgcgttataacgaaaacgcccacgtcataggtaacccccacccctaccgcaccccagccttaagctacagtcagatatataagtttgatctcaaccttattaaaacatcgagaattataaaaccgaaggaagcgtcgtaccgtgcatgtaataaagcaaggagacaacaatacgtgctggctgttctacaaaaccgtgtgctccgtctcatcattgtacatagctacatgcttagtgcgcatagttaggttatacgtcctccatctatctggggttggaaggcagcaggaatggtcgatgcattaagcaaacatatgttcctgtgcaaatccgttgttgagcatgagggccgaggcatgaaagctcaatggcacgaacacgaccgccatggatgcctccaccctttgcaccacagacagccaccacaagcacataccggcacccagtagtctgacgcacccatggcagctgcatttgcccaggagagttcacatgcagttgtgtaccgagcctcaaattccaaggtacggccctgtacccgatgtgccaccctgcagcacgcgagcatgccagcagtcggctccgcttcttccaaaagagagtgcacggcttgttatcatttcgttgaggttgttgacttttgaacattgctgatagaatgcagatatatatgttgcatgctcccgtcgattcggagcactaagtacatttattcgttgcgatgttagacatatcaaactattagaggtataccacgagaaccttcggccgggcctaccgaaacgaaggacataagcaaaggcatgagccggaggcaagcagcgacggtcgaagggagaacataagcgaaagccgtggtatcgagctgacaagcttcgccaaagatggactctgccggagggtcgtacggttgaagtccgcgaggcgaaagcccacgaagggcatgggtttcgccaagtatcgaaccttgccaggagaaggcccagcgggccgacacgccttccagaggcttcgccaaggactgggccgagtcacttggcccattaggagcccatacgagcaaaagacattgtatgcccataaagatattcctatcataagggcaaccatgtaaattcccctgtaaagcctaagccctaaaaggagagtctgtaatagggctataagtagtcccctagggccatgtaacaaggggatctgaaaaatttctactccctccgtcccaaaataagtgcagttttgcactatttatgttcaacgtttgaccgtccgtcttatttgaaaattttttatgattattatttttattgctattagatgataaaacataaatagtactgtatgtgtgactaaatgtttttaattttttcacaaattttcaaataagacggacggtcaaacgttgaacgtgaatagtgcaaaactgcacttattttgggacggaggtagtactaagcaaattgtctttacttccaaccactgttaaaagaaccacgtccttcgacgtgacacagttgtctattcgacaatacaaactaacaacactattgcaaattttatgaaaaagcccttgagacccagagacaaggctgaatccgcagcatcatagtttggttgtgtggtggttttttcactgaaagactagatgttctttatggatccataaataaaagaacggtaaaatttgctataggatacttaaaaacgtgtaattaaccgtgggacaccgtaaagatgtgaattagttataagacaccataaaagagcagtaattagctactagacactggaggcattattttattatttttccggcattgtggccgtgtgcgtgccgctgctgctgctatgcatgcttgtctctgcggtcggcgtcgtcagggcctttgctgcccaggctatcaacgccttgccaatgttcgcgtacaagccctctagcgcggtggagaaggatggcgttggcggcgccgcattgtacacggtgtaccatgtcgggaggaagaggacaagaaaatagaggagaggctgacatccttgacctacataatcaatcctccaaatcctggccaatagtttactgacatgtggtctgtggacccaatgagtttaaaagctcttcttggcccacaaatttctttctctctccatgttattcggaaataataaaataatatatccggtgtctattagctaattaccactcttttgcggcatcctatagccaattcatgtaggtgtcccacagctaatagcatgtttttttagcgtcttattgcaatttttgccatggagaagttatgagaaattagtggttataggtgaagttatgcttacaagtctttaacacttgggtttaaaccatggtaccttcaaatgttgtgcatcaggaagttatgagaagttagtggttgtaggtgaagtcatcaggaagtttggaatttaatgaggtttgagatttgttactttttcaaacaaagttaaaaacaattgttttgtaatcatttttaaatattatttcataatgaactatttcaaaactcaattctcagcctgttgtatataggacaatagtcacccgagaagaaaaaagcgagatcctacggttgccacggcagctgctttttctactttctagctgcaccgctgtcaaaacacatatgcaaaaccaggtaatgtgacacttttgtccattcgcgattcccctgccttcgttgttgctctccctaagccaccaaccaccatcaacccttccccgccctctctctaaaccgatgaaatcctcaagtctctatggaggatatgggtatacccacacggcgtgcatatccgaacgggtagtaggtaggctgaatccatataatatgtaatagagtaggacacggttatcatgatgtcttatattcaaagacagggcatcgagtcctggctagatgctaccatgtataaaattaggaaactgaggtcgtgcctagctaggttttcctcattgtaaccctatccgccaacctatataaggtgggcaacacgtctctcgaggacaacaaccacaacaaaatccacaaatcattacacttgatgaattcaatccaccaaacatgagtatggtattatctctcattgagagtgtctaaacctatctaaacatttgtctccacgcatcgatccggtttttggatctcggacgtagccacataaatttagtgccaatcgataacattgatagtctcccaccccctcccacgccaacaccaacttcgaaatctatctggtcgaggatgtcgcctccatcatctgatcagttcctcgatgtcaccggagatggaagaaaaagttatcgatcacaatgcatattagagaggaagaaatttgtgacacattgcccctaattttcatgcgaatatagtttaccatttctgtagtgacaatggccattttgtcaaaaatcatatttgtctcggttcgaataggaaccgggactaaagaatatctttaccctctggttcaaaagcccaacagtgtccaaagatcacatttgtgtaattattttttattttaagtatatttaatgctccatacatatgtccaaagattcgatataacgtttttggaaaaacaaattaggaactaaacaaggccatactttctgcactcatctatgctctctctcctcccttggcaagagtgccaaattcacggtaaagcgagagacagaggagatcagaaagagcaaagcccatcggaggaggtctaggcaccggaggcagaaggagtgacctggacaacagggacaaggagtgacctggacaacagggacagcccgaacttgagggactcgacaaggttggactccgacgcggcgcctagcaacctcgatttagaggcaagctgtgttggggaataaccctgtactcagggtgttgtataaactaatgtataaaaggactaaaatacccccaagagtatgttgtacatatatagcaaatcaagggcaaagatgtaatttcctgtacatatgaataaaatgagtcctccaagggcaagagagggggatctcccaccctcccaatccattccattcttagccatccaaaactccatcatcttcctctcatcctctctccagaagaattcaagcttgggttctctcctatggaggagggggcccttgtcatgcacgttgggttttgttccaacgagcgggatgtcaggccagttggtggagaccgatagacgacagggccgacacaacctcagacgttggaagcgaggaccagcagggaggccggctaatggagacgcgtggtgagaagctggaggcggcgctgaggttggcggagtagaagtcggcggggacacaaatcgaggcaatcggacggggacgcggccaaatgacggcggtggtgctggaagctgcggagtcagcgccaacagcctgatagtgacccaccccatgcacggaggttggggatgagcatagggcaccagcaatttgaggcttggaggtgatgcagtcggcccaccatgtcgacctgctctggtggggatctggaggtgaagtggcggcctccgtcctaatggttggaggaggccggccgatccacgcagagtggcggcggaggctttgtggcgtggaccccggtggcggctccaacgaggtcacaaaggacattgatgaggttgagtagaggggaatagagacgcaacgacggtagatcgaagcgggtgaagaggcggcgacgataggtctcaccggcacggatccgggaggccgttcccggcggcgagcaggagccccgcgaggtccatgacgaggaagatgatcaccagatcagttaatcgcgaagatgcatgctacagctgcttgactgattgatatgacaacgaagaaaaatgccttcggagatgacgacaacaagaacaaaacggtgaccgcatccaggaaatcgctactaccagggtcgatgatgcataagcatgacaccccggccctaaatcgtcagctctggtactatgttgaattgtagagcaggaagagaatactgcgtaactagataatagtattgagccccagagactgctatatatggagattccatgggtagagacaaagaaggtactagagataatgaaagactctaattaaatcaattatatcctaatattcctagctacaactaccatatatactcgaagtctctgtgtcgactatttcttctatccatcatgggcaatcatgttatgcaaagctctttgctctgtttttcctccttatgggatgtcttctgaattgtggttggaaagtagatttttgtcctttgaggggatatcccctcgttttatgcatggcattcaaaaagttatcaaaaaaattaaaaaactttgtcaagatagataaatatatgatatatcttttcacaaacatgagttaaacttcgacttacacaattcgaaacaaaaataacaaatttggctgtgaattacacgttctattcatagtcaaatttgttatttttgtttctacttgtataagttaaatttgaatttgcttgtttgtgaagtgacatatcacatattgatttatcctgctgtttttttcaaattttttgataacttttatgtgacatgaaaaatgaggacatatctcctgaagggatgatttgaattttcctgctggcatcgtagcagtaaatggctgtgaattctaaacatcaaaggttgcacagttcagtgtgagatccaaaaggtggattcagacttctcctgcatgggtataattgttgatataggagattaagtggtactcattagtgcattatgttaagtttatcttacaatcaacatggcagtacacgtgcaattaatatatatattagatcatcattcatgtctttgtctttgggcctgtttgaggagcttcagattctgacaaatagctgattgatagctagaaaatctggaaaactaggttttccaatattttatggattctataactgcagcttctcagaatctggacaaaaagctatactatttagggagcttctgattctaagagaaactgtagcaactagaagttccccaatcaggccctttgtttcaatggatgattgaattcacaagtttccaatatcaccttggaccgtattagttattgtgctgtaattcgtttgatttttttccccagcagaaagctcttttggtttattttaactccgactgaataacaagctctacccaccaggaaggcaaccaactaaattgaactggaataattaattagacttcgtgactttcactcgttgtcaggctccatgcttctcctctatataagtgtccaatccattcggtcccaaattatctttgcccagtctcccaccacttggcttgaaaaaacgaatcgtgtaaatgtaatcgaaagtgaactgcttcgagtaggaatgatcggcatcaggtattagtgcatctcactaaccagaaagaaacgctcaagatattttgctttctcaagtcactcccaaaaaactcgtggaaattaagcaccagcgatagaattactaaggtccacactgaaatgggaaacagatttgatgataatagtgtccatatatgttttatttcagtttagtttgttttcctcagcagtaggtaatggcagattttagctgcacgtacacacttcatctgctaatggccagcccgtacaactgtttgggcctcattttattgggcaagattgcgctagagtgattacttttttttttaaaaaaaagattacagtacacaagagaggtatactctctgccctttcaataatcagtggctttggcacttattacagtcaaggtcctgtgttagtgccttgtcgtcttaaaataatcactattaaaaaaaaactttcataaggaccagccatataggtgccagtttgacagaaaccgacacctataagccgtttctcacccaccatttctataaccggcagctataatgtttaataggtcccggttctttgagagaggcaccgaaggccctcccgccgatggtctaaaaaagtataggtgacggccgttcgtaaaaaacgggcacctattatcttaatgacgtgtgttccggcccgagacaataggtactggtttatagtaataagtgcgaaccggtattaccttgcgatgtgactcgcgtatggttataggtgccgagttttcatataatttcttcatacaaaatcatatgagtataaactttataccaaatgagctagacaagatctataaaaaaactttttgaattaaggtcgtttggacgtttaaaaatgtgttataatgtgctataccacacttgactatgtacatatgattagatgtacagatcgggtttattccattttccgaaaaggtaaaataaaagcaccacatttacaccctacatgttacatgttactatagatatgtagtcattccttattccttcgagataacttctttcctctttctcaatctccggttcgcgaggcagaagcaacgtgactagaaattcatcaacgcaataggaatgagtggtatttggaataaatcgcttagcaagattgtctcggggtggctcgtgctatcaaaacagtgttcattgttttcacataacgtcgaagtggttgggacttgggtgtccactaggcggtagcaataggggaatgaatgttgtgccatgtgtaaaatccggacgaatattaaaataaattcaaatatatttggtcatacttccagaataacaaaagaaaaagaaagacagcgttcaaccgaatagtcaattggaattaatcccgatttgatttaacagtgttatcacattttgatttttttttattcacagcttttggtaggattgaaagtgattcggatagtttctgtccgaccggacattttttcggattcggatagtttcggtcggatacatccagaaattttcgaattcgtatttttttcggaaatgaaaacgaatatgatattggtgatatccttcggaatcggataatggtcggatactatttgatattttccatcagatatccggtattcttataaaaaatatgtttttcttttctctacttaggtggaacaaaacaaaccatataaaaagatacaagagcaattaacatacaaacaaatggaaaaattcaattctgaaaaataaccactcaaattttcaaaaactttcaattcaattcttaaaattttaaaaacttttaattcaaaaattgaaaagtttcggttcgaattcaaaacactcaactcagatttgaaaaattcaactcaaattctagaacgtttaattcaatttcaaaattctcaactccaattgaaatgttcaaccaaaaatttaaaatattaaaccaattttcaaaaatttcaatgtgcctacgaaaatttcagtgatacacattaatttatttgtttcatgataacataaatttgtatggaaagtaagcacactattttctatctcccccttgcccttacaaatagagataaaatttgaaaatgttgatgttttgtttttgaaaactaatggctacatctcttccttgatttaagaagcttactttgaggagtcttgatatttcgataatcattcgttgccgtatttgtttctattcatattctctccgtatctgtattcgataatattcgattctattttcgtatccgggtttccgactccgatttcgattcggagaaaaaaaatatgaaaatgaatatgatagagcttgtttctgaccatattcgatccgttttcatccctagcttttggtgtgctctgttagaaggcgtaataaacgaccattcttttggatatcctgttctcatacgttaacgagattatgccttatgtgtacatagttgcccacactagtacacaacgggtttttctagacagcccagcccgaaacctattttcgcgtgcataagcctgcccctacatatctgccctaaatagtgtgcgaaaatctgattttacatacgggtagcgcatccgcacgcgaaaatctggttttcatgtccaggtgcttatgtcgtccacacggaaaaaaaatccaaaacaaaaataaaaattcaaaaaaaaatcaaaatctagggatcccgtcagcggcggcatggatctggatggctcgtgtgtgcagcggcggcagcaacggcgggatagggtcgtcatggggccgatggctgctcccagccacctcctcctcgttgtagtcggcggcggtggcagcggcgcagatccggccatcgcggggctggtggtgccgctctcggccgcctcctcctccttgtcgtcgacggtggtgccgggtggggacggggatggcaccgctcccgaactgcccaccgcccgctcccggacgctacccgaagtcacgccgtcacccgtcgagccgacacccgctcactgtcagccgctgcccgatgtcgcgccgccggtcgttggccaccgcctgatgcgccaagccgacgcccgcccgcccgctctcggccgccgcgcagccgtctgccctctcctggccaccgtctgctcacggccacctcccgcgccccacgcacagcgcgttcagtggaggagagaggagacatgaggaagagagagatgattgaaaataaaagggaaaaaaagagagaggagtgataataaaagggaaagggagagagaggaggtttaaaaatttggagtgagagggaaaagagaacgaggaggggagaaaaaaaatgtgaaggagagtgaatatttttgcatgcggtacacttaagagaccctatctgtgaaaataggctcattttgatgtgcgggtccttaagaggcctgcatgcgaaaatagaattttgcgtgtgtgccacttaaggagctgcatgcgaaaatgaagtacgtgaccaattacggtctggtttgcaatctaaagtggtgcttgtaacgaaaatttgtttttgtagtactgccgccctagtcatcccttacaaccttaagttgaactggttctgtttcaattgaatagaagagctgatagcttgtttcttcttactgcctgggtgagctgatgtgttccctctttcctgttggctgaggtcctttgagatatgataatggaggggaaactatagcacccaaatttggtttagtcgatacaggcccataatttatcgggtggccgcattgacttacggtagggccattgctattggcagcctgcaaaacaataaaggtcatgaagttttgatttcatgaagtttgaagaaattttggaagtgagaatatataaggactattacctcggtatcagagtcaacattgtccaggtcaggcgtagagtagtaattggtagggatgaggggggaggggggcaagcaggttttttttaacccacttatctcacttctagtttattttttcttttaaattttgtactaccatatgagaagtgaactagtaagcaggtttttatacgggtagcaggactatccacttgcatccctattccctagtaattggtagtggccaagctgaaaatatgggatttccactcagtccaccattggctgaaaagtctcgagcttgatgtgcacggttcaagttataagaattcgtccattgaaggtccttcgattgacgatattcaatcaaattccaggcagcccaggcccaaggccgtgcacgcccccgtatataagcgggggagatgtctccccccagtcgtcgctctcgcctcttgctcaaccctaaccctagccgccacatgccacaggccacagtccacagccatcggccaccgcctagcggcccaccgacccacctccgccgctaccccacccaccagtcctcctccaccgtccaccactcaggcgctcaccgattcgcctcccttcctcttcgtctctgatcgatgccttgcctgacgagggcgacggacggcgtcctgctaggggcatgagggccaccagtgaatccgtcaactctttgtctctggctgccagatcgagggccgcgcgcgccatctctttcccttttgttcttcttcgtcagatccacccccaagtccccaatatccctcttgagtattgtcttcttgtagatccatgagcttattgtcttcaacggcaactccggtgctccggcttattatatttgatgaagtaattgtgaatttgatgaagtgttgatgtatttgatgaagtgaatgtgaatttgatgaagtgattgtgaatttgatgaagtaaatgagagtctcatgagtttgatgtgctatgtacaatattttgtcaaactgagttgttgaagggtctatgccaagtcgtgtttggaccggcatgggcacgatgggctggccgtgccttagggctggtatggcacggcccgggactatttgggctgtgcctaggccgtgcatgtagcctatgggctggaacagcacggcccggcttgtttgttgggctatgccggcccgactgaccacggcccaggccgaacaagccccaacgatacatccgccaccgctctatcctacacatattctaactccaaatccaatacaaaattgaatacacaattttgtacctagcagtactagtatatttgacacattctaatatgagcaatgctacacgtactgaatttttcttactaaacttttactaataatcatctcaaccgtttgatttaagtaaatgaaagttataaaaaaatctagatgcactcatagcatgacacatcagtgttaataagaatataataagaaaaagttactccctccatctacttttgatagtcatatttccaaatctaaaaaatttatttttgataggtatatttcaatccaactacttatcatcttaatgactttctcggatttaatgcgtgactctccgttcttccacacaagattggctacatggacatcgagaaatgtaaatattaatgaatcgcttgtttaaatagatgataagtagaattacttattcttggtctatgtgctaagatgaaatataactattaaaagtagatagagcgagcagtacgtatagccttttccttctaacacatgtagcatccaataaaaagggagctattttaatgtgaattaatgttgataaatagtgcactatgcatgtaaagtagagagacgatgaataaatgcatgctcgctgctctacaaaattgtgtcatccgcctcatcactacacataaccacacgcgtagtggcgcatggttgggatctatgtcctctgtctatctggggttggaaagcaccgggaatcattgatgcacgatgaagtgagatccatccgagcaaatcttttgctaagcaagaatgccgacgccaggaatctcacgggcagggtgacaatggccatgcacgtctccaccctctgctctgacagacatccacggcgagcaactgccggtgcccagtagtaggacgcagggccggccctggggcagtgcggacggtgcgaccgtactggaccttcaaaaattaggggcctccaaaatatgtatactatagtattaggtctgatgggcttagagaaaagacagaagaccaatcgacgatcgagtatatcgtgactgcttgattgtattttaaacttattattgtgaaatttgttaataacaatgagtttttaaatattatcttattttttacggtgaatgggggctttcagtttttttccgagtcagggccggccctggtaggacgcaaaggaagggtagacagagtcgctgccataccagatgtgttaggcagctcgtgagccacgcctcgttgctgcttcttccaaacgagctagtgcacatctcattgagggttctgaagattgaaggcagcaggcagctatcaaacactaacaaaaatattggaaattttatattagttatttgaaaaactgagacccggaggaaagggtgaaaccacaatatcataggaaagtatgtgaggttgatagcgatggtaaaaggagaacataaaagtttagttgtacggtggtctttttttttttttttacacagaaagactaggtattcttaatcgattcagtcatccagtgaaaggaaaaacatgttcgagtaatgtaaacatttcctaatatgaatcatatatttctgtttgttcttcagtttctcttccgactaaaatttgtattttaattattccttgatatatttctctttcgaaacgaaagactatgaaaca

SEQ ID NO: 64971 - DNA, 8445 bp, Oryza sativa
tgctcttaatcccctaaccaagccaaaacaaccacaccaccgagcgcttcctgcagaatctcctaggacaagtaaggttgcagttctttcctgctgcagggaagagagggagggggaagagaatagatagatgagagatggagtcctcttctcctgctgctattgttgttcttgtgctgttgcagtagaaggaggtgggaagcaatctgacaacaagaaggaaggaagaagaaatccatggctttaaattgtttgtttgattcagaatggttgcaccaagaaagtgggaaatctgggtgttgtgctgaactgatcttagtttgtgaacttactgtagtaaatcgttgagtaatcctctgtttattttgtggtttcttcggtgctgtgagtgtaaaaaacttcactgcagcatacgaaagaatgctatgcagaaacaaatgttcattttttcctattccttgtcttgctaaattataaagtatatgcacaatcggtaccaaaggtgctaacgtcagtcaacaaggtgttgtattgtcttcgcaggtccacagtgaccatggattgaggcaggtaatatacgaatgtaaataatgaatcattaccaagtattacgcctgtttgttttgaatttgaaatctgaatgtggtgagacccggagatgagacgtgtcctgctggaattatgttatttcattggtgcatcaagcattcatactgttgcattctatgtcatgagcatttcatccttgtatcatgcaagtgttttctatttcggtctggaggattaataggtaaggtgcccaggctccagtacgtgcagcaatacaatttgtacatcatatcataacttgcttgaaggttgggacatcaccagactttcactgctacaacaaatccacagttccacacagatatgctacatcacacatcgaagaaaacacttcccatgttagctactcatagtcagaatgagaatgggtatcaagtttcaaagagaggtgaatgctcataaatcccttcttttataaggttatgacctactaactacaatcaagaccctaaatctcaaaccttaatgttccacatcatcataaattcttagccattggatcattggattagatcacttctcagacattggatgaacaaaatgcagcagccaccacatgaggcccatctagtaattttgatcctagcccaattcagcagagaaggatttaaggtttcttcttggatcggtggggtttcctcctagagtcggagtggggtctcctccctagcatgccccacacgcgtggcgcggcacggcaatagcttggtgaaaacaacaacactcagtaccttattaccaacaggcggtagccatgcttgtcgatgctgagcttcggacaccaccacctccatagaccctttcctccttaatttgcggtgctcatgtgtgtttcttttgtttaaactgtttgattttatcattggtttgttgaaagttaggtgttccatatgctgccggatgattcaattttctggtatgtttgttcgatggaaatattttcagatttgcatgtcatatgtttggcacaatacctgaacgaggatcatactacgttagtatcttctcactgcaagtttatgatttttatattgtggtttcttaacctaattgcaccatgtgcacactaccatctcactatatcaaacaatttgtgtcatctaatcctaacatatttgattctagaaggtcacccatggtcaattaatggtagaccagttgtttgcagtttgcattgtgtatgggtggtttagcttcagcacaattgtctttttaaacatttctggacagatattgaatggttgaggcagctcaccgccctgaacagtagttctcttttatttcatacaactgcagatcctatttaagtgtaagaattaccatcataattttattttcctgctattattcacaacttacaacatggatttaacatgaaaagaaagctagctaccaaagttacgcccttgcagatagcacgacgagaaggatatgttttttttaaagatttaaaggtaaccgtatgatccatccatgaatatttggaagaagagatgcatgtgcttccaatagctacatatttgacgagaacagagtgtgcagtaatgcatactgttggacaaaatatagctgaagctcatacaagtctgatatgttgtattacaaaatattctttgaccttctatggatcacattttaattcacagtttgttgtctttgcttactttgaagccgataccaaaatatcttattgaagcacacagattccagccttgcatatatataaagttattttagtgtacccgctgcaacatgcagggaatcaaccagtactcttgtgtacatacgcatgcaaagaaaatagaccatggatgcatatgctctctgttccgtaagttggtgtgcacgatctcctcccccaacaatatatacacgttgtagctagtgcgcatggtaggcactaacatatatagttgttgacaaaatgacaagttaacttgccagctgaactcaaccctgtgacatctgtcaatctaggcttgggaggcaccaggaagtgtcgatgtgagaacagacgttgaaacatgtcatgtccattcacatccgttatcaggcatacacggcggtgtgcagccgccaccgggcaccctgcctccggcgactcttccacggcttgagacgatgagaagccgtggcgagcggcgacactttggagatggacagcagctaagcgtagggtgaacagtccgttgtcaagtactatcatatttgcctgaccacacgaatgctaactataatatactagttaagtgcccgtgcgttgcaagggaaaaaaataatacatcaatttcaaattattgaataaaattgtgctgaatagttattgagtgtttcttaataaaaagtagtaatgcaataaaatcctaattcagtccggggatatacgtatttagctgtatttacactcatgacatcaaatcaagtaactaattgcaacaagtatatacagatggcattatgtatttcataacatggcaagtgaatgcaagagaagtaattttgcgagtataggggacaaaaccaaacaatacagcataggacaacacgtccgcaattcaaacccagagcaatactataatgttcgcactgccaggacatcatagcttcaacgattgattgagaacacgcacaagtatcttttgtcatgaggcacatattctctatgcctgcaatatattcaatataaaaatctaatgaaccacaacacataaagcatcaatatgtcctccagaatcacacaccacaggtgcaccacaagctagcttgtttggtcatattcatagcaggtgatattccaatgggagaggaatggaggaaggttaacttgctggagatcagagagtgacttagtttggtttgcctggataagaggaaaataggtcagtccttatttgccagtatatagtaatagttatatatgtatgttataccattcccgtataactattttctctatacgataatactatgtgttttcttctaatatactggagcataacatgtaatttgtgcaaagatgaaaacatcagccacagtaaaatctttaaaaaagaagggaaaatagttgcataaaagagaagctttgaaatctggatcaagaaatgacattgacccatgaactatttctcaaaaggacaaatccgcattcttaaaagtattatttcttaattttctccacaagttcttcaacaacaaagacatttcatgggtcaattacagaaaatacagacctaaaaacaaaggataaagcctcttctttataagagagaagagggggaactttttggtggatattttagaacagtcgctatggttcaaggaaatagctaatcctcaagtgggtaatggacaatcaattctatgcttggatgatacataagccaaaaaaattgaattgaattgcatatgtgcacagaggtagccgttcagggctcctggacccactaaattgatactttgctgaaaaaagggaacaaatcaatccaaaagtcagctctaaacaaatgacattgatctgttgatgtagcataagcagtgcaattaaaagctatggaatatgagtacacagatggaaggtttcgtacagaaaaccccaatttctgatagcctaaccagaaccaattcagggagccttataaagctttctacaaaatgcaggccacacaggaaatgctatctacttacatcaaaaggaatctagttttgttcttctgaaaacagatttgtaggcactcctatttgtaagttaaatatttctttaacttactgttaaaaaaaacatgttcagcatccttgagtctagcttgcatatatctatatcaacactggctacttcaatcccatgtaaacatatgaatatgacaggcaacatgataaagtttaagagaaaaatatagagcaaaaggtatgtagttgcatcctcaatcccatataaatgtttaaaagcttgacagcctaatgtaagattttttttggttttccaccgctggttgtacgattttgggtagcaatcgattgggtgggctggacagctgcagccaaaaatgccgcaacaatcagaactgatcagcctcaatatgttgttttttagataatggaagctttatttagactcatttaattacatcaagatgatagaatcaaactgagtcacccccggcctctgcataaaatgcacatagccaaaaaagaagaaagaaacaactagaacatctcccaagcacaaaagtttaacagaaacatatatcttagtggctatcaatccgtaggctagaccgtcacccatgctcctgggtaaaaaaactcctgtgccacctggtccaactgtcgagataccaccgtatatcttagtgactatcaatccgtagactagaccgccaccatgctcctgggtaaaaaactcctgtgccacctgctccaaacgtcgagataccaccataatagtatcccgcagtcccggttggtggaggatagcccatgtacgtagccaccgggtaactaaggtgataacctgcaaaggagaagacaccatcttgttatcaaaaattactccattcctacttaaccaaatggacccacacagagctgttgcacccatcaaaagtagattcctcatttctttggggacacatgatagccaaatcccaaacatataaccaacattgcgaggaggtttcagattagaaaccaaatgaattacagaccacaccaagcgagataagcggcactgaaagaataaatgttggatagtttcatccttgtggcagaaacaacatgtcttgctgcctttccaatttctcttagcaaggttgtccttggtgagaattacgccccgacgtaaataccaaaggaagattttaacttttaggggtactttcaccttccaaatccgtctaatgatattcggaaccccggtatgtgttagagctagataatgagatttgactgagaagaccccattcggggtgaggttccagtgaaactcatcttgctcctgtaccagaaccaaatcagctatgcgaggcaataggttatgccaagcagctatttttgcaccaattaaatcccgtcgccatgaaaagcatggaggattggtttggaaaatctgtgcgatagtcgactgtttatgcctaactatgttatagagacaaggatactgttctcttaacaaggcattacccaaccatttgtcttcccagaacctaacttgggagccgtccctaatcttgaaggatccaaaacggaaaaagtcatgtttgaccttcataagactagcccaaaaatgtgaatcccccgctttccaataggcttgagataaaggttgtgatcccaaatatttattgcgtagcagttgttgccatattccatcggtgataagtagtttgtataaccacttactaatcaacgctttattctttatctcgaagtcatgaattcctagccccccttgttctttgggacgacaaataatgtcccacttagcaagccggtatttcttcttatgtccatccccttgccaataaaacctagatcgaaggtaatcaagttttttaagtaccccactaggaattgcaaggaatgacatcatatacattgggagactgctaagtactgagttaatcaaagtaagttgtcctcccaacaaaagaagttttcctttccagctactcaatttcttctcaaatctctcgaccacttctttccattccgcatttcttaacttcctataatggatcggaatgcccagataatggaatgggaagttgccgacctggcagccaaagagctggttgtattgatcactaaaatcgctctgactcgagaatttaatgcattaagaaaaatagagcagcacttaatcagaagttatgtgcaattgatctgaagatagcattatatagtttaggaaggatatggcatcgaggtggggaacaaaagtgtgaaaatccccaatgatggagcagaactcgatagtgaagcattacctggtcatcgaacatcagtttcttatgccaacaagatctcaactaaattgcaagctcaataaacaaaagaatcaatatcatctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaattgtaatggttgaaagaacgagatctagcaatgcttaccttgtccacagcgtggtggagagagttctggtggcatcggaatggagagcgtatctgttaggtagcctcctagtcttgctcacttggaaaagcagataaatcaaccataagagatggtggaatatcattcccgttgtgtttcaaagccctagaataacaggtaatcaagcatgcatatcacacattttatcctataaatgatggacctcatgcatgatttcaagatagagtgaattcacattgaaaacctaaaaacgggccagtgcaatttacggatactaaaggaatgtccactcttacgtgagtgaaaatgtcaccaaatggatgactcccagagaagtcatctgggccaccacctgacgcttggcgctcagaaaatccagtagaacaatcgatcgcaaatcgaaaaagacaaatcacatattcactatttatgtcagtagtaaggaaggcaccatttggcattgaggcagattatcatagtcctgtttggtgcaactgcttttaaatattattttgttgtttggataactcttttccttcgtttgatttataaaacaaactaccaggaagatagatttatgtctctgcggaaacttaaaaagcacatgcatagtcacagaaaatagttaataacccggtcgtatgtttcacgcttatcttcatccttcaaaacctgagataagcatgacaaaacgcaccctttagaataagaatgtccaatggttaatgtaggacaagctaagatggtgcccaaacaaagaaaccaaaaacatgttcaatgtaggacaaactaaaaatactctgttacttccttgtttcaggcttccattctaatttatgagtttccaaatggatgttacatgcagcttgcactcatgcggttgggtcagcctagcgatggaactccacccgccagatctacgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaatcagtatgcaaaaaacatcttaatggactgaataatatgcacataaataaatcgataaaaaaaactcacatgatcttgttaacgatgttggtgtgatgcccccaatattgttatccatatcttaatttagtgttagccagctgaacaatcctaacagcatacttcacatcgagagttaaaacttgtttctgtaaatcagaagaaaaattcaaaagtaaactaatgagagtgaaaataaattattctgaacttaactctgaaaacagcttagaatgatattcgcaacatcatgttccttttgaataaaaagtatgaactccaagcagctattatatctgtttattccatcgattaaagatactttccattaggaaaaagatatattagctgcacatttcgtagaacacatgaatgcttggaggtatatattagctgcacatttcgtagaactcatgaatgcttggaggaactctccatgcattggttatgtatatgtgtgtt

SEQ ID NO: 64972 - DNA, 25262 bp, Oryza sativa
atacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactacatacttattatgccgtaaggctgcactatcaggtcacttcttgctattttttgggttttaaagaaaaaatcatcatacacatggagggtctatattcttattactatgtgaatttggaatgtgagtcttatcctataaattattggaagcatacactaataaaccattttattttatttgcactgtacctcaactctgtagccaagttaaacacagaagtatttaatacagtaatgaccttttcaattcagagcttcgaggcaacattctgccgcggcagggtgatcggttgctgctcggcgcggggtcgtgtcgtcgggggccagctcccatgatccggtggcaactgcagagggcgaggagggaggagagccagtgtggggtcgtgtcgtcgagggccggctgctgcgatccggtggtaggagaggagggtggtaggagaggagggagggaggcgcagagggccggctgccacgatccggtggtaggagaggagggagggaggcgcaggcggcgatgggggtgggggcgcggtcggagagaggcggcagcggggtgaccgtctgctgctcggcgcaaggtcgcgtcgtcgggggccagctcccgcaatccgacggcagttgcggatggcgaggagggacgcatcgtcggggcccggtgtctcgatccagtggtaggcgaggagggagggaggcgtcggcggcgctggggccacgggcggaggggcggcgcaaggggtgggtgtgggcgcgattgcgctgggaatcgggagcgagcgggggcagcagcgaagggagcggggagcgtggttgggaagaggggcgcgatagagggagccaaaaggggagatggcgcgcgtttgaagcgttgattttgcgggaggatcctaaaagcaatcttaccccttgaattacctaggactcaccatcaccactacagaatttttaaaagtagtagagatactctctctctatttcaaaatgtataaagccgttgatttgtcgtacaatgtttgataatttatactatctaaaaattttgtataaatattatttatatattttattgtgatttattttatcatcaaataaaatatagtctcaacttataccttaacatatttatactaaattttttaattaaacaaacagtcaaacattataagaaaaatcaatagcgaaatatactttaaaatggagggagtatatagttgcttctttggatcaagaaaatgcacagctcgtcaccatgctccgtttagattgctaagtagtactccctccgtttcgttttatttgacaccgttgactttttagcacatgtttaaccgttcgtcttattcaaaaacttttatgaaatatgtaaaactatacatatgcataaaagtatattaaataatgaatcaaataataggaaaataattaataattatttaaattttttgaataagacaagcagttaaacaacatgtgctaaaaagtcaatggtttcaaataaaatgaaacggagggaatagcagtggacagcagcatctgttaactttggcgttcgccgccgtatgctcatctgttcaccagcacgcactatcgatctgcgttcttgccggtggattatcaatttatcatccggggatgagaaaaacgactgtagtttaataaaatttcagaggcttcaaatacagatactcctataccaaattagtgaatccagctgaaactaagctctgttcttttctcatgaagatatagattttacctcggtttccgttagcacgcttttcaaactactaaacggtatgttttgtcaaaaacattctttataaaagttgctttaaacactactacaaaacatcaaataggtgtcggcactataggtaccggaagtgctaaaacaggcacctataggccttttcacacttccgcgggttgaaatcgtaaaaaaccggcacctctaagcaattatagataccgattctatatagaataggtgtcggtttttatttaaaaaaattacctatgtattataggtgtcggttaattaaaaacggacacctataatatattataggtaccagtttttttaaaaaataccgacacccacgtaaatcgagccgagccagcgggccaggtttgctcgctagtcgcttcttgatctctctctcgcccctctctctctctatctcgtcccctccttctccccgcatacggcgtcgtcggtgacggcttcgcggatacggcgatgcgcgaggcggccttggcggcggccggggtggcgacagcggacagagacttctcccgtgggctccggtggcaacggcgactcccgcgatggaactcggcggcggccggggtcggcgtcggcggcgaaggcttctcctgcggacagagctgtggcgacggcggcttccacgacggatccggcatcggcggcggccggggtggcgacggcgggctcccacggacggagtggtggcggcggcggctcccgcaatagatccaaccctcggcggcggcccggggtgcaggacgacgggcggaagactgcatccctgggtcggccatcggcgggttggagctggtggtggtggccggctccccccaacaaatcccggccacggatcggcaacggtaatttggttctatgaaattgttgagggatttgtggtctgtgcttttttcatctgtgatttgtgtgaaatttctgtgatttgtgctttaagggatatgtcttggatggatcaatggttacagtgtgtgaaacttctgtgatttagtttggatagatggtggtctcgtgtgtgaaacttctgtgaattgctttggattgacggtggtctaagggtgacgaggaatggctcgatgcatcgtgccgatgcattgagccctttttttttattcttgagacctcaaaggtaactttgaatattcacattagtaccgcgcctcaatggtgccggttgggaaaaccaaccggctcctatatgtggggttcctaactggcactatggtagtgaaaatatcaaatatatccatttatcaagtttgtaataattaaaacttaattaatcatatgctaatagctttttcgttttacgtgcgctaacttagaccctgtttgttttagcttaagattattataatatgtatttgtcgacgtttgatgtcgtgattccggcatttacatagtatggggatcgttggtactaggatatatgcgagattatagtaaaaaagatggagacggggatttttatacaggttcgggcacctgaattgtcaggtaataaccctactcctgttggccgaagccggtcgttgctcttatttaccataatcacaccagtacaatatttggggtagcctatctatcttttgtcgacatggcggtctgaagtgctgacacgtagtcgacaacagagtagtatttctcctcgaatccgtgtccggcgagatcagagacagcgttagatccttcttgatggtagtcgtaggtaccgtatggggactactaggcttatctccaatgttgatatccggcggcttgtcttggcgtatgttggcttgtatgttgatctattgttttatgtcccctcttcttctaggggccttgtatttatacccataggtatccccttatcaaaatagaactagggaaaccaatatggatacaatccgagtagtccttatcattttcatgtagaaccctagttgtctttccttatccggaactcatcctatatctgaaaactatttccgtataatacatggtatgtggtgggtcctgccgagatttagtcaactactatcaggtatgtggtatctataaccctgacagtattatttggagtaatttgaaacaaacaagtatcaattattataatctacaagctagattagtacaatctagtaatccactttagaggtgcaatttttatattattggatggctaaaaatccactgcccgtatatattttaaaaactcacccacctttgctatggaacggaacaaatcaggctccatccttcccactcaacacgcacattgaccttctctaccctccagctgcacgcgcattggctcctcttctattccgcgtgtcatctctcatcctctcggcacatccatctccatctccaagccacgccgccgaagccgtctccttctcatcctcctccgtgacttaacgattcctcgttcatggaagttttatttattaatatatgacattaatttttagctatttcaaattatgtatttattgtatacaatgacaaatggatgaacaatacatccaaaatagttgaggacattatagacattaacatttcaaatccagtaatctatgcctccaataatccagagaaacaaaccatcatagcttattttatattaacttattataatccaagctcccaacggatggcctattcagccaaagaaaaagccaaattttaaattttcaaacttaattttgatattgattttaagatattttcaacatagtttctttttcaaaattgacttttaagtcaccgagaaaacatatgtaaaagttttacctacaaattcatttatattccctaataagccgttttggcttattatagaaaaagccaaatgatggggcctccagatttcagtaatctcgctcaataatctagattgcaataatctaagctgaaagaaacaaggccttaatctttatcttcatgacgccatcctcaacccaaaaactatcaattagttttcgtactcgccaactgtatatctaagggatgatgtcttcaaattaaattctcatctaatcacctctcttccttttccttttatctatatatacttttgttttcattcttggttattgtgttgaggcagtttcttgaatgagaaattattcctccatctttttatctctcttctcattaactctttttccacattagatttttacttatgtgataatgtatttaatgctataggcgtatactagatgttacggaggattgatgacaatgagggctgggaatggcctgatcttcaaacaccacccaagtgagtcatatgtgtcccatcatttcagttgggccggaacagatatccagtgagcctgcgggccatatcggtgtgcgcatagcagctagcacacatactccctcccctccgttccaaaaaaaaaaaaaaagcaaacactgggtttctatgtccaactctttccgtcttatatgaaatttttttataattcgtattttcattgttgttagatgataaaacatgattaatattttatgcgtgacttgtctttttaatttttttataatttttttaaataagacggatggtcaaacattgaacacggaaaccagggtttgccttcttttttttttttgacggagggagtacactgcatcgatggtatacagtgtacgtgcaacattgaacagtttctcgtcccctttctccttgagattaaaagatgtcagggtcctgaatctgcgtagtccaggctttctaaatataaatacatttttgtaactttgatttgtgaacgagtacttccacaaaattgaacagccacatggaaatgaatatgttaaaaagagctttaatctccgactaggaagaaagcccgtgccagatacgtgggcttcttattaaatgttttatataaacaatgctaaaagaagttacatcccgccatttccatttaaatgttattaaacaagaagaatatctctcaaactaaaaaaaacattttgaccgagtaacatataaattctcctattgtcaccattacttattatgctttaaaagctaagtgaactgcatatgtaccaataatataaaactaatgtatcattaatacactaaaatatccactacttaagcttcatgtcttactatagaatatagacattgtaaaaatactaccgcttctatccattaatgggatagcaccattaaagttaaatagaaatgctactctaatatgggtgaagcccatcatagcctcaagactttctttctctattgccttgaaacatgtagccatgctccttaagaccagcttgcagcataattttaatgcctaatttgttatcgcacgattatggagtattacatcggtaagtatgaagttgaggactattagcgatggtggcctccattggggccaccttcatttagccatatgtttcatgctatacttatgacaccgtagtaaacactatttttcatgtttggtaccctttagtgaaggacaaagagaaggtggaggtgatcaaagtagtttttctaaatgttttaagtagatttgtggtatagagtagacacaatttgtttatggtgttgatcattactactcaaatttttagatatagatagagtattctcttttgaaaatgagcgaggttaatcactctatgatattaaaaaaaattatagctagagtcatactaccatgataatatccagagcaccatattattctttatattttgacaatatgtatagtttagcgcctagtttgttttcaacaccaattgttcatagccatatgagacacttttactaatttgaagaatgtatttattttctaaacttatttacaacaactaatcagttggagtacgcttatagtcatgccagtggattttcttatatatatccatcagttatgtctaacatattgaaaatccttaagtataagaaattatatcatgattattttattgcgcatgctacttcattgtttatttatgtcaaaactatttggcaaaggaataaaagtatgatcataaatctcatgatggattaagaggttgcattatagaaagttcattggctggaaatatttttgatattttttttcatatctactaccttcgtcccagaatataagttcttgagttggacatggctattaataaagtagatagaattaaatagggagaggtttttattggttgaaagtgaatgtatgtggaaaaaatgaatagtagagggttgtgattatttgggaagagaatattgatgaagaagttatcatatttgggataatttatgcatgttagaaattgatatatttggggatggaaggagtatgtactatgtatgctaatcagttttcaaatactaatcaaacagttctgaaaatataaaaaaaaacatttgagaattttagtctcaaacatattataatttaatcagatctactttgaaaacacaattaaattttgttgttttcattttttactttgtagatttaaattagtgttgtatatttgagaagtgatattccaacccctaaaatatgatgcaaatgttttgaaaattatcatacaactatctattatatattagccccatatgtcgtgatgtatttaggaccacaatacaacttctatagttgaactaaagtaatacaacgggatcacaaattagatttatttaaaaataaattttcttaaagaatattgattggatattttatattttttattatagatcttagtttaactatatatacttatatttgtgaagtaaaatatttttatctaaaatcatattttaaaggccgtcgttttttatggatgtacattttttttggctgtctgttttatcttagttcctatggttctcttggtgaacaataggttagctttattgtttggttttcaatcgtacgtacgtacaagagtatagtagtagtgtgtatcgtataaatagggggaagttattactttgtaataattgaactgatctaatggtataaaataacggatccaccaatttaagtgaaaattaatggtgagattagatagtaacatgtggcgacttaggaacatttataagagtgccccagtcgatgacactatcacctcaaagtccgacgtgcctcaagtggtcagaagccacgactccaagtataaggacaaggaaaaaggagaagtagatggtttccattttcagaggtggtaaaaaagtcccaaggagagaaaagatgatgagaagaaggccgctcaacttgcgagcccaaaatactttccaacagttgattgcccggatatatatgaaaatggcaaagctttttggccggattatgcacttgaagaaggtccatgggagataagaaggctacacaaatggtacatggacaccagcaagaaaggactagtatcattaaccgttcgaccaccgcccgatgctttcatggccaaagatggtctcttgtggcttgatttcggtgatcttcgtggcatctatcatcaggaaaagatggacgtgaactttgttgctgcgtggtacctttgaggctgtgagtaacgatatttttatacacaaataaataattacactagaaaagtttttgattattaataacaagcttttttggtaggatgtaatacatggatgttgagaaaaccaaggaacccatcgattatctagatccaacaaggatctgccaaacccagcatacggtgacattatcaaccgtgactaactgcaacatcgttactatttagcgatcgttatatatgtttcttgctctacccaatgtatgggagcgttgtggtcctggacccccttgattatgaacacaagacgtacagacaatttctaaccatcttacaatagtaggtgattctaatcgatgcgtgtctacttttcatgaattataattgaacctccaccttcatactaactaatatcgaaatcctacggtgcgtacaattactgcaaggtaaagggtggagaacaactgcaaacaagggagaagttgctagtgcatacatactggccggcaatactccgcacacttaatatatttaaattcttttacttacaatgtttaacgaattcatcctatgtgtatgccatgaagtgtcacaagcgacctcgaggcagtatcctctacggttattacacctgcgattacctcagggttaatgggaggtacatgactaagtaaagtaagaggatgtaagtatttcaactcaaacatataagtccaatggaaaactacacatctaaatgatatactaatatattcttgtttcattcgtggatgcagttgcctagaatcgagctccaaataaactttgaagacatagagatctctgccactttatccactgcgagtcctgtcataaagatgacagttcttcgacccagaaggaaacctagcgacaagtgatgattacaagtttcttccagagtggaacaactcgatgctataaaattgtaaatgtgcatttgaaatgacaattgtaaaaaatattgtaaatacatgacgacacttttcactaatgcaatatatgcatttatgactaacaatattaatgtattaataaagtaatcagttgtaccgttattgattaagcattaataaaaaaattggcgggagattttaaattttggtgccaatttttttccaggaagccccctaattatcgcaggcggctagctgtttgcgaaaaatttcttcccagacggaccggttgcctttgcctacaagtgggccgagcatccgcataggaagaccttttttgccgccacagaaatgttttttttagtaccaaacaaaactgtttgatccagattctaaaaaaatatagttacagaatccagaaaatgaattagaggtagaagctgagaaactcagcttttctaatttttaaaagctaactaccaatcagctgctttttataaaatcttctcttaaaatatgcttttataatgtgggagggagttctacacaaatagaaaaataataagcggtggtaggaaggaaattctgccttttatccatcggctgccacggcagctgcttttctactactttccggcggcgccgctctcctgtagaaaaaatgcgaaaccactgccctcacgcgtggcatcagcagcagcaccgcggccgcatgtgggccgcctcaccggccttccgcaggcgcctcttcctcctccgttccctttccccctccccctgcgccgccctccccggcaacgccgcctgctcctcctccccctcgccgtcgacctccattcgggtcaacgcgatgtcggcatcgggccccgtgtacgaggcggacgctgaggcggtggtccgccggatcaccccgccgctcgaccgcgcgcgccacaagggccaggcaggtgagccagcgcgacccctatccctctcgtgcgcgctccggggtggtggatttcgggttgtggtgttgctgatgatgcgctctctgtgtttgcgggattgcctccgtagggagccattggtgggatatatagataatactcgaagaagagggattttattcggattgttggggctagagaggccgtgcgggggacttcttgagactggggttgctaactaaggcgaactcgagcactacacagtcattgcttcacaatgaaccgtgtactgaaacaggacagaaattggtggatattcagggttagcattgctgttctgtctgataggacagtgttttgcataagggtgttttgatcggcgacgagtttggtgatacgttcgcagtgttcgttgtttctccgtatgatttgaagttcctgtatgttatgtgaaactataaataaaggaatattttacaatggcgtgaaaggattttgctgaggtgtagaattcacttataaaaaggtttgcgctcttgtagagttaagatttttctgtgatatgatttgctacgaaagaccatccagtaagattgcacagatacaagaattttgatccaacctctaagcatgtgtcgtcttcatatttctagtgcataatctacaagaaaaatgtaatactgtccgtgtctaggaacttttctactggtgtatacagtcagaaacatatcaaatcctgtatggacatacacatgttgttatgaagatgtgagctgtattttccagtttgttattgtttcatgttcccaaaaaattagtttcctgttgattccttaagtttacttacatatcaaattatcgatacatttcccagggaaaattgctgtaattggtggatgtcgtgagtacactggtgctccctattttgcagcgatttctgccttgaaagttgtcagtatcatctaaatgtatcattccataaattacgcaacagtacaaatagttcacatgatgttattcagggtgcagatctctcacatgttttctgcacaagagatgctgcaacggtaataaagagttatagccctgagctgattgtacatccaatactagaggaatcttacagtgtaaggtaacattcatggtatttatctttgccgtttatactataatcacaacatcatcttcgagaatctgactttataattactgcacagcgatggtgagagagaatctgtttcttctagaattctcacagaagtagcaaagtggatggagcgctttgattgcatcgttgttggtcctggccttggaagggactcatttcttctggtcagcttacatacctaacatcttctggagtataaacactatctctgtcctgttgaggtcttcttcattagtcttatttgttgctacctttgcgttttatacagtttaagatagttaattatattgattgacagttgaaaacatctttgctgtcataattcttgttttctcttcctttgaaactaaccatatttcgaatatattttattttcagtttgcacctttggtcaagcattgttgcaactgtgtctacctccattcctaattgcattagtagctcccagggccaaggatagaccagattggtgttgataactcatcctgtatttctgaagatctacagtttgaaattataaagttccttgatagtaaggaccttgtgtttcatatggttaatgctctatgtagatgacaacctcagtcctgaaactttttccatgctagaaatggtagcttcattttgaaggtgtggaggagttttaaccatgcatgacttttttcaattggaactgaaatttctcttttgtattaatgtcccatgtcatctatttgtctaatctcctatatggagatcatgccatcttgccctaagtacttacgatagtattcaaatttgtcagcttatgtttgttttgacatatcttacttgtaggactgtgtaagtaatatcatgagacatgcacggcaggcaaatattccaacagtcgttgacggggtaccatttgacttttttttaaaaaaaaaacatacttgaaattataaattatgaacaggacttgatattttttagtgatctgcaggatggccttttccttataaccaataaccttagtcttgttgagggtaacttgcttgccatcctaacaccaaatgtatacgagtacaaacgtcttgtccagaaggttcttaactgtgaagtaaatgaggaaaacgcttctgaacaacttactgcactatgccaaaagtatgatcataaccattgcaatcatttattcttcactggtcatctgtgatgttttctgattctgttgaacagaatcggtggcataaccatcatgcggaaaggaaaagcaatataatcagtgatggcaaaactggtatactagaaacattctttggctacttcaaattttggtgaaactataattggtttcaccagattttatatctcttaactatttggtatgttgttttattcagtaacacaagtaagtacctttggttccccaaggagatgtggtggtcaaggtgacattctttcaggaaggtttgttgccaatgtggtgctgagtgtttccttctgtagttatttctgctccttttctttggaatttttttcccatgctgctttctacgcttcatatcaaacatatgccccaacataacctttacctccatgttttgctactgccaaaaccagtgcttaaatcgaaagtactcagttttggatcgactcatttattttccttccgttcgtcataaacaaataacaaagaaacttttctaggaatacagttttagtttgttctttgatgatttgaaaaccacatgctatggtaacatgaaaactagctatgtgaacttcaattttgaagataacattgaacttaaacaatgagataatgaccagaactttgttctaacaagaactgattatcccgccctcaaaataaataaaggtcctgcagttgcactaactgctaccacttttgtaatgtgtgcttcagtcacagcacactgcataattacccagtatgcaataagtatgcaatgggttcttgggaatctgataattgtgttcaatcatctttgtgtttctgtaaatattggctattcaattatttatcatcctcaaataccatataactattgcatactcgttgctcaatgctaacaatcttctattgaatgtgagctaaaatcacgttcatatgcaagcatatgtgctggtcatgaacttacctatgagaactctgcttgatgtaatagtttagttccattcttaagcaatgccatggtagctcaaaattctggcattagtacttcaaaagtgtgttttattcaacgttcatttttgctggtttcttaccttatccggtttactgttggtggtagtgttgcagtatttgcatcatgggcacgtcactttctcctgacgaatgagtaccctacagagaagaggttatgatcaatcactgtttcccaccactcttgactaccatgatattaaataatatttgcgttggcattggtgcggtacagcgtgaatccgatgatgcttgggtgcattgctggctctctactacttaggaaagctgcatcacatgcttttgagaagaacaagagatcaactgtcaccactgacatcattgagttactgggcaaaaggtccgcgtgcgctctcactagattttttgtttcaacttgtatcgtatttcttcattttttttacaccttgcacttttcctcttgcagcttggaagatatatgccctgctggtcattagtttagatctttaccatcattggtggtacggcgccttagcacctgtaataatggtaatccatatgttcggataccagtctctccctgcttaatgtacatgtttcttgactgaaaagatggtgttacaatgcttggttttgtttagcctccgttttgctcagaagaattctacagaatgaataatgaattgccccataaatggggctttgattttggaaaaaaatagcccaaatttgctggagtatggattaggcccgtttgagctccggggtggtgatccccgcaaggatcaaagtgcagctgcaagaagaaaaggaatggaggggaaactgtaccaaacagaattctggcacagctcaaatgtctcatgatatgcctatgcaaattccagttgtgtacagttttgagcacacgtcattggagccaaaggttcttcactccttcactgtcttgtcgcatctacactgaaggaagctgtttgcgtcacgctgtattctgagattcgaaattgtttctcaacaagtcaagcagagctgtgtgcctgtgacatctgttgtcaattttttcatgcatgattggaagcatccttctatccgtcatgttccattgtcatctgtgagttccatatcttgtttaactccttttaagaaattactgctgatggtgagtttattaatctatccttgctgcagcacaacacatgcttattttttctctctagggtgtaacagaaatatccttattggtcaacagacatgttgaacacgaagattcacaatggtctcatgataatggataacaggtcttctttcatccacctcaaagatcatcctgaatgaaatgccgggggaggcaatcaagcaagaaagggcttcggaagggtgaccccctatcccctctcctctttattctagcaatcaaccccctttaacgccagcgacacaaggccactaagcttggggcgataagcaaattacgaagagagcggtacgtttctgcacatccatgtatgctgatgacgcgactgtcttcataaacccgaataaagaagatgtgtgagctttcactgatctccttggtcgctttggacatcaagtatcataatattgcctactaaatacgtgcaacatccaccgcggctaggatagccctgttccccccatatatagaagataaatgatccctcacagcgatgcattacccttgaagaacagacataagaaagaactgaaacgaagagattattatgagatgaattcatggggacaggatgtcacgcccagaaattcacaaaccagaatttctaagctgaatgtgcattaaacccctgttcaggaccagccagagtacacaaacgacaattgttgacatacagatccacgtcttacaaaaatacaaaagattacaaatgcaacggaaaaggataaaagcgagctaagcctgaagactttactcctgcagcgaggcgactccattccacaggcatccttgacggcagcgacgaaaccaactccttcgagacatctccaactgagaagaactttaactctggggtgggggaaaagagagcaagactgagtactacccactctactcagcaagtcataccggaagagaaggtatgatgcagagtataaccaaaggaggctagaggttcatttgcataaagctagcatttaaaagcagtagttgaaagcagtaaaacagttgtagcaattaatcaatattaaccaatcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacgcacaagacacagccccacgacacgttaccgtgcgccgacatgccaccacgacataccggaaagaggccgtgacaggacccttcgcataacccactctaaccgatcgcaccacaccttagggttcacccccgtcctcagcaggcaacgggcagcccccctttcgtgccgcggtgaattaggaagccgatcaaccggacaccccggccaacccaactccatcatgcccaccctcgcctaggtacgtcggctagaggaaagctacactacaagcccagccgttgcccacgctggcttgtggtaagtatgataagttcttccagggcatcccgcgaatcggtccttaattgccatgagcacgactagcaaaaccatgcacccacagcccaccatgtagtgtattttgattaactaacaccattgcggtggcactaatccaaagctatgccaataatcaaagtctatacattaatgtgattccccttttgtgtactagttgaactaagcatggctaagcatttcctaagccaacatctaatcattttgatacccaagttatcaatgacataaggtaaacaatatatggctgagtagtaggacccatcccacatgatattgtaaaacgatgcaacatttaatagaaatgcgggacatttgtaaattgggtacaatataatcaatcgtaatgcatgacttgccttgctctcgcactgatgagaccacaacaacgtcttcgagaaaccgtggagcgacgaaacggccgagatctacacgacaaacaaaacacacacgcaaaacatgctataagactactgaaacatgaaacaaaaccatttttaatagattctatgcatttttatgaatttactgagacttcaatgaacttaatcggagctcgaatgaattagatatgaattttagaagattaaatgtgtttttactataaaagaaaaggccttaatggattttattgcgcaataaaggtccctgctgacatcatcaaaggggaggggtggcgccgacagatgggccccacttgtcatagactcaaaggcaccggtttactgtggactgagtccacgggaccgcggagaggagcaccacgtggcgcacatgtggcgccgacgtggcggccacgtggacggccacgcgggcggcaggcgaacggccccgatctactgagcgatagatcggacggctgcagcggctcgcggctgggcagtgcacgggtggctcaagccggcccgggcatggcgtgcagcggcgcggcacggacatcggcggtgactggcggcgcaagacggcgagcggcggtatgcggcgacgcggcggtgcgacaaagagagagagagggagaggaagggagggaaaccgatcctcaccgaggggctcggccggcgcgggggaggagcgacggcgaacggcgacgacgagcgacgggaggacgacggcgacgggcggacgagctccgggaccacctaaggaacaaaatgggagggattagagggagaagggtggtccacggcgagcggattcgccggccaaaggcggaggcaatggtggtgctcaccggcgcgcgagaagaacggagctacggctaccatttgtgtcaaccgagcgttggacggggtagccctcgcaacggcgaagctagtggcggtggttgcgcggcgtggtaacgacgctagcggcggcggcgtgcggccggagagtggcggcggcggcggcgctaggggagagcggcgcggcggcgatagagggctcgggagagtgcggcgtcaaaaggaaaaagagagagggaggtgcggaggtacttaaataggagcgggggaggcgagtcgtggccgggaggggctcgattttgctggagttagtggggatgtgggggaggagagagagagagagaggcgggattcaaatttgaatcccggccatctcgcgggcgcgggtgtgagcgggtgtggggcgtgggcgcggggaaggcgtggcgcgtgggggagtgggcaacgtggcccggggcggcggttgaggagggaggccgcccctccggctggaggttaggggcgaacccgacaggtgggccccacctgtcggcgcccgggaggaggtggggaggccggatggacttcggggagggggaggaaaaggaatgggccggcggcccaaaaggaagaaaagagggggggaaaaggaaaaagggaaaaaggaaaataaaaggatttccagggattctttaatgcttgtgctcaattttaattggttaaaattatttccaaggctctgaaaattccactacaaatctcgttagcatattttgacatgtagaatccaagaaaaattccacatgccgattccgattattatttgcatttattaatttgaggagttagctctaggttaaattaaatcatttcttcggacgatttattttatgaattttaaagcaaggaggggaacttcagggcgtgacacaggaggagatgctgggaactacagcatcagatgttaacagttaacttgaggaatggtagacatcaagaaaggagaggcgtggatcaatcgtcaggagagtgtggggtcacccaaacaaggatgcgaggtgtcaaacttcagtgctgcaacatcctattgtctctctgtctcttgtacccacctcctcttcttcctgcgtcctgcaccatcctcctatgagttgttcagtgccgtaaaaatatatacattatcctcctgtttgtcacaatttcagatttaggttctctgtgttatagaagatctgtgtaataataataagtgtaatataatgtgtgtgcccttttttgcctattgttcttgtatactctataacctttcacccgtctcatgtagctaaaaaaagcttcattcctccacgaagttaatacacatattgacgcgttcaacacaggtgcaaactattagttgtttgataaatgattccatcgtccattatgcccaaaacatgatttatacatcatgtttcgtggttatgaacgaactgtaagcaggggcgttcctacactaaactactcgggatcaggtacccggggtcaccggaccagtagaatttccatctctaatcgttttagcctatattaactatattgatacttaaaatttaaaaattagagtattatatgtattatgatatgtaaggaacctccgataattttcattgtgagtttcgccactaactgtaagggcatagccttgacatataattgggatttagtaatatcatgttttttctctagtagtgtcatgccctctcactaaatggcgaaaccatatggtatttccaacaaaattttgcctctaaaagtagtcacattacactattggttatgagaaattttactgttagacacattatctcgaggtacctgttgtatttcccaggaaagctcaccatttctacctacgtgctggatgcacctactcatgcttctgttagctaacagccagagcaaaccaacaggtcaccgtgtaggccgccatgggcttgtggacgcggatacagcctgcatgcacgtgtaattgtggccgtattttccagctatacgcgtgagtgctttcaccagaacaagtaacaaccaacgagagcatgattatataattccatctatacatttaaattattgaagcggcagggcatggcaattgggttttagggatttttgtccccagtggtattttgatcattagaaaaagataaacagtacaaactgaggataactgacgatgatagaagttaagcaaaaagtgatggcatatattatagaacagtggcatactgttaaactagactaaagtcagtggtatgtggtatgtagtagattctctctaaaatttttgatatctctaatacaactaccatgataccttcggatgccttcttaagaatggtaagagaaaacaaaaaccccttttggttaaatgggatctcgcgacatacttgcctcctctatcaaatctggcatcataagactttagtattcaactcgctagctcaacttaatatttttctatgatcgccttagtgctctctttctctccaccagtatatataacatactctgttgcctcttctcttcagccctccgccaggcgcccttccacctcatttacaaactactgggtcatacttatcgaacaaattcacggaacgaaagggaaactttgcatagcaaaactcatgtagatgcaaacaaatattatttttctgaagcataaaaattcgtaacaactcccaggaaatctggactccaacaactattgccacaaaaaactggtatctcctgttctctccttctcttcatcccttcaaaagctcaaggtcacataagttgcaaaataaaaaggaacacaattagtaagcaacaagaccaaatgtcatgccactagtacactgtaataattgtcatgcacttgaaacaaaaatctgcactccacggaattctgttcgtaatcaaacaaataaaagaattggggtaatcaaggaggcaatatcagcctgatcatttgtttcttgcaactgaagaacaagttcacagaaatcacaaaagtcataacccatgagtattcttgtgagcatctgcctacaaaattgaatactattgatcagtacctcacatgcattgcatcaagttaagaatgtgccatgttgacacatgttttatagtggaattgctagctacaactgatgatttactgtatacatagcacatgtatacagctcaataataccgaaactgaaagtaaccccgcaggggctctaccaattttcatgccctttagcccttacaatatttctgacaaatcctctaaaagaatatgaccaataaactgcaatagtctgctaggccactacatttgtaaagttctgtacgactgtagatgtgcatctgaaaagcgtacatagctagcacaacagtctgaacttatataaattcaagacataatccgaactagtctgaccaaatatttctgaacatttcagaactaatctgaaagaaaatttctggaaatttctaaattgctagctagcacaacattgctgaacatttctaaaccaatctgaacaaatacagttttctttgatgcaggaaatccacatccagatcaactcaatggaaagcaatgcagcttagaatgcaatccagtatgttaaatctttcggcctcaaaagccaaggttcagaccaagattattcaatgattattctcattctcaatctcaggcactttctactgataatcatatgctaactgcaaatgaaagttattgattgctcaccgatgagggagaatgttggggatgcggcaaagatggactacctcgattcggcgcaggtgcattggacgagggaccctgatgcggcgatcgatgaggtgagggctacgacctacgacctcgatgcgacttgggtgctgcggacgagcgagcgaccccgatgctggaacggtgcagcggacaaacccgatatggcggtgcgaagaggccgaaggaggttgacgaggccggcagcccggcctggagcaagctccgatgcagtgcccagggaagcagcagcaggctagttggccgtggaggccttggcgggtggtggattcggagagagcgaggagatgagaggatccacgagattgcgtgatggccaattttctcctgcgctggctctattgggagtgtggaacggtgccaaaatttggctcgatttggcacctggattaggaatgcggcaaaattgggaacctgttggaggcctggtttttatcttaatttctaaatgaagttttgggactgctgttagccatctgttggagatgctctaactgccattcttcaatgcaaaatacatttcaagttcagtttcatattcttgccatttccaacttaaatcattatcataatacacgataaagccatgcatgttgtgctcgttgtgtgtttgaataccacctattacaaatgctttgtcactacatatcttccacactcacttagaacattaaactaattgatcaatcgcactacagcaccactgatcctggcagacttaataataatacctaaaatgccttaagaatggttcaaaaatgttttaaaatatcgagaagatggcactgatagttttttgagaaacataattgctgcactcaaagcgaatataagaaaaaaagaaccaaaacatcatccaaaagattcatgtcctttaaaatacccttcatgtattatgcctccaaattttaagaccttttaaacacatccaagcatggctatactaaaacacgcacacgaaaaaataactagtatgtttatttcaaaacagaacctagattcctttggagacaaaattcaaccacattacagttctcttctagtgtcaaaaaaaactcaaccagtttgctcaaatgatcatatgttcaattattttagcaagcgtgcacatactagaagtcctaaaaattatatggttttcaaggctgtgctctgtaaatcagaataggcaggtgaaaaataaccacattttattattgtattgaaacagtactgaaaaaacagtgcacttcatttggtaatcatggccgattcttttgttcagtcctcactaattcaggacttatttacatataggtatttcatagcaaacaatttaagttctgatgaaatcaggtaaaaagttgatatgttttaaagaagccttatatactgtctttgaaaagagacaaaataatgttagtgaataccaaattcaattgtattttcttcaaacatacatttgaccaaaaagataaaataattatgcgatacatcctacaataaagtacaaatggtactaatatgtaaaaagcacaacagcaaaaatcaaagaacatgtaccttgtagatgtgctccaagagcaaagttgtcacagggaagctagggtgtctttcatttcattcactgaaattactgtttcactgggatatattttggaaatcaatttgaggaaggttgcatatttgtcaagaaactccttctgtaagagcaaacaaaatatttttgttatatgcaggaattaacatccatttgcttgaacagtaccagtgactgtatgctgttcatgattaggtgtttgattcgattagacataagaaatatttaagataagaagttagagaaaggatttgtcctattaatattttagataagttgttgtatgctaatctgcttgaagttgaacaatgaattaatctaatcaactcccaacattctccatctctcaactatcaagtctcaactatattttttcccttaacaagacggcattgaatttcatttcctttgcattgtaaacagaatgcaaatagtttacccatgtagtttactatttcaagtgacatgagaacataccttgcatttatcccatagagaaggaagtaattcttcagccgtaatattcttctgtagttttctatacattgcattgattgtcttgtcaagctgttgtgaaatgaaacagggacgtgcagagacagatatgaggctgtagtaaaagaaaatttcaaaaaaaaaaaaaaacatgagaaaggggaaaaatgattatattgtttacttacaccacttaagctggacttcaacatcttacggaagtctaccttcgacattccaacttggaaaggtatctgtataataatgtaatatgaagcatccataaaaaaattaggcatcacagtatgctaatataacaaaaatcatggagaactagtcccctgttttttaaatttcaatgcataaaactatgaaaaatgtatgtaattaatggaatagaagtgtatctggccaaacaaatctaaggggcattttgcacatatgagtgttcatcctattatagatcttgaaaaaataaaaataagaaattcatatgttcatcaccatcaatatttcggtggtattatttcaacaaaagacggcttaagtatttggtcatctcatctaattatcttgaatcctctgccagaacaggtatctgcttcaaacttcaagaaatggaccatagtccgaaaaaggatcaatattgtggtgcactgtcccgaagaagataataactcaatgatatcgcctttgaaactgaaatgcacaaccaaatgtgatgggttacctcctcagggctcatgttgtacattagttcctcaattttccgagcaaactggaataatttttcgaagtgctgtaaaagaaatattttagtggtgacagaataaaataaatggcactaccaaaaatctgaaccatgaggatatacagatgacttacgatatatatgactaaattgatgtggcgtgagcaagcttgttcataagcttcactagcttggtgataatacttagcaagtgttggtacaacatttgctaaatcgtacagactgcatatcatacaacatgtaccaagttaatgtgagtagtacaggccactaggtcctcgtaagtatagcaaattctgttgggtagagttttttttcggccttcaaaaaacattcatcaaagtcgaagtttcaccctaaactacaaagtaggtaatttttcaccctaaactttaaaaaccagacaaacttcgtcccgtgatggtttttttgtggtggttttagcaatcttaagagtagcattgctattttttcctaacttgatattgcatcacatatcatatgttctgtatcatttttcctctttgcatctccctctttcaacactgtactgtgtgaggaaatgagaggaaaaaatgtggcatgtggagtcacagtcagtggccacgatagcattaaatcgtgttgccactttagacatagttcaaaccaccattaaaattagtctccaggtgaagtttgcggtattgaaagtttagggtgacatataagtgtttcatagatgagggtgaaaattagacttcactgagagttcgagggtaaaagatgaagtttacccaactctggtaaactacacctgaaacaggagaacaaagagaataagaaatagaataaacctgtgctggaaagctgcataattctccaatagtacaatgtcaacatatttaggttccacttgagcaattttctcgagggtcacaaacataatggtcacctgttcagaaaaaaaaatttaatgactaaaatagggttatgattatatttaactttcataaaaaaaaagtcacagaacactgagatctgcg

SEQ ID NO: 64973 - DNA, 1157 bp, Oryza sativa
aggggggtttatttcacacctcaataggtgtgaaatatatatatagtttttgatactgtcaaaacaataatttgactcagctaatagcataatattcaatgtccactgaaattcattcaggtaagggagaaacgtgcagaatttgtacttctaaagtgcacatttgtgcggagggcatccgagtttttaaggaattactttcccagtttgattgattttatgctaaatgacaaaggcaacttctcacaggtaaatttagtctagtaattgcagattatttaactttaaccggatcatttttctcaacataattccttttgctttcagagagggcaactccagaggcctgaccatgctgatatgaggtacaaatgcaggacatatgcccgacttctacagttcatcaaggttacatgcaagttgtcctgttgtgaaaaacgatactattttacaaacagtactgttatggctacaatatgtgaaattttgcaccatattctcatgctttatattataatttttttctagaacctggacaagagctgtttgatgcctttacggaaatcttactgccattctcttaacttgttaattcgacgggaggtacaattcttcaaaaccttttttcaattatcatgatatatgttatggcatggcgttagacccaacctattatggattgagcacagttgtggttcattggagtatgtgctttatatgcatgatgacagcatgaatatatggtagatagtaccaacttgctagttgaacaagttgcaccaacatataaaaccacacatttcaaccagaaaatcttcagttaacctacattttcgtcctcattccatgtctgcaagcttattacatttagcatgcatagttcatagcctcttttgtggcatctagtatggaactatggacctatgcagaataaatgggtgcatgggagagataatgaatggaatcttttgtccatggtactatgaactgtacactctatagctccttgggttaattgggccaactccttggattaattgattattaaaccggctgattttttagtgaactgggaattaaactgcatgcatgtccagtatttgtttgcaaccggacagtggcaggcgctgtttcccttttttttggttgaagcgtcg

SEQ ID NO: 64974 - DNA, 5776 bp, Oryza sativa
ggtgacactatagaatactcaagcttgacctcctcaggaaacacttggatgacgacaagaaacgaccacaagtaaccgttaaggccttggactcacacgttacatacgaggtatgcagcaacatgggtcattctgggaatgactgcccagaaactcgtgaggaggcgatgtacatgggcaacaacaacaacgggcatcatccacaaggaggtcaggggtggaaccagccacgcccagattattaggaggtaacaacaatggtaacttctctaaccaacccttcttgaaggatctcgtttctgcgcacaccaaaactactgatgctttaagcaaaaagctagctgctaatgacaagatcctagagaacataaatgcttagttagatggctttgcctccgctttccaaaaccagctgagattccataaaatgatagaaacccaactagatcagttagcttccttagtccctgcaaatgaaactaggaggattctagggcaacccgactcctccgtagaaaatgtcaaggcgatcacgacgaggggaggtaagtccactcgtgattcgccatatcctaaccctgcaggaactaatgggatagccaaagaagcgccatctaatgactcagctgacaaagaggttcagccagaaaagaccgtgccgcagatatactgcgacacacgattgctgccatttcctcaacggagtaggaaaccgttagcggatgagcagcttgctcgttttgttgaagtaatccagaagatccacatcaatgtgccattgttggatgctatgcaagtaccaacatatgcccgttatctcaaggatatactcaacaacaagagactgctcccaacaacggaagtggttaaactgacggagcaatgcaacgacgtcatactccacaagctcccggaaaagaagaaggatccaaggtgtcctacaatcacctgttcgatcagggcacatcagtttgaccgggccttgtgcgatcttggagccagtgttagcgtcatgccaaaggacgtctttgacaagctcaacttcacggtgttggcatccacaccgatgcgcctacaactggctaattcgtcagtccgttacccggcagggatagcggaggaggtgccatttaagatacgggacttcttcatcccgtttgacttcgtggtgttggatatggatacaggaaaagagacgccactcattctggggcgttcgttccttagcaccacgggagccaacattgacgtgggaacgggaagtatccttttccatattaacgggaaggaagagaagtttgagtttcaatcaagtacgggccaaacccgtagaatatacaagtggtcgaagtggagccacccaagatggatagcctggtgaaatttatgcagaactttctggagaaggaaacaacgatgcccaggaacggttattggaagacaccggtaaaaccaagtacactggccaaaaagtcagagcagtcgactcacaagaagccgtcttccgcatctaaaccaaagaaggtatggaaggaaaagctaaagatgcccactccatcacctctagagtcggctggaaaattcgtgcactaaactaaaaggaggtacagtcctgcacgtcggacttaaaatgacgtgaccttcgccaacaggtaaaatggtatgtatccgcatatttgttttcaccaatttgaatttttgcatcaacacatgtttgaatttcaaaattacatttaggatttttgaattttgaggaaattcttcaaatgaatttttcagagcaaaccaaaataaaattttcaacgaaaattcacaatgccacgaccgcgctgaccgttggaatccaacggccaaaagtggggccggttgggcataccaggggtttggctgaacccactggtgggttcggccgaaccagccaggcaacgactatttgccatttttggtagggtaacatctagtggtcccacatgtcatttttaaccgttgtgggtaccctataaaaaccagtcggccaagagagggaaatccaccccatttcagcaagctttgatagtttccctcaaattcaaatactagttgcatacatacaagtgctttgctgaaactaatcggcaggtgaaactcttgtcatttctaaaccctgccgagttaatccgttcttgctccattgtgcagaatgaggaggcgattgtctcgtctgttcaaggggtccggctcttcatcaagtcatcatgacgagtctagcactcattcatcagctgatgtctcgatggaagacgccgaagctccgcgacgactcctgaacgataccgacctcgacctcgtcggtgatcgggaaagacaagcctactacatgctgagtgactaggaatatgctcacacgcgagaatactctccagagctgctgaaaaagataggtatggatgttgaatttcgtgctatttagaaagttgtttgatggcagagatttcctgtggtagataaacctggttctcgtttgcttactttgcaaattctgtgcactttgaaagaaatagaagatggaatttattttcgcttcttccataaggagtatacacttacatggaaaggcttaagtacacttcttggttttcacgattcctgtaaaatcgatctctagaaaggaatttctgggttcgagaaaaaataggtttcgggaagatatttctggtgctccaatttgcaagaaacctaggacgaatgacattcataatcctacactttggctcatgcacaaatggattgctataactttgtttcctagaggtgatcttagacccattaggggggatgaattgattatcatgtttaccatggtttgaaagatcaaaattgctcatgtgaaatgtatgataagacaatgattagagaatataagattttcttctcctgttgactgcacttctctaattactcggatagcaaaagggctcggggttgttaacaaccaaattgcttttatgtcagccgctcgtccgtgtattgatgagacttatctagtgcaagggcatattctgaaacatggagtagatggatctttgttatactttttctccagttgtacaaatgaaatcccgttgccaaatgcgaggaatcatttgtacaactgccatgaactaaccattcccctgcagaccatagaagaatctcgtgtaggtggagcaaacagggagacgcgcaacatgacaaggaacgaacaggaaagttcaccatcctcaacacccgtgcagatgtatgaggcaggttgggaaccaactggggatgcacccggatggacccaagctccatgtcacaacatcagagtctcaagatgggcaagtgccagtgaggaccgatggcatgcgtctcatgacatacattcgggggacaaccaacctcccagatcaagtggtgtgcctccatctcgaagtgaatagcgctcgagatcctctcgttgggacttgggtgaaattactaggagaatggatacccttgatatgcagacgggggagatccagtacaacctcatggaacatgtagcacaaacgcaagaatggcaacaatctgctgatgctcagttcgccagcatcaacgacatgatgcagcaacagcatgatgaccttcaagcatagttccgcttccaggggttcaatccttatcaaggaccctgagcgaaagccaagcttggggggagacatttcttcccccactaaggtaacttgtatcacattgcatatttccctttccaaattgcatatttgctttccaattgcatcttataaactgaaaacaacataaaaatttgcaaaatagaaaataccaaaaagataggataggtttgagtcatgctaggtaagacaagctagttctctttgttgaaatgatgaatagttgctctgttttatatctcttatatatgggttcataggtaagtgctctctcaaagattaaatataagtagccaacaattatctgggaacctgaggtaaatgagctgcacttgctaatctgagtctaagttattgcaagatacgagatagtaaataagagttactatgatcctaatcctagtttgacttaaatttgaaagttcctcatttgatataaattcctaccggagccaaaaatgtactatcatggttaaaccttatacattttggttactcgccattccattgaactttgtcaaactcttgtgacttgtatagatactcctcatgcactatgatcaatatcatacacccacatatatgcacatgctaaactcctaccaagtattaacattatattaacattggacttgggagcagtatattgatacaccctggccaaggccattcacacataatgtgattattgcacatcaatgcaaggttaaggctatgctcaactccaaatcttactgtattcattaggaaaggctgctgcatggcttgtatgattgtaggttaaagcatatatttgtgtttaaagagagagacttgactcagatcgattaccaccagtacaccaaggcaaagtaatcgtgcaagacacttgctattatatgaacttaaactatcaattggactagtgctaccatctcaaggaccgactacgccaagtcatgttgttattccatcactaagagattgtgccaagcatagatggagtactcaacatcattaaatcaaaagaagacaaaaggttaactcgtttcttgctgaattgaactttactaatgatgaaaattttataatatctaaatggtgtacatttgcatttttaagttttatgtcaaaggatcatttcactgctacaacaacgaacgactgcatcgaggatgtgatgtattgcacagaagatgaagtgacacttgctcaaattgagatggttcacaacaacgagcagaccggttacgcgcagatgctccaatttccattggatgtgtgatccagccagtcgtcttcctccatgcatgatatatatgattggaaatataatcaagtctacttttatctctaacaaacggctcgtcatttcgagttcccataagagaataatgtctattttagtggatactgcacagaagctgaaagggcccagcgaacctgctcgggaatgactcatggagacccttgagctagctcacttactttgaatttcagcagtcatgtttatccccatctagtagggttgttcgtaatataaatatcccctatgttttatcatttgaaaaacttttgacgatgagaatatgcttgtttagctatgtgctaacaaattcagagagatatctacccctttgctgttgtgatttccttgtgggattacaaaagtggtgttcgatgccccctaattggtgtttctggtccctttgaggatttttccttgattggttctaggttgtgttggttggtaacttagagtgtggttgggtgaactctcaatttaggttgccataatagagacggtggtttgcttcgagtatgatcgtcaggaaccacggttatcttggctgcttgtagctagttttcttggtctatttgaggctttatcggttcttgatcctatgccgtgaagatcgggacatcactgtacacacacacatacacacacacacacacacacacacacacacacacacacacacacacatatatatatatatatatatatgtatgtatatatatatatatatatatatatgtatgtatgtatgtatgtatgtatgtatgtatgtatgttgatcagtcaataaggattgcacttcgttgtgaagggctgcaggaat

SEQ ID NO: 64975 - DNA, 703 bp, Oryza sativa
ttcctgcagccctgaagcgcaagtatataatgatgcaagggcctaggcaacctagcaacattatcgatgtctagttcaggccattagtggatgatcttaagttactatgggaccggggtgtgcagatgtgggatgcatacaaaagagagtacttcaccttaagggcaatgttgttcgttaccatccaagattaccctcggctagcaacacatccgggcaaacagtgaaaggtggttgtgcatgtctgtagtgtatgctggaaacaatgagcatgtggctgaggtactccaaaaagaccgtgtacatgcgccattggaggtttcttccagccggccaccactactatagcaatacaagagatttcgatagcataatggaggagggtacaactccaacacaccatgacgacatagccattttttatgaggtaaaagatattgaatgcatatttggtaaggggcatggcaatacaagcgcagcgggtaagggtggtgagaagactttttggtcaccacctgggatgttaagtctcctaagatgtgtaatacatctggtcaccaccttcgtgtggtttgacgggcacatctcaggctggagttgactggcacggtgagtcccagcactatctcttatgcaatttagtgatgaaattgtattcgtgtatgtttacacattgtggagatgaaattcacttgtgtatata

SEQ ID NO: 64976 - DNA, 37689 bp, Oryza sativa
  unsure (1)..(37689): unsure at all n locations
ttttttggcttttattattatagctgccggttatttgcaggaaccgacacctatagtaccatataggtcttggttcttggggtacaaccagcacctataaaattataggtgccagttctggaatcggcaccaatgaatttgatcgtaggtgccgaccaaaaggtgtcgggcccaaaaccggcatctattaggccttaagaaccagcactaatgggtatttctgtagtagtgaacatgattcattaactagctaactactagctctgttcagtgctcccattcgccttagcaacccactctcaagaagacccccacggcctctctagccccaacaatccgaaaaatccctgttcgagtttgatctatatataccatatcaattagttctttgtggagcattcccacaaacacagagcgtgcatcaacaacaattgctcaaaatccatctcggacactcatcctgctcatccccacgcgtgagagagagagagatatagagatagagagagagagagcaagaagtgctcttgccatactcacccgcctggcccttgtgccacgtgcggtcgagtagcggggtgatcagctggacctccgcctcagcgtcagcctagtacactggccctgccagcgccaagcccgaggccaccatcgtgtggcactgaatagaggtcgatgatcaggtgtaggaggaggagatgcatgctgaagcagaagcacccactgcaactggcggcggtagggaggagaacagcggcgcagggaggaggggttgaggagaggaagcggagcaggaagaggtgtttgcagaagaccggtgaggcaacccacaagcagacgtggtgctattgccacacgtgagggcatacgcccaagggctcaccatgggtcatcgcctctgttggcgatatggcatgaggcccttcgaccaaacctgccgaaagtatgtgaccgatggggattcaagcccgagacgtcatggctagtcaaggcgaactcccccatggcgaagactatggagcaaggacggcgagaggcagggaatcccagccaagctagaggcctcctgggcgaagagcgcaaagcgaagggcatatgccgaagggggacgacttcgccgtagctaagggcccatggaccacaattatgctatgtacccatgtaaatgtccctttcataaaggcaaccatgtaaattcccctgtataaccaaagccctagtagtaagacctgtaatgggggctataaatagccccatagggccatgtaatagggggatcccaagtaaaaattctcaaattaatacactttacttcttttccaaccactgttgagtgaccacgtctttcgacgtatgcggttgtcgtttcgacaacagctggcgccgaccgtggggacctccaagcgaaaccactcagagcgaatgccaccaaaggtcgtgaaggagaaggttacaaggcgaaaggaaagcgaagccagggcggttatggccgccgaagagggagcagagccttcggcgcccatcgccgaagatggaggagcgccatctgcttccgcacctgcgccatcactaccgccatcggctcctggcccctccacacaggtgccgaacgcggctgacatggcgaaggcggctgcggtggcaagggcactccagaccaaggcagagatcctttcgacaagccagctgctggtgccccaagccgctccgtcgcagtcggcagcggccccaactgcgctctccgctgtgcaagcccaagtcaaccctgaccccgaaacacaaaccgaagccgacatggaagccatgcgacagaacatgacatgactccaagacatgcttcgccaaatgcaagaacagcagtaggcataagagacggcaaggcggtccaaggtcactttggccccaatcctccagtattggcaggctatgtcccaccccaagtctatccacaagtatcgacccagccccttccgccacaagtcgcgcaaagcaccaatgtacatcgccgggtagccatcgaccgcagcagcacatccggcccctcacgtgcaactgcaagctcaaccggtcgctgcccaagtacactctcaaccgcctggccaagtgccacaaacaatggcagaaggggcttcggctttgcaggcgcagctccaagctttccttcagcagctcagccaaccccacaacatttcaggaacagccccttcggcccacccgaaggggaatacaagtcagggtgcgcctagttggttgccgtcgaatcagccaggtctgggggcttcaccgtggagtcaaggaccgcagttcgacttcatcaatgctgctcaggcaccaaccgttcagccgcaagcatgtaacgccccgattttcgttcgggaataaaaatcaattaataatacattttctagaaattatattaaaagttaaatcaatttaatcaagtgaaattatagaggaaattaaaatttcctttaaaaaaatcttgggccgggaatattttgtaatattctttgtgccctaatgtactctccggaattttccgtgaattttcggagctcgagaaatagttttaatagcacaaagttcatttaatcaattaaaataaaaagaaaacaaacaaaattccccctctttgtctttgggccgctttcggcccaagatcttttccccctccttggcccgctcgcccctctccccttccccctccccctctcgggctctctctctccctcggcccagctcgccgctcggccctctcctccccgaagtctactttgcctccccagccggcctccctctcctctttggccgacagatgggacccatgggcccacctgtcatccccaacctcaggccggcaactgccgttgccgccatggccgccgaaaaccgcccacgtcgccgccattcccggcctcctcgagccctctctcgtgtgggaccggaagccacccctctcctccacctcctcccccgtttttccccaaaaaccggcgccagtttggcccccatgatcccacgatgcctcgccacttcgccggccgttgccgccccactcggccacgatatccccctccggggcgtataaaagtgtaccccggcctcccctcatccatttccccaactcgccgccccctcccgcgcgctctctcgagctccctacgccactctcgtgcgccgccgcacgccggcgaccatccagccgcgcgccgtcaccgcttccgtcgcccccgcactgcgccgcggccacctatagctttgcatcgtcctaccgcaccccggcatccgctccatttcccctccccgcctccgaagcaccgccgccacgcgcaccatctcttcctccaccatcgccaactccagccgcacaccaccgccaccatagccgtcgccgcttcgcgccgccaacatcgccagcttctccgccgcgcgggctagctcggccaccgctccgttttcccctttccctaccgaaaccaccatttcaccgtgcacccgaggtcgccgacatattcaccacctcttgccgccgtccccatctacctcacgccgtgccaccgcctccaccgcattcgctgcatcccaccgcccctcggccgcggctctgccgtggtcgggcgtcgtcggaacgccgttctcgtcgcctcccgtgccgaccgccgccatcctttccgccgccggtcgcctctccgtggtcgtctcgctgtcgctgccctcggtgagcactcctctccccttccctctttctccccttggccggccgcctcccgtgcttgcgcgcgccgtgccgccgccgccggtggcctcccggcccgtgtgccgccgtcactttggtcccggccgccgccgccgccagccttgtgtgcgcgctggccaggccgcgccgcccggccatccccagcagtccgatcggccttggccgatctggaccgtcgggtgcgcggccgcgtggccgatcgccaccgtggactcggtccacggtgggccgtgccgctgacgtgtggggcccgccccctttgtggacgtggtccgcgcctcaccccttgctgacgtcagcgaggtccatttcctttgtaaaaataaataataattgcgcaataaatcgagtttaattctagaagttcatttaaatggctcaaaacttctaaaattcatatctaattcattcgaactccgaattgagccattcaacttgcaaaattcatctaaaattgagctctacaggtttgtttactttttatatactgtttccttggtttttattagagtttttcgtcgttttgcgtgccagcgtgtagttcccgtcgtttcggaagatcgcgttcgcaaggataagagttcagaagatccaagtgaagaagcaaggcaagtcacacattccccttgagcatgttgatcccaatttataaatgttttaccgtttacaaagaaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagaccttttctagtatcttgttgagctgcgtgctcgagacatctggccatgcttcatggtcgtaattatccaactaaaacgcgactgaatggtgggctgtgggtgcatggttttgttggtcgcacccatggcagttaaggaccggttcgcgggatgccctggaagaacttatcgtacttaccacaagccagcgtgggcaacgactgggcttgtaacgtagctttcctctagccgacgcaatcaggcaagggtgggcgtgatggagtttggatgggccctgcgaaggcctatgcggcttccggattcacctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtcccatcttaataaatcgacccaatacactgtagttcaggtgggttggttgggcctgttcaacgtggtgtagcgttgatcagtggagattaaatgttactttaattactcaacagttttactgttttgctcaataaaatgttttacaaccgcctttatgcaaatagccacaaacccctccttgtatccccttgcatgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctggacgtgacaaagcaccaacgccaggcttcagagcaaaccaagcaccaaaccaggtcgccatgacatggccacagccaactttcgacccatccatggcggctcagcaagcatcaccaatcgaagccgggcagccgaatgccatggcccaacctcacgcgcaagccgtgatttcgcccttcaccacgctgtacccgcagcaaggtgctgtgaatagggcagggggcgaaaaggggctactgctgagtcggggaatcaagacccgtccgatcccaccccagttcaagttcccacccttcccacgctactcaggtgaaactgacccaaaggaattcctctccatttatgagtctgcgatcgaagcggctcatggcgatgaaaataccaaggcaaaggtaatacatctcgctctagactgcatcgcccgttcttgatatttcaatttgccagctaatagcatttactcatgggagcaattgcgcgatgtctttgtccttaactttcgaggcacctatgaggagccgaagacgcaacaacatctactcggcattcgccagaggccgggggagtcgataagggagtacatgcgtcacttctcgcaagcccggtgctaagtccaagacataaccgaggcgtctgtcataaacgccgctgcggccggtttactcgagggcgaactcacaaggaaaatcgccaacaatgagccacagacgcttgagcacctacttcgcatcattgatgggtacgcaaggggcgaagaggattccaagcgacggcaagcaatacaagctgagtatgataaggctttcatcactgctgcccaagcccaagcacaatcccaggttgccgaaccaccttctctcgctgttcgccaacctcagccggtgatccaaggacaatcaccaaggctaggccaagcccccatgacctggaggaagttcagaattgaccgtgcgggcaaggctgtgatggctgtcgaagaagtgcaagccctccgcaaggagttcgacgcccaacaagcaagcaatcatcagcagccggtccgcaagaaggtctgaaaagacctctactgccccttccacggacgctcttcgcacaccacggagcaatgccgaaacattaggcaacgtggcaacgcgcaagatccaaggccgcagcagggagcaactgtcgaagcaagtcgtgaagtagttcaagaacaagcacccctagccgaacagcgccaagatgcgtagcgaagagtaatccaagtgattacaagggccgacccgccaagccagttgtccaaacggcagaataagatgcagatccgaacggtccacaacatcacttcggcgggtgcaggggccccgcagtatctaaactagctaatttcttttgggccaaaagacgccgaaggagtaatgttcccgcatcaagatcctttagtgatctcagccgagatagctggcttcgagatccgacgaatcctggttgacagagggagttcggccgatgttatcttcgccgaagcatatgccaagatgggattgcccaccctagcccttaccccagcaccggcctcgctccgtggtttcggtggagaagcagttcaagttctacgccaagcacatttgctggtagccttcggaacgggcgaaaatagacgcgaagagcaagtattgttcgacgttgtcgacatcccatacaactacaatgccatattcggctgggcaaccttgaacaagtttgaaaccatttcccatcacaattatctcaaactcaagatgccgggcccagcaggagtgatcgtggtcaaggggcttcagccttcggttgcctcaaaaggcgatctggccataatcaacagagcagtgcacaatgttgaggccgaaccgcatgaccgggcgaagcacgcggcaaagcccacccctcacggtaggataatcaagatacagattgatgatgccgaccccacaaagctcgtatcgctggagggcgacatgggcaaagaagaagctgagatcatcctagaggtactcaagaagaacattgatatcttcgcctagggccttgatgaagtgggaggtgtttcgacagatctcatcatgcatcacctggcagtcaagccggatgccaagccaaggaaatagaagctacgcaagatgtccgccgatcgccaagaggcagcaaaagccgaagtccaaaaattgctcaaggctggggttattcaagagatcgaccatcctgagtggctggcaaatctagtgctggtgcggaagtcaaacggcaaatggcgcatgtgtgtcgatttcacagacctaaacaaagcatgtccgaaggacgattttcccttgccacggatcgaccagctcgtggattcaacagctggctgcgaactcatgagcttcctggatgcatattccggctatcatcagatccacatgaacccggccgacatccccaagacagccttcatcacactatttggcaccttttgtcacctcaggatgcctttcggcctgaggaatgccggagcaaccttcaccaggctggtgtgcaaggtcctttacaagcagttggggcaaaacgtggaggcttatgtcgacgatatcatcgtaaaaagccgtaaggctttcaaccacgcgtccgacttgcaggagacctttgacaacttgcacgcagcgggtatgaaactgaatcctgagaagtgcgttttcagcgttcgcgcaggcaagttgttgggcttccttctttctaaaagaggcatcgaggcgaatcccgagaaaatcgatgccattcagcaaatgaagcctccgtcgagcgtacgtgaagtacaaaagctcgcaggccgaattgtggcactcagtcgattcctctcaaaggcagccgaaagaggtttgcccttcttcaagaccctccggggcgcgggaaaattcaattggacacccgaatgccaagcagcgttcgacgagctaaagcaatacctgcaaaacccgccaactttgatcagcccagcaccaggaaacgaactgctactatacctggcagcttcgccggtgccagttagtgctgccctcgtccaagaaagagattcaggccaaaaatcaatctatttcgtctccgaagcattgcaaggagcgaagacaaggtacattgaaatggaaaagctcgcttaagccctggtgatggcttcgcgcaagcttaagcattacttccaggcacacaaagtcatagtgccatcgcagtaccctttgggcaaaatactctggggcaaagaagttactggccggcttagcaagtgggcagcagagctatcccctttcaacttgcattttgttgcccgcactgctgtcaagtcccaagtgctagctgactttgtggccgaatggacaccggcactcgcccccgagcccgaacctgtcgaacagccctgggtgatgcattccgatggttcgtcttcgcacaagggggcgagcattgcggcagtactcacttcgccaattggtgtgctgattcagtatgccgcaaggctgcagttcgacacaaccaacaacgcagcagaatatgaagccattcttctaggcctaagaaaggtgaaagcattgtggattcggctctagctaatccgaaccgactctaagctggtggcgggccatgttgacaagtcctttgaggcaaaagaagaaggaatgaagtggtttttggaggccgttcggtctatggaaaagtgcttcaccggcataacggtcgaacatttacttagaagccagaacgaggaggcagatgccttggtgaaatctgctgcttgtggtggcccacattcgcctggcatcttttttgaagtcctatatgcaccaagtgtgcccatggacagcttggaggtcatgacaattgaccaggtgaaattaggcaaagacccatacgactggcgaaccccgtttgtgaaacatcttgaaactggttggcttctggaagacgaagcagaagcaaagcgcttgcaactcagagccacgaagtataagatggtctcgggccagctctatcgctccggggtacttcaacccttgcttcgctgcatccctttcgccgaaggggaggaaatggcgagggagatacaccaggggctatgtggcgtgcaccaagccgcaagaacagttgcctccaaagtgtttagacaaggagtttactggcccactgtgttgaaagtctgtgttgagcaagtcaagaagtgcgaaagttgctagcgtcatggccgaagccaaaccgcacccagtatgagttgcagcccatcgcatcaatctggaccttcgctagatggggactggacatcattgggccgttcctggtggcacgaaacgggtacaagttcgcaattgtggccgtcgaatacttctctcgatggattgaggccgaacccctcggagcgatcacttcggcagcagtatagaagtttgtatggaaaaacattgtttgccgtttcggagtgccaaaagagttcatcactgacaacggcaagcagttcgactctgacaagttcagagaaatgtgcgaagggcttaacctggaaatcaggtttgcgtcggtcgcgcacccgcagtcaaatagggtggccgaacgcacaaatggtaagatcctagaagcactaaagaaaaggcttgagggggcagtgaagggcaaatggccagaggaaatgctatctgttctatgggccctttggacgacccccacaagaccaaccatgttcagcccattcattcttctttatggcgatgaggcaatgaccccgacaaagttatgggctaactcaccaagggtgacattctctgggggcgaagaggggcgcgagttatcgctcgaactcttggagggggtaagagtcgaagcactcgagcacatgcgcaagtatgccacagtcacttcggcaacttacaacaaaaaagttcgaccgacggagctgttgcctggtcatcttgtcctaaggaagaaggtgaacccgatagccgttggcaagcttgaatcgaattgggtaggaccgtacctcatcaaacacaagtccaggacggggtcctttcgactagcgacagtggaaggtgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtggatagttcctctcaatcaataaagatctaagcagcggaaaataaaataaacggcgcagacgactccactccacaggcaacttgaccagcgctacacctaatcctccacaccatcagcatcattgtagaactcttcctctgatgaatgattgcaaggtgagtatatgacatactcagcaagtcacgcagcaaatatgcaagtgcacaaggataccaaagaatggcatagtatagggctcatttgcaaaagcagcctttagcaaatatttgagaattataaaacagttaagtgataattaaacaatattaatccaacgctatacaacataccctgttgcataggcccaaccattctggacaaccatacccggctgtacagatctatctccaaaccaggaatattccattccaaaccaggagctaaacaaattattaccaattaaagcatcatttactatggtgagaagtgtgagactaatcacgaaagacattgttagacccgcccataaccgcgggcacggctattcgaatagttttactctgatcagaggcgtaccactgtacccacaagacacagccccacatcatgtcaccatgtgcctcaataccaccacggtacctcggaaaggagctgtgacaataccccttgcctaacacaatccaccacagcgcaccatttctggatcataatcacccccttataaacaaggcatggactccccagcgacccccccgtgggcttatctccgccacttctcagtctggtgctccgcaatgaaccatgctatacaaaagataaagccgttgcccacgctggcttgtggttggcacgattaatgtttcacaaccgaaactcgtgaaccggtccttaattgccatgagcacgaccttcaaaaccatgtgctcacaacccaccattgacaagttttaattatcaattaattatcataacacgattaaccatcgtgagctaccattaaatataaccataaataataatatagtatgattcatcccattagtgagctaatgtttctaagcatggctaagcaattatatatatagcatttagctgaaccaaaccaatatataaggttctagctaatcaaattataacccacaggaaaataaagtcatcttcggccattaattaattgggaaaggctcaccacccgatgacattcgaaaataatgcataagttgaaataaaacaatagctttaaacaggttcaacatgctcaaagggttgtttgggatctgtgtgacttgccttgctggccttggaactcttcaaattcttctcctgcgaaaacggactctccggaaacgtcggaatctaaacagaaaagagcaaaaataccaaaacagcacataaacaagcatgaacagtacatgtagatatttttaacatgtagatctcaattttagaaaaatttagagacttgaaccaactaaatccgagctaagatgaattagttatgaatttttgaagatttaatctattagaaaaacaggaaaaagaaaaacgatgatgacgtcatgatgacctaatcaatggccggaccaagatggcgacctcgccggagattggatggtcggctgcgactttagaggacatgtacacgtagaggacgacgagacgaacccaacggtactcaccctcgaaccaaacgacgaacgacgacggccggcgacgaggtctagcggcggcgcggcttcggtcgacggtggcgacggggctccggcgatcggcggcttcgggggtcaggcggccgggcttctctaccctcccgcgcaccttacggcggtgacggcgaccggcggcgacggcagaggcggcggcacgacgcggatggagctcggccggcgacgacggcggggtggagcacgtggcggcggcgctacgaggcacgggagaccacgggatagggggcaaacgaaagaggaggactagggggtcctatttatagccttggattgaagagataggactcctcccgcaagaaatcgatccgggaaatcaaaaactcggttttggagataaactcgaaaacgagttcgatccggataagatactcaacgattaactccgatttttgggggtaaagatagaggaggataagaggaatatttcccctcaactaattttagaaaaacacaagagaaaaggccggatttggtggaggaagcggcggctgcacaggtacaggacggcagctcgggcttctgtccaagcttgaagatgaacagtacatggggatgcaaattagactttctgctgggcttctacttccaaggactgattaaaggagggacaaaaagcagactttgggaaagagagggaaagggctgtaggctaagaggagattgggccgagaatgagaggacttttcctaattcggcccgaaaaggaaaaggtgaattttaattacttttccaattaaattaatcactgaaatgatctttgaattgttaaaaataattctattgctcaaataattccaagaaaaatcttgaacatacttggacactcaaagtatttaatgaaattttatctggccctattttatattggaatttattaattaaaattagatcttctcttctaggcttttaaaatcatttctaaaaattccaattaaacaacaatttatatatttaggatttttagggtgtgacagaaggcgaagagttcgaccattcctagaacgctgcctctctcaagcgttttatgtctagaacgagtggcacccaaatcgccaacttgtaaaaatgtatatatcactatgtaaacccttcggcactatgtaagcctttcggcaagaaaaaaagaagaaaaaaagaggaaaatgaaaaaagacaaaaaactggatgtagggctattatccaccacggaagcccgaaccagtataaaatctctgtgtcctccgccttctttttgtttgtctatgtgactgataatttgtggaaaaaaacccaaggcaaacgcctgatcagcgaaaaaggccagggggcgaaacgaatcggcggaagcatcgctcaccgaacgttgaaaccgcaacagcttatttcggggaacaactagccgaacaccgttacactcgatcaaaaggaaagcacgagtgcttcctacaacgtagaacaaaactgatcgaaaacggaagccgaaagctgaaaagtcaaaacctatttcgctaatatacgcaaaggggccgacacgtttcgacccaatgaaagcacgtgaggtgacaatgcaaaaatagcgaaaaggaaataaaacacacctttattgattttaaataaaaatgtatcaaagaatacaaacccgacaaacatggtacaagtgaaaagaaaagagcaatggcactacagcccagcttacagataaattacattttcacccccgggatcaatatctctctctaaggaaaggtcaggcgaactaggttcgtcatcactactaatatcatacacgaccctaagaggagaaggaggcgaaatacggactagactgtaacgacgctgggagattaactcatgccgatcagtcttctgatggtttcgccaaaagcgaaccatatcctctagtcgtcttgtatgaacaaggtcctagtcttctaaggttcgcccggggtgcgcccacatccagccggcgaccttaaacaccttatagctgcggtcgtttatcaccatttcatgataaacatgccgaaatggacatcgcaccttcggcaaacccttcaacgccatgaacttctcgttgctgtttcgccaattttcagcgggaggtcgaacgcaaacctttcggccgcacgcctgctagcaaagtgccaaaaaaggagaaatacaagaaagaggaggggacgaagatcagccccgatttcaaacagaacaattaaataagcgaaagggttatactttgccagtagaacagagactatattaaatacaaggcgaatgcggcttaaagtcgaacagacaaaaagtctatatacaaaaacataggctactagaaggtcagaaaggattaaggaaaaaataaaaataataaaaagacacgagggcgaagggcctcacacctcagggtggtcttggcctccgtcaccttcgcccttgtgcccagtggaccgttccgacggcccgggatccttttcgaagttggcggcagcagcctcctcattcctcgcgatcctttcaaggttctcgcggagtcgaatctttgcacaatcccggccgccatcctcccaaaaccccttccgaaaggcccttaatgcagctccagagcactatgtgttgctaggccattcttccttcacgaaatcgggaaaattcccgatgtggtcgtagctgtgcgtgtgcaaaaggctgagaacgaaccccgccgaaacacgagcgcaacagtcctcgtaggcgcctgccacttcgacaaccaagccggccgcgtcctgcgtccattcggagaaatcgagtgcagtcccgccttcgcccggagcactttccgcccgcgccccaaggtcgttaagggccagccggagagtgtaataggcctccttggcagactctgaggctggtaccagggtcgcggcagtagcatcggtgacgcaagacgggcttcgagggatttaatcttctcctcggccgaagcaagttgttggtctcattcggtgtcccgcttgcgtgctgcttcaaggtcagagcggagagacctgttttcagcattcgccttcttcaaagtctccgccaccacgcgtctttcgtcttccttgtggcgaatatcttcttcggatttacaaagataaaggcggtacccatctagtcgctctaaggcggacttcttggcacttaggtgcacggcaaggccctggtaaaaaaagacatacattacgttagagaactagcgaaagaggaaaattcagcacacaaaaataaaagtcatacccgcacaaataggctctccacagccgcgcagctttcgccgaactcgttcagttcggtgaagagcccaaggccttcggtcggtgctatgacctggcacaccccgtccactcgttcagcggggacgaaatgtggggcggtaagcgtcactgtcacgtcccaaaacgactctaaaatacatcctctaaattatgcctagcataattaaaatccgtgtgaaagcctccaacaattaaaatgtgcaaagttaaaagtcaaataaggcttggaggatttttgtatatttcctaaaagcctaaaatgcgtaaataaattttagtagaattttcagagcacaaataataattattaagaaataaacaaagttaaaatggttttataaaaagaaaagctctaaaaagtcccctttccctccctctccctcttgggccggctcggcccatctccctccccctccctctcctttccccgcagcccatccggccttcccccgcgcgcgcgccgctgacgggtggggcccacccgtcatccccttcctcccgccgctcccgccgcctcgcccgcgccctagcgtcgccgtcgccgcgaatcccgccgcctcccgccgtccccgcgtgcaatcaataggggggaattattccccgtgattccctctccctttccccccacttttccctctctctttcgtgttcaaacgggcggatttgcccccgcaaatctcgccggcgccattgatggcggccggacctcccgcgcctattcctcccccgccggccgccctctcccccttccaaccctatataaacgctccccgcgcctcctccgtccgtttccgcctctcgccgcccttctcctncgacggattcaagctcgcgccgtcgctctctctctccgccgtcgccgtcgagctccggtctgccgtcgtcgtcaccccggaccatctcccaccccggcgtcgcctccttcggcttcgccacatcctcggcgacctcgtccacccctccgtttcgctcgccgaccgccggaaagccgccgtccccgtcgacccgagccgcgccgccgccttcctccgctccggctacctttccgtcgtcgccgtcgaccaagggtgagccgtggaccgccgcttcttttcccccttcccttcccctctctcggccgccgctccgccgtgcctatggccaccgccggcgaccataggggcgcgggcgcgccgcctcccgccggctgtgccggcgtggccgccttcgggcgcaccgtgcggctgccgcgtggggcgcggctgtcagccgcccgcgcccttgggtgcggctgacgcgtgggacccacggcgccggccggtgtgagcccgggtgcgcccggtccatcgtggaccgtgaggctgccgcgtgggccccactcccgtggacccggtccgcgcgcccctctcctcggctgacgcaataaacctttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttcagcttgttatatggagtttattagaataaaagccttttcttttccgttggttgtgtagacgctgcagcttcggaagatccgctcttcgtggaagttgaagccgacgtttgggaaagcgagtaaggcaagtcacatcatccttgaacatattgaatcccagtttataaaattattttgatttaaattattgcattatcgctttacttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggattcacacctccccctctattcaaaaccctcaaaatggttttaggctgggctcggagtgcatggttttgatagtagcacctcagccatataaggaccggtcttcgggcctctgttgcaaagcactaccgtacttccacatgtctagtgggtaaggcttagtttgtggctcagtctggttataaacaaaagtacacggatggagatggacgaagtcaggggtcgatggacatctctaggacaaatgaaggctacacgagctgcggcccggtagtcgagatgtcatggcacagggccggtgtcctgctgctaggggctcagtcttgcctacctgtcccgggggtcccggccgtaggtggggttgggtcggtactcttgtctatggctaggatgggttggaaattatgtcacgtcttccgtccgtataccgtggtggtatgtggcctgtggttacacgtgaggaagatgtgtcttgtgggtaaagttgtacacctctgatcagagtattatctattcgaatagccacgccctcggttatgggcaagccgagcaatgtacccaagttagtgttttaattcttaaaccctgcttaacaactaaaatgtggaatggttggcctgggttggcttgggacgagctaggacctagggtcgggttgccagttcggtctgaatcatcgtaggccttgggttaaggcaggttcatgtgggttcacggccttgtttaataatattgtatagctctggaatcgtgtttacaaaatagctttgagcaactaagtgtcttttaatgctgtttactgcaaaacctaaccctttatatcttaacccccttgtactcccttgcatttatcctgcacttgtgggtgtgtcttgttgagtacggtggttgtactcagtcttgctcaatttttcccaaacccagaagaggagcccttagaagatgaaggctttggtgtctagctcttgcctgccgtcaagcgcctgtggtcgtcgccctagtcttccgttgtttctcgtttgtctttgtgtgtgctgggccttcgctgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacagtcacgtccgaaacgctcgcttcaactgccggggccttccactcctgttgacgaataggtgaggggaccgcatcaacccattcgtcttcagcaacgttggccccagcgtccggggctgaggcactcctgcccgtcgccgcttcggcatcgctagcgggtggcagagacatgcgcctgccacgggaagttgcgcgccgcaacaccggcgatgtagtagtcccgtcggatccttcgctgtcggaaaagccatggccgacctgcacaaccttccctttcttctttttccttttaacagtcatcaccggttttcgcggctgtgctggagatcaccaagagggtgttcgccacgacgatatcttgcggtcgcgtaagtgaaacatgagatcttgccccagatttcgcaggggtagggctgggggtataaccatgagagccatcctcctcagaaccggcctccgcattcttctcttcttcctcctccccatcactttcgacggcggccttgcgctacggcgagttcggacttggccgcctttcgcgaccgcacgcttgcgctttttcgaagtgccagcctcgtcatcaccggcccgagaggggttcgatcggcttggcaattcgccggtatagacatggttcattcggccgtcggcttggcgctggagcaagcgggcgaactcggccgtggttagagctccgatcatcttcaacgcctcaatctcagcgtcttccaaagtccgcactgtgaaaagagaagaacacaaccgtttagcctaaaaagcgcttccatgaaggaagtacgcggcctaaataaaaaaaaaaccttactttcggccccggcggggagaacaaggcggggaagcccaagaacttcttcgccctcgttcacggaaacgtcccacacacgggcgagaggggaaatccgaaggagacaaaactccttgcagagatcccgggtgcttagccgccgggcaaccttgcgaaggagaatgagccgggactcgacagtcccgttgatctccacgtttggcttcgcgttgatggagacagcaaaacgctcaaaaagcagcctgttcgcctgagcatctttggcagagtaggggttgctgatatagaaccatttctgcatccagttcctgtcccatttcgccatcgaagcaagcactggccaagcatctgaacgctccggccgcagcatgaagttcacgcagctgaaaattgttttcctcggacccgccggcgtctgcacgtctttggttgaggcacatgcagtaaacagagcggcgaatagctcggcggtaggggcgaacccacaggtccgacacatccaagcgaaaagcgccagcttcgggaacgccaacgggctaagctggggaagcctaacctcatacatcgaaagcaccgaaggcaagaagttgtcgcatgggaggcgaagcccagtagcgaagtatgcggcgaagacaaccgttcgcccatccctaggcaagggaacaacggcctcgcccccgcacgatccttggccctctgtgagagaactggataataccagttcgccaaagtcggcctctttgacaagtgacttgccaaggaagcacgaccatccttcgccaaggctcctaggatcttcaccagttgacccggccttggtaggcttgcggggagccattgggctcgtagaacaggaaagagaggtaaaaagccgaaaggctaggagcacgacgatggcgaaaaagataaaaaataggagagcgaagagagcacggagcgtgtcaagtggtaaaacggggagagcacggggagagtgaaaaatggcaggccggtttgggggtatatataaccccgtagcgagaccgttcgcctgccaaccaattgtcataccttaaaaattcaaaatatataaattgttgtttaaatggaatttttagattttattttaaaagccttgaagagaagatctaatttttaattaataaattccaatataaaatggggccaaataaaatttcattaaatactttgcttaattctataattcctagatttttctgggatttatttgagctaaggaagtattttttaataaatggaattgcatttaagaaataatttaaattgaaaaaggttttaaaaagtcttcttttggctttgggccgaaagtcggcccaaaacctctcttctctctctcctcggcccagccggcccagtccgcagccgcagccgcccgcgcgagcgcgctgtcgctgacaggtggggcccacctgtcaggcccgtcgtcttcctccgcccgaaaccctagcgcgccgccgccgccgtttccttccaaatccggccgctcctttccatttccggccgaattgatagaggggaaatgatcctcgggatctcctctaccttttctcttttggaaacatcggctaatttgttttggaagttcgtggaatcgagttcgattcggatcggtctctttcctccgaaccccgaagtttccttctcgtcgccggtcgccgtgggccttcgccgccgcctcttagcccctttaaaagcttccccggtttctcctctacccgccgccaccctcgccttcgcctctcgtcgtcgaaaacgccctagcgccgtgtgccgtgcgctgccgccgttccagtcatcgtcgtcgctcgggaagatcaccgtcgtgatcgccaagtcgccgccgtcctcgtccgctccttcgccgtcgccgaagatcaccggagcaccgccgtcaccgtcgacctgaagaccgccgccgtttcttcctcgtcgtcgtcgccgtccgttggtcttccgccgtcgttttggtcaccggtgagttcgccgcgtcgctttacccgttggtgtcctccgttcgtgccgaagcgccgccgttcgccggcgacgtgcgccgtccgagccgtccgagccgccgagccgccgccgccggtggtgacgtcatcgccgacgtcatcggggccgttcgctgtgagccggtcgtggaccgatcgatctcggccgtccgttttggatcaaatcgatctcggccgtccgttcgcgtgaaccgtcgcccgtgcgcccggtccaccgaaaccctagcccgctgacgcaataaatccttttttccttttcaaaaataattcattattgcatcataattcaattaaaatcaatttaagtgttttaatccagtttaatctttaaaaattcataactaattcatcttagctcggatttagttcgttcaagtctctaaatttttctaaaattgagatctacatattaaaaatatccacatgtacttttcatgcttgtttatgtgctgttttggtgattttgctcttttctgcttagattccgtcgtttccggagagtccgttttcgccggagaagagtttgaagagttccaagaccagcaaggcaagtcacacagatcccaaacaaccctttgaacatgttgatcccatttaaagctatggtttctattcaactattgcatttattttcgaatgtcattgggtggaattaacctattgtttgttatagccctttttgatcttgattactttgttccttgataccttgggttattataacttgactagttgggctgtgtatactggttcaactagatattaggtataattgcttagccctgcttagaaacattagcacactattgggataacttatgactcactattatctaatgatggcttaatgatagttcacgatggtcaatcgtgattgattaattaattaatgtgccaactaaaacctgataatggtgggttgtgagcacatggttttgatggtcgtgctcatgacaattaaggaccagttcacgagtttcggttgtgaaatattaaccgtgccaaccacaagccagcgtgggcaacggctttatcttttgtatagcatggttcattgcggagcaccagactgagaagtggcagagataagcccacgggggtcgctggggagtccatgccttgtttataagggggtgattatgatccaggaaaggtgcgctgtaatggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttaagggcgggtctaacaaagtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaatacttaactgttttattaaattctcaaatgtttgttaaatgctgcttttgcaaatgcaaccctactatgccatcctttgttattctgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtctgcgccgtttatcttatttttccgctgcttagatctttattgtttgagaggaactatctacctctgtaatgacattatattcgcttattaattagagtaataatggtactctattatcgatttattattgtgtgcctcggctgattcctggacgagggtttacacacatgtaagcgtttggaattttggatagaaattccgggcgtgacaccaatcgagctctgacacgtgtcaaagggcagacgaaacggtaaattcccatcggaacggtgctgaacagtaaaaagcccgattacggagaaggaaaagcccatagggcccattactattcatagtaataaaagagactaaataaccccccttcgacgttttgcaacgaatgcgaagacgagatttctctcaaagaaattttttctaagcatagaaacaaacaaactttacttgcaggaatgatattggtttcggcaggagcaccggtcgaaagggggcgccacataccataccacatagtttgcacggtctcggctgaagctcctatctcaccattgcccctgaggggcttgttggcgatatggcatgaggcccttcgaccaaacctgccgaaagcatgcgactgatggggattcaatcctgagacgtcatggctagtcaaggtgaaacccccccctcccatggcgaagactatggagcaaggacggcaagaggcagggaatcgcagccaaactagaggcctcctgggcgaagggcgcaaggcaaagggcatatgccgaagggggacgacttcgccgtagcaggttcggccccgggagggccgaagaagctatcctggcccatcaagcctaggggtcaattgggtcgacaataacccgtcggcctgctaagggcccatggaccgcaattacgctatgtacccatgtaaatgtccctttcacaagggcaaccatgtaaattcccctgtataaccaaagccctagtagtaagacctgtaatgggggctataaatagccgcatagggccatgtaatagggggatcccaagtaaaaattctcaaattaatacactttacttcttttccaaccactgttgagtgaccacgtctttcgacgtatgcggttgtcgtttcgacaacagcctcctcacccggttttgcttatttctatagaacagaggtgttggcgactatgaacgccaaatttacgctgtcaatatctacataaatctaaaaagataaaacatccaacatagtgatagggtttaactctaatgatgtccactagcgttggtgtatatttggatgcaggtaacaaatcatcaaagttgagacaaaagatatataaagacagaggagaattaaacatccatggatgcttaggatctccatattcctaaggcatctctaggcctttaaataccgctcctcttcctcattcacaacacactaagcatgagctgaattacaagaggcactattgcgctttattataaactagattagggagcgagtaaggtagaagaactcagaggaattccggagttgtcagtaatcttctcttactttatgtaccttgttaattactctaatttaatagaaatattcttttgagtaatcaagatttactttgtgagaattatatcttagctagttcctattagcatattggattaccgtcactagtaatagtgttactttagtgtctagctaacattacagtagtacttgacattgtagatgtggtgtctatagtatttgagtacctgtagttgctgcgtatcccaaagttcgttagaggttggtgcagaggtagtgatagccctcaagagcaccgcaatcctccctgttcaagtacgaagtagagcgcgttctggtagcaatgagcaagtcagtgcctgaagtagtgctataggattaaacaagctttctgtagacacagtttctcactaggaaatcctctctatcatttgcctatcattgctttgtgtccttggatgaacctggagaatagctcagcacacacgttcctcatggaaatcgataccttggaatactcccgggtgaagtactacatcggtatattcgtgagcctgcggattctatctgtaacattaagaaataccaacaagcatttctggcgccgttgccggggaacggttgttgtttatctccgaaccttgttcatcctcgtatctttttagttttcttttttctacctctacccctgctacccctagagaagttttcctataaacaacttctttaccttggagcaacaacctatctttagattgtctgctcccacgggcgaattctataagccgcctccgtcttaggaaccaattccatccaccagctatttattccgccttggcttaatagccataggttaggaacgatccctgtcggacattctcgagcgtgagtcattcgagaaggtgatgttaggtatctctgttcgtttcatctaaaccttttttccatcttcctgaaaccaaacggccttcatcgccctcgatcgagcctaagccttgtcactctggccatcggaatgttgttcttattaatcatcaagaaacaacccgaatcttgcacaatacatctcttggaaaggagaaccttcaggtcacggacaagcttgagacatcgactcttgaggatgaaacaaaacattccacaaatgagtatgaaaatttctttcaaaattcccaaagattcacgctcgcataaggaatcctcagagtcctgtttgattagtaccgcttatctgtgcgaggaccacatccaccttacagtcctcatttctaacatgtttagatgggtggttgttgatatttctcaacgttacagatagaatccacaagcgcatggaagataccgatgtagcacttcacccgggagtattccaaggtatcgatttccacaagaaacgtgtgtgtcagctcttcaccgagttcatcgaaggacacgaagctaagataggctaagggtatagaggatttactagtaagagacagtgtctacaaaaagctcaatttaatcctaatgcaatactttaggtgctagctagcccgctgctactagatatggctctacaacatacccggacagggaggactttagtgttttgagggctatcaccagctctacacccacctcaaacctactgtggttatacgaagcaaacaccggaaattaactacccagacaccatgtctatgcagcttaataactactttagtgttagctaaatactaaagcaaccactatattttactgtattatagtgatcagtgatcccgtatgttgattaggaacgaactaagaggtaactctcacaaaataaatcttaattactccaaatgatatttcaattaaaatagagtaattaacatagtaaaagaaaaaagaagaggattaccgacaactccggaattcttccgacatcctttactctactctctccctaattctagtgtacaataaagtacaatagagtctcttataattcagctcaagcttggagtgtatgttgaagtgaaggaagtgaagcctttatataagtaggtaatgacggttaaaaaggtcggtaatacactccaaccgtcattggggataaatctccaccgtcctccaaaagccctggatccaactgcgagcaacaaggttcggccgaacctaggctaggccaggcagcctccagccttagcgatgggcctattctctgataattcgatgaagttcaaggcccactcttggatagataaaagtattccttcactgaagtctggttttcatcccaactttgatggtttattacctgcatccaaatatacaccaacacttatggaatatgttagaattaaaccctaccactatgttggatgtgtcagttatgatgtgttatgaatgtattcgcagcatagaattggcatttaacggccgccaacagtggttgtgaatgcttatgtttatcctaaatactacaaaatctcgtttttattcgtggcactaatcttgcagcatgatgtctccgtggtcaagcttgtgaccataaacaaagcgctgccgggagatagcccggattaccgtggtaagtttcctttcgaatagaagcaagacccagttcttaggatagtacgcacctttgggtattcttggttcctaactatttcaggttgagattaagatagagggccatgcgatgcctaagaacacggtagctacatcaactgtacactttgatgttccttggtattagaacacactctatagaagacttcgacatcatgcacttgatttttgatgtcttgcgacacaaaagtctaagtgtgggggtgttggctgctgttaaatgccaattctatgccgccaatacctacataaaacataattaataatacatccaacatattggtagggtttaattctaacgtatttcatgagtgttggtgtatatttggatccagttaatcaaccgttaaagttgggatgaaatccagtctaaagtgaaggaagaattctatccatacaagagtgggccttaaactttatcgaaacatcaaaaaatggatccaactacctgagaaatggataaggcaggctgagggagagacacaggccatgttctacgccttttggaccaagccagggttcgaccgaaccccagtttctgccattcgagctagggtttggcatggatgctccagatgctctccggatggcggttgcggggcattttcgacaattcgcatagcagtaaccgtcatacctgtctataaaaggagttcatcacttcacttgtcacacacactccaagcttgagctgaattataagaggctctattgtactttatttaatactagaattaggtagagagtagagtagaagaagtcggaggaattccagagttgtcagtaatcctcttctatttcttatactttgttcattactccgtattaatagaaatatcattctaagtaattaagatttgctcggtgagatttaattcttggttagttcctaagtagcgtgcgggatcattgtttgctaaagtagttattaattgtgtagacgcggtgtctgggtaattaatttctggtggtagcttcatatcccacagtaggtttgaggtgggtgtagaggtggtgacagccctcaaatacattaaagtcctccatgtccaggtacacagtagagcgacatctgggagcagcgggctggccaatgcctgaagtatcacgttaggattaaactgagcttttcatagacactgtttctcactacgaaatcctctctaccctttgcctacttttggttcgtgtccttggatgaacttgaagaggagctgaacacacacgttccctaaggaaatcgataccttggaatactcccagttgaagtgctacatcggtattatccgtgcgcttgcggtatctgtgatgttcataaataccaacagggggaaggccaacgagcttggcatgacgagttccatcaaccaaggccatcttggtttcaagttggtgttagtcttaccatgctaaaataaaaagaaaaaaaagagagatggaagaaaagaataaaaaggatgagagaagaagaaaagagcaagagacctgacgagctacatttagatcaaagaccgcattatgtgagtgcctttaaaatatggctatacacctgactagtagtgatcatgctacctggcttcacccaacccctctcttgagctcatgtgccgctttggtttagccttcatctactcctacccgtgcacaacttcttgctcccgtagcaccaatactgcaggaggagatgccctcttcttttctggtgtttgctgctccactccagttggcacttgcacattgcctaaaaagataagcatgctatatctctacagtattgtgccaacggttcgtgccttcaaggcacaaggttcttgcacctgaggtgcgtggataaccaaactgctcgcctaagttggcatggtcatgtgccttcctccgctacaatccgcatcaagatggaggagagatccataatcatatgtgaccatgtcactgcccgagagattccaatatatccatcatgctggcaggtaagtacactcaagtatacaaagataaaacaaggttcgccaaacctttactcaatagtacaaccatgtgaatatctcttgatcatacatggttatgcttcctttgtctattttcgtatgctctggtttgagtgtgctacaggcattcataggcttttcaagttaaccatgatgcttaggttaaatagtccgccttaatcaattttgacgtggtgtcaatgcaccgtagagcgggtacttttatggacttcggatgtatgtccttcgtggactaacccctatagaaaatttttcaaattgacgggtcagtgctcaagttcaagtcacactagaggtaggtcagggtcgggaacaaatcaattgctaaggagaaacctatcacctctcaaggtgaacgggaataaagtgacaactaaggagcagtgtacaataactccaacaccaataccacgcttcttggtcttataggaaaatagatgctcagggaaccaagcagaacaaatgcaaaactttgttgcattaacccttgcatttggttcaaagcttgataagacctatcaggtaagaaccccaaacactttatgcatcctctatctctacccttctaagttacccataacctccattgttgccatgagataaaaaggcaaaataaaatgaaataaaagtaaatttaggcacttcttgtgcgtagagttacttaataaaataaaggcgtgcctgtgtttcaccccggtggaagccattttgctttctatgtttttgttgaataaagaccaagtacaaaacaagtgtgggggagtcttttcggaagtctcgacgcgcaatggcatcaacttaacatgtcaatatgatgaacacaggtccacgaccgcacacaaaatttagtagccagaaccgagtccttgatgggacggctgaaccaagtgttcgcttcatccctgcctggcccggctctgccaccacatcgtcgtgtggtcaggtctgcgcgtctccttccttatcctcccttgtttgtgagttaaactttggtagaaaaatggaatacaatttagtttgactccaaatgaaaattgaaaacaacaactctcaagaaataaaattttcctatgattgatcatgtataccttttattctttgctaacactggtcacttgtgaacacacttctatcataaggaaccttgctcatctatataatttataattgtgatatggttatgacaaaagaaattctggtccaactatcatgatacttgagattttatctttgtgaaaattaaaatttttcgagcaatacttcaatgactacattatttcctaccaaggcgatatatgattttcattgaaaaactttatatatatctaggctgcttgtcattacattgagctttgtcaaagtattatgacccgcgtgagatgtttttcatattttcatgatcaagatcacacacacactccacatgcacacacttatgctaaacttctacattggaaactagcatccctcatccatcatttattatatccgttatccataaaataaatactccatcttatttatgcctcttgctccaaaattctttcaaggaaaaaaaagagagaggcatggctatgcaaaagaaggaaaaataaagtcttgctcatacaaatatggagcattgataaaaaaaaagagaaaacacaatcttgctcatacaaataaagatagccatgtactttcccaattttctaaagagagaaatatgaaggaggatgtataccgaaatgagttgttatatttttctttttccatccacatacacatatacatataccctgattgatccctaccgagctccacatatatagccttttagaatatggacgattcaacaaaatatgcctcggtgaggatccacagatcaaaccacgttagtgatttgagagaaagtcatgatcaagactgaaaaaagagccgaaccgcgatcgagagcgcgtcttcctttatctctatctctctctccctcaatccccggcattatccgccgcctcctctctccctctcgccacttcctctctccctctctccgcctctctacgcctcctcctctctcctctccttctactggcgatggaagcgcgcgacggtggcgggcggctattctctctgcccctcaacggtgggggccggagcgcgtggaagcggtcgtctgccgacggcgccgtgtcgcgcgccaagctcgaagccggcggcgccaggggaagaggccggagcgtgcagaagcagtcgtctgtgaaggccacatcacggaggttggggcagcacggggaggggagcgggagcgggaggagcaggtccaaggggaagcagttatcgagcaccttgccgacgatgaggtcaatgtgaatttggaatttggaatttggagatctttgaatttggataaggtccattcgaatttggaatttgtagatctttgaatttataatttggaatttggattagagagagagcaaatgtattgctgtcggtgtgaagtttgactgaatattgttgttcagtttgcaaattaaaatgcttcattgcagcgtatagttttgtatgatgatgagtggacctttccggagcaacttaaaaaccagcagcgaaaagtaagaaaaaaaataactctagtccctgttagtgttaccaaccgggactaaagatgggtatcttttggtcccggattctgggtcccggttagtaacccgggactaaaagcgttgcaaatcgggactaaagttctcttttgcagcagtgtatggtagtaatttttaaagttctcttttgcagcagtgtatggtagtaatttttaggaacaagaaaacaatataaatcctaggtggcacttattttggaccaaaacgcacatggcagtcatgttgtttcgttcgtatgctcattttttcaagttattgtaatgcattgtatccacatatatatcaatttgttatactcgaaacacaatttattatatattaattatggtattttagtaaagaacaagttttactggtctaacagattgcaaactactatatatgccttgtatttttatacggagggagtacgtagttctgcaacagtactaacatagcaagaaataaaacctgaatatgttggagacaaattgtatgcatatggatgaaagtccgctttagggatgaaagtcagccacttgcgatcgatatatcttagctactgctggtgttgcttgatagagataagtgctttgaagataccgacgagcacaccgataacagagaacaccgtgacgatggctttgaagttgttgtagacgaacttgtgtactgggatcaacagccgcctcttacgcctgtaggcctcaagctccgctaagatgcggaagtagtcaagtccgacgaagagctgcttgacgaggttcttgaagaactcgagcgtctcaagatcagagaacccgccgcgtacgagtcccttggctcgcagctcgtgtacgtcctcctcacggttcatgagcatcgcgagcagaagaacgtaggagctgagatatcttcatcacccaagccagtggtgatggaggcctcaagagccaccatgttgacaagccagcacgccttgaggtcatcgatgaccagtggcgctaggaaaattcccccgaacaggcgaggggctccttcgtagatgcccatgtccttgagctgtgacgtgtcgttggccacaagctggatgccgatctctgcaagctcgatggcactgctagactgtggcagtgacgtgacgccttcagggaggtggaggtccgtccttccgatagggatgctcccacattggtagtaacggaggagaccgaggagatgcgctggtgtgtagctgccgttgaggacgagaggccttttaactaggtctaaccgggcctcgaatcccaaacctgctcgagcgataaaatcctccacgtccagcgctggcttgaaggacatgagggtctgaagcaccagccatgggatctggttctccatcagaaagatgtcccgcaggatgctggctagtttggagttgaaccaaccttgcaatgacggagcaactagcccacctggactgctacggatgaaaatcataaactgcagcaagaaacagccatcccggaacatcatagctgcaaagtcggcctcacagctcatacctgccgccgtgtcaccaacatagcagcttcgcacgttgcctgcaacggagaggattttctcgtaggccgcctcagccgactgcggcggatcagccccctgagccgagtccccccagtccctccagaagtagtaggcagccgctcgcttcacctcctccgcctcctgcaggtgcggtaaatcgtggtggtaagggccgatggctactgcgctcggtaccaaatatcggccttctttggtaacgccgcgcaggtttgctgggaacctgtggatcttggtcttgttctcggtgaagttagcctcaaccttttcggctgctctcttcaactcctcttcgaccggaattactactgcttctgcagtgcccatggccatgcccgtcatcgtcgtttgattggcggccaccagctgactctgctgcccgcacctaggaaatgagcgatagagggatcgccgtctatggtcgtggagctggccctgcttagagcaagtttaatagtatagtcaactcactactggaaaactgatctttgctcggtcgccccaaaaccacaatagttatggttaaaaaagaaccgggactaagtcccggtttaaaatccacagccattctacgatctttagtcccgggaataaagtgatctttagtcccggtttatatcctgtcagtcccttgtcagaggggcgggaatctttagtcccggttgatgtcacaaaccgggactaaagatcaccactttagttccggttggtaccaatcgggactaaagatctcctagatctttactcccacgcgtagtatattatccctattccctatcatcacccctacaaccggcctcaatctccttaacaaccggcctctcctctgctcagatccatctccctctcctccccctcctccccttcctcctcccatcccggccctctcctccccctcctcccttcccatccgatgcccagctagggccgcctcctccccctcctcccttcccgcacgcgtcaggcggctgacggggccatgctcgccaaggctgcgcctggcggggccgcacgcagcaggcggccgcacacgggccgagtagcgagcggcggtaggcggcgctaccggtatctattcttttttcttttttttttacaatttgtgattcactgagatgtataattttgtgatttgttgtatggatctgagatgtataatatgtgatgtatttggtttgtgtgtatttttttaagatttgtgatgtatttgatttgtgtgtacaagtaacttaagatttgtgatgtgaatgttttgggatgtttgtttgatttgggagtatgcatctcactcgatttgtgagaaaatacagggattaaactccgcctaaaaaaacaatgaaaaaaaaaagaaaaaggagacctaacgggactgccgctaccctctcatctttagtcctggttggtgttaccaactagatctttagtcccggttatttcaactgggactaaagtcccggagtgctagtcccggttccatctttagtctggatctttagtcctggttatttcaacggggactaaagatggattgctagtcccggtttcatctttaggcctggttggaaaaccgggactaaagggggttaccaaccgggagtataaatggtttctccaccggtgactactaaccccaaatcatttatagtcaatttaatagccaattcatataatagttacttactgcactactaatatctgatatcacctgtcatatatacattgcatcttgaagtctgtgctgcacctggctagaaatctctagccactgctcttatctcttctcttttatcttcttaaaatatgtttatagctgacttatagtctgctattgtacctgctcttacaagctaatgctacttcacatgggtactagtatattttagcttaggattggctcaaaagtattatccgaaaaaaaacaaacatattatcccctctatctctctctcatatcataacacattttggcttttattttaactcaaactttcttaagtttgactatactgatggaaaaagtagcatcatctataacaccaaattattatttttcagctatgagcatcttctaagactaggccatcatatcttaagactcacaacatcatcatagatgcctcaatatcgagggatacgtcgcttatcattaaaagaataattagctataaataatagtatccataccaaatccaggatatgcagtcgggtagacatgtttcaccataaggaatctaaccagttgcgttacacgcactttgccaaattagtgttagtagatctaatttcaagtttattttgataatgtatttatttttgtaaaaaaagtattgaaaatgttgctatgtttcttctcaacccatgatgttgtccttcgtagcctaatgctgattataaagctgtacaacttatcaacaacaataatctaatttacgagtaaaaaaatttatatacgtacccttagcgattgaaaaagctaaagttgaaaaataaggtacaatgaagaaaatcttaaaatcaactccataattatgttgaaatttaaattttgatagcagcttataagttgtagagcaaacgacggcaaagtatcagggatctattatatactaaaagtccattaagcatcctataaacgcttcgaagccgccacatggcgcttttacaagcgttcctaggccaccatgtggcattctataatcccaccatcgatttccatttaaatcggtggacccattattttataccgtcggattagatctatttaaaaagtttatgctttctatatccgcgagcaatttatcgaaaatactgtatacatgaaaataattacgtactatggaaatacttacatacgtgtacgtatgaaagtacttacatacgtatatgaaactttaggtactgtaaattaaaaaacaaacaaagaacgtacgtgtgtacgataaaaaaacctatagagaaaaaacaaacattgataaactgctcacttgatggaaaaatacaaaggaacatgctataaagccctaatggaaaatatatgtacgatgttataaccatcggaaaaaaaatagacggttttttaaaatatcatcttctatactataaacaataaaatttattactctacaaatatagccatgtggtgcttcgataagcgctcttaggccatcacgtggcactgtataatctcacgtagcactatatttaaatttatggatatgttattttataccttagcccgcttcctgttaatatcatctattatatattgatagtccattaaacatcctacaaacgtactcaggacaccacgtatcactcctacaaatgctcctacgtcgccacatgacattttaataaattagaaaaatcacaaaaaatttgagaataaataaaacatttggccatcgattttctgtaatatacgatggacccattgttttctactattaaattatttgtccaagtaaaaaaggaataccacctatttcctttctctcctattttcctcttttagaaaggtggaaaatatattttttaccaattattttttggcattggatttatttagccaaaaagaaaaggaca

SEQ ID NO: 64977 - DNA, 1643 bp, Oryza sativa
tatattgctaattatatttttctatggaatcacgtattggtcagcacagaataatgtacttactaaaatagtgaatatcaataaaaattgtttaactaaatttgaatggatcttgtgtcaaattaattagtgatatgaggaaatttgagccattttctcgggatagtatttgtcttgttgtatgcatttgttcgttcttgaaattctgtgaatgattcgtttttacttttccttttcaagtatgatcatctaaaaaaaataaaaaaaaatacaaattaatagttcaattacgttttctaatgccattccccctatactgcaaagtttacaatgcatcacatacatatttgagaactcaatttgaaatctttaaacaaataaatgcagctatatttttgttaaagcacaaataatttagaaaactatgctagaaacacatcctaaaactaaacatatgtactccctccgtcctataataggtgacgttttgactttttatttgcaacgtttgactattcgttttatttgaaaaattagtgcaaatataaaaaaagataagtcatatgtaaagtacttttgataataaatcaaatgataaacaaaataaataataattttaatttttttttaataagacgaatgatcaaatattgataaacaaaaactcaaaaagacaagtaatatgggacggaggtagtatataggaatatcgatagacatataagttagttagagtacctatggattagttagactatacaaatcgataaatacctatgtaaaacagaagggatcttcttaacggcaaacggaattagttggagcaaatcgacgggtaccttcttaattaatgaagcaatgatcaaacatggatttcttaggtacgaccggacttgtcgaagtgtgggtaaatatttcaacacctgatcgaaattcatacctaaatgaatttgagccatgctggatgttgcttcagaagcaaacatgcatgtaaaaaacaaaattagacagaagaagatcaaacctaatcaaatcgtgtcgctgcctaagagaatggatgtgcttgcccagacgtgatgggtttgtgccagcagttgcggctggtcctctgatgcagaaggaaaaaggactcccagcatcacctttgcgtgacgtgagaacgggatgccggagagaacggtcatggccatcgtctgcgcagatcgtcagattggttctcaatgtagcctgccatacgcggatcaagcacgtgcatcgcaaagatcctccgtctgaagcaacatgagaatagtctcaagttgggcagtagaaaggtaccacctccgtctgattttaagtgaagttgtattctccatcttatttaatttttttttatgattaatattattagatgataaaacattaatattattttatgcgtgatttatttttttattttttcatattttttagataagacggacggtcagctgttaggcagtaaaacttataattgcatttaaaatggaattgagggagttgatggtattgcatacttgcatgagctttttataagtaacaagaaaggtagcccatgcatttgcgcgggcatgtatcgtatgctatatttgatgaatctataaatgtgaaatatcatgctttaa

SEQ ID NO: 64978 - DNA, 4362 bp, Oryza sativa
cattgttctaggagaggtcacatcccaaacgtctaatgggcgatcgatcacccgacccatctggtagcgatcagatcccctcccccctccctccctccacctggtttccttttttggcaccgcattactttcctattttagtaaatttatgcatctaaagtttaaacacctcaagtttacacatctaaagtttagagacccaaagttcataagtcaaaagtttatataaccgattcaaatttgaatttaaatttaaatattttctatatatagtatttctatacatctaaagtttatacacctaaagtttatagacccaaagtttataagttaaaagtttacatacccgtttcaaatttgaatttgaattatatctgattcaaatttaaatttgaattcaaatattttctatatatagtatttttatgcatctaaagtttatacacctaaagtttatagacctacaatttataagtcaaaagtttacatacccgattcaaatttgaatttgaattatatctgattcaaatttgaatttgaattcaaatattttctatatatagtatttctatacatcaaaagtttatagacctaaagtttatagacccaaagtttataagccaaacgtttacatagccgattcaaatttgaatttaaattcaaattttttatatatagtatttctatacataaatttttctaactttttttttaaaaaaaattgtgtggtgtattgtagtaagaagagaagaaggggagaagaggaaggaggtattgcctatagaggatggggggatcgcccattacaaccccgtcacatcccctcctagttttttttttttttgacggagggagtatggtttatgtgattcaggctggagctggatagctcgtgtgtgttgcttacattattgttacagtttgagctcagttttccattaatttgcttttgaagactcgtttcttagtctgatgaactgcaaatttgtacactcctccaagagtatagaatatcgctccacaaatttttttcttctttttccggcgcacacaggaggaaagtattattttttaaaaaataatgatataatctaatggtctaagatatcgggtccaccaatttaagtgaaaatcaatggtgagattaaacagtgccatgtggcgatttaggtgtatttgtaggagtgccgcgtggcagtttgagagcgtttgttggaggtttaatggacttttagtagataatagataatagatagaagattattgtgggtgggctgtaacttgagactattctctggagatgatctcatatattgaaaaaaccggatccaactttaaatatagagggcattggctccttttattaattggatttgtttagaagtgaaaagggacatgacaacagttcacccccatgttcctttcattaattgaatttttctagaattgaaaacggacatgacaacaactcacctccatgttgttgatgggaaattggatgtctctttctaaaatattgctatgtttatctttatcttcaaaatatattctccgcctacacactgcacccttgtcttgacaaattacaatcatctctaatttaatttatctatttatctttcctattttattttatccccttccttttaaaaagtctaaagttaactacttcctccatctataattttagcctaataatttataaaaaaaaatgtacagtaaaatgtactagacatctataattgtactttattttgttcttctcgttttaggcatcaaaccttactccctccttgttctctctctttgtttcatctccgtgttaattagttaaagatacggtagctttttaatgtcctgcttaatatattttgattagctaaaattatcgtcttttgtgacacggacgtatattttagaatgatgacaataatatttatggaacaacggatgttgacggtttgaagaacagaggtggaaggcgccggcacaggctcttcgtcagaggtggacgaggcgtcggaagcgccggagctgtgcgacatggctagcaagggagaggtagcggaagactaagatcagagggtcactgataccatgtagaaggagatttggatcaaccgtaactttcattgatcaatggagcttatatttatacatgtacaacaaggcttgggagttgcctgggcctaactaatcccctgatctaagggacgtgcagcggtgcgagcggagcgaggagcgcggcgtcgtgcgcggggtgcgcgtcgtgcgcgtggagcgcgcctcgagagtctgacgaagccgttcgccaacagatatcttgaacaaaatcacttatacggtagctttttatgaaacttgcacttgttaaagacacttcttgaaataggacgcttatcaaaagtgtttttcggattttctctttatattataaggctttggtactagtcaattcacaagttgataccttgattataaggggcatgtatgccatcacccaactacagtactgcccaccaagtggctgccaaggtgacctgtcccggccgagtcaaccggtgtgatggaataataatttggttaatcaattcacatgttgataccatagtaaggagcatgttaccgtagtaaggggcatgtatgccatcacccaactacattactgctcaccaagtggctgcccaagtgacctgccccggcctagtcaaccgatgtgatggaataataatgtggtttcgccgtacacaagttgataccctaacggtaaggggcatgtatgccatgacccaactacagtactggccaccaagtggctgcccaaggtgacctgtcctgtcctagtcatcgagtgtgatagaataataatgtggtttcttcttcgatgagaagattcttttgagaggatatcctctcgtgtaactttttttttcaaatctatccatctactatatactaaaagtctactaatcttcctataaacactctcaactcgccatgtggcattctacaaacactcctacaccgccacgtagcgctataataaattagagaaattaatagaaattctaaggaaaatagaaaacatcgtactgtaccattgattttcatttaaactgatgaacctattattttagaccattaaattattagatctataaaaaaataatatctctctcccagtatacaattgacgtacgagaggaaatccttgcttacaattcatcgtcaaaaaaaaaggcaaaagatatgtcagggttatagataacacatacccaatagtagttgactaagctcggcaggaccaccataataccaagtcttatacgaaaccataccttgtatatagaagaagttcgggataaggaaagacaagtagagttctacatgaaaactataaggaccatcccgatcgtatccatacttatctccctagttctatttgcacaatgagacatctatgggtataaatgcaaggccccctagaaggagagagggacatacataccaagacaagcctagacaaatcaacaagctcagtcagaatagacactaatacacatcgccagacatcgacatcagagatcagtctacacagacccaatttggtgccatcaaaggccgacaatagggaactagtgctttctctaatgttaccaagtacgtattcgaggaggaagattaccccaccgttcactacgtgttggtgctccatgccaccaagtcgacgacgactaggtaggttatctcaaatattgtgcttgcgtaattctaaagaataagagcaacatcggctttggtcaacagtgttatatttaattgggtaattgatccatttaaatcaattaaatcaaataaattccaagcctcattatgttaggaattcatgtgcattcattctcttatgggatatcaatgggatgaggagttttcagaattaatccatttgattagggaattgataacttatatcaattacgcctaattgatggatggttgatgcttgtgtagtggaggatggttcatgactagttaatgacaattagttgctctattccttttcctattccattggtaacctacatcaattactcataattgatggttggttgatggttgtgtagtggaggatggttcatggctaattgatgagaattagttactcttttcctctttctattccatgactcttactcttcatcttccattccacatataaaatgagaatggatttgatctccctaagaagaagtcagacacactttcatccatttccaaggctgttgctgctacggtaatcccatcccgaagagtgcgtgcacacacgttgggagacttggtctctgaaaccacgcactgctg

SEQ ID NO: 64979 - DNA, 1897 bp, Oryza sativa
cgacgaagcacggggaacacctcattcgaacgaacgagtgaatgactcaacaatggctgcggctaaaccggtgggctagacacgattcacggtaaagccccggtacgacaaacgataggccggtaggaacctagggttgcacctacggctagacaactcaattaccgagcaacgggttaaagcgacggctaggtttaagcggcacacaactgtgacacggcacggcagcagcagcacagcggcgacaaggcaattagcaatggcggcacagcagcggctactcgatgacacaaacgagagattaaaacctaaaccgagggaacagagatagaagtctcaccgaagcaaagcgattggagagggagagatgacgacggcgacccggcggcaacacacggaaacgatgacaatgctagacaagcaacggattagattgaatttgatctagggtttaggtagacgtggcaatgataagacagccaagcgagatctccggataacgaacacaggaacgacgatcaccggcaaactacggagcgacgataaaagggaggacaccgggagaaagagcgcaaggcgacggtccttaccaacacttacgagacgacagacggcgacggaagatggccggtgacaagcttcgaagggcggcgaggtactgaccacggcggctggagcggcggccggaggtggagagagagggagctcgcagggagagcgattccggcgatggaggaagacgggacttgagaggataggtagaggacgactagggggtcctttatatagccatgggagcccaggatcgagcccacatcaacgggaaaaactctggaaagtttaggatcttcgtcggaaaaaggatagattgaaccgcgaaattggaaaggatttccatagaaacttttggggatttcgtggggaaattgtagaggagattgagaggattccgttcccgcaactaatttggaaaaaggagcaacggggaggccggattcggaaggggatcggcacggctgcagctcgggacggctcgggcgctgtccagatgttgaagacaacactgtagcgagagggaagaaaaacagacttctatgcgggctgagaggaagggagagagaagagaaggaaatgggttgaaaagggcccaagctgaggaggaagattttattacttttccaaatatattaaccaatgagatgatctttcaattgttaaaaatacttccaatgcacaaatagttccaagaaaattcttgaacatacttggacactcaaagtatttaacaaaactgtaaccagctcatttaatgattaatttaatatgtgaataattactgaaatgttctttgtattattaaaattattaaaaatccgagaaaattccagagagtacaattaatcatggagaatttaataaaaattaaatccaaccatgctttatatttaggaatttttacttcccacatttaacttcacttgtaaattaatgaacatttaatataaattctaatattaatttattaaataatttataaatcctgagacaggaaattcaggctgtgacattaacagtcttcaccgaaacagtggtatataaaagctgctatggaatagggagcattctcaagagccttaaaatttggtggggattgttagatttaattggttaattgatccatttaaatcaattaaattaaataaattccaaggctcattatgctaggaattcatgtgtattcattctcttgtgggatatcaatgagacgaggagttttgagaattaatccatttgattagggaattggtaacttatatcaattactcctaattgatggatggttgatagttgtatagtggaggatggttcatcactagttgatgacaattagttgctc

SEQ ID NO: 64980 - DNA, 768 bp, Oryza sativa
aaacacacagagagaaataatctataatacaattgcaggcgctcacaacacgcgcacactcacctctataaacatgcacacacacatcctacccctataaatatctcctaaagactgggccgacatatcttgtgatcgacgaaatcactacgagcgtctcgttgccaacggatatgtcagcattgatggaataattagccgtaaatgtgagctcccgtgtcaagtctaagacttgaatccgggtgggtatgttccatcataaggaacataaccagttaagctacactcacttcacaataatattggatattaaaacaaccataatttttaagctacatttttggaatactactatgccttttaaactggtggaaccattattatttctaaccgttatctatgttatataataaacaagcgtgtattcatgggacatcacgtttcaaaaatattactgcacaactatatttcgtcattatcgtattcatgttaggttgtgtgagcctctggcccattctaaatgaaaatgttcatggatggatcacctctcaaactacatcaatcatattaggttatataaacccatacatttagtgaagcctcatgtctcacccaattcatcctctaataaaccatgataatatatgcaattaaagaaaagaaaaacacattacttttactttcgttgacatattttctaaagaaaataagattatattcttttcaaaagatgaagaatattataaataattgcttatatatattatt

SEQ ID NO: 64981 - DNA, 1017 bp, Oryza sativa
ttttctcacatgtttgaccattcgttttattcaaaaaattaatgcaaatgtataagatataaatcacacttaaagtactatgagtgataaaacaactcgtaacaaaataaattataattacgtaaattttttgaataagacgaataatcaaacatgtgagaaaaagtcaacggcgtcatctattaaaaaaacggaggtagtagtaaatatgttttgaccacctgccaaaatgtctcgactaacttttttagaaaatgaaaatgtctcgactgatgcctctagcatgcttgaattgctcaagaggcgggaggaagaagatgcattggccctcgtgggagtggctgtctacgccaaaatatcttggcggtatgggtttcagggacttggtcatctttaaccaagcgatactgaccagacagggttggcatcttctcacagatccaaattcgctttgctaagggttctgaaagttaggtacttctcaaactcagatatttggtctgcccctaaacctcgatctgcctctttcacctggcgtaatattttgtttgggcaggagttgttaaagaagggggtgcactgggctgttggtgatggttcatccattaagatcacgatggacaattgaatacttggtgtgcaagcaggaatatatggtgaatacccgcttccctatccctgatgatgttactgtcaattcgctcacactggtggagaaaggggatttactcctggttcgtaacccccctgtagtcccggttttcaaacgggactaccaatccgggactaaagatcactatcttttgtcccgggtgaaaaaatcgggagtaaaaatacatctttagtctcggttggttgttaccaatcgggactaaagatagagcctttttagtcccggttggtagagctagcctagctagatccggttgctctattattagtttcttttcttcattgtgtttttaatatattgatttcactccatccccatcccaaaatcccaaataaattatcccc

SEQ ID NO: 64982 - DNA, 3330 bp, Oryza sativa
agttttattatttaaaaaaacttaggataaacatgttcatttccacatggctactttttattaggaattactcatcgacagatcaaagctacaaaatgtattcatattgggattttctcctattattggagaggtatacatctcatacttgacatatatgtctccttttatcttacaggttggaataggatttagaaacttacttcgccatcgaaatataaatctatatatgtacaatattacatacaaatgtatctttcctgagatttcttggtgagattgttagcttgataataatttttcctgtgcaacaggcatccatacagtgtgatattccagcagtgagcaccattgcaatgtacccatagcgaggcaccattaacaccaataccgttatacaattttttcctaatgcctcttattactacagcattgtgttgatcgacattgtttttgaaccacgttgtttataggtatattttctctctgcaggggaagaagaaaggaattataacaacgatattaagaaggaatgagatgagaatatataagggagaagttataatagagaatagtagatatgtggaggttttgatcgatgcttttattacagctgacgtcaggaactgccttgattgttcagggagtagatgttgggttagaaatggtctttgtcactaaagaaaatgtatttactaaactacattcgcatgaaaaattggaagcaatgtctgaaaattttcttctcactgatcagcattgtggtctatgctcctgtataggggtaaaaacagtcacagaaattcccgattaaccgggcgttgtttccgtttaaggggtacattttccgaccgtaccgtttttgttatttttaaatttctttttgtctaatttctttctgcatcatattaatgtcgatactgagtagtttaaataataaatatggtcaattaccggccgatcgagcatcgtttccgaagagatactaccaattccgatcgttttcaccccctactcctgtatcattctcttccatctccggcgacctcgacaaactctgacataaaaggcagcatccccaagcagaaaggttttagggtaggtatcggaatgggataccgggtgagttcaccggtttagaggaaggccaacgggtggtagagagagcagcgacgaaggtagggaatcaaaaagagacagcaggatcggcttacatggtttttgccttttctttttttgacagcggatctgtaatagatgcagctgctgtggcaactgtaacgactctcctttttttcatccagggtgactagtccaatacaaaaggttgagaatcaagttttgaaagagtttgtgttgacatattatataaaaatgattacaaaacaaaagaattttttcaactatgtttgatgaaagtagcaaatctcaatcctctttaaattccaaacatcacgatgataacgcactccatgcatgaaatttgaagttaattatcatggtttaaattaaagtcatgttcacataacttcacctccaacctctaaattcaccagcaagctctagtgttcctgaaaaatacggaacttcaatgggcaaagaccaatacataattaaataaagggatgttcgtcctgagtgtctatcaacctcaactactttatttttggtggagtttgctctggcttatgatactgtcgtaaaaacttgctgtattgcaaaatccaaaccaagctggtgctccaaacatgctgtatagaccagaaaaaaagtattcagtatagttattacaagatatgtgcttcataatctttccttcgaaatgagaaatatttaaaggaaaaattaaaatacaaaatttaatggaagagaaactataaagcaacagtaattaaggtaatgtttacaataacttgaacttgtttttccttttttttttgggatccataaagaacttctaatcttctctgtgtagaaaaaccaccacacaaattaactctgatattgcggtttcacccttgcatccgggtcccaggtcattttataaaatttacaacattacaattttagagtttgatccgactaacatcacatcgaataaaattactctcactgttacgggccgatgggagcatatgcagaatagagcacagctaccttgctcaaagtttgcaagaaccaacgccaacgggtggcatgcgtgcagccattgtagcgaatctctgccaacccgtccctatgtgttctactactcggcaccagtacgtgcttggaatgaccgtctgttggtgtgatgggtggaggtacgcatggctgtcgtaaccatatcagcgagcttccatacatcggaggtgatgcttacaagccgattttctcagacaaatctgtcatatctgtgcatcaacgattcccggcgcacccatacgcaccgtgtatagcctgtatagtgacgaggtggagcacacgatttaatagagtatagcaagcatgcatcatcgttcccttgctttaatatatgcatattgtactatttatcagcattagtaattcactagtaacaacatgattgcacacaacgctccacgaatatacatgtatatattgccatccatgcatgttacttttctgaacatgaatatatatgcatatattcccttcttcttgttgaaagaaattttaaaaaaaagtataatagattttttatcagctcaattttgcacataagtctatggagtgttttcccaaaagtgagtttgggcagtgtcctagggctaaaaccatacataagcagtgtcctgtagcaaaatttgtctttttaatttttacgttggttacttcatttctaaactaactaatatagcaaataaatgagaatggactgagtatgtgtactaaattggtgtgacttgtttacttctttctttggagattttcagaaagatcacttcaatatgttactcttaacgtaaggtttccatggctttagtggcacaatgaacaccagtctcttaacataagttcaaactttcactatgacaagtttaattaagttccctttctacacatgggcctaattatttggtgtcttctcatacaccaaactgaaaaaaaatccactaatatacctagctttcagcacaaccgaaatccaaacatgcattcgaaattttaaatattttaacatgatttatttttcaaatattatttttaggtttcatgcaatgttcattacaatgtgttgccatgcacggacacacgtatagtttctcttcatatatctccaggtctttaaataggcgcaatgaatcaaagaaacaaattaaagccaac

SEQ ID NO: 64983 - DNA, 10619 bp, Oryza sativa
ttcttttataaaagaaagggtatggcataagttttatataatacttcgccatttcaatctaaatctatatatgtataatattccatacaaatgtttcttttctgagattaattaatttctttgtgagtttgttagactgataatattatttccactgcaacatgcagccatacagtgcgatattccagccagccccattgcaatgaaccgacagcacagggcaccattaacgccaatattgttatacattttttcctaatgccacttattcctgctgcattgtgttgatcaaccctcttttttttaaccacgttgtttattggcatattatctccgccgcggatgaagaaaggaattataacaatgatatttaagaaggaatgagatgagatataagggagaagttttaacagagtagtagaggtgtggagttttcgatcgatgcttttatcacaggcggcgtttgatcggagctagcacaagaagaagagccctacgtcacaggcgtttgtcagccacgctatagaacgatatcaacttcgcaaccaagataaaatagcacattgatacaataaggcccggtttagttccaaaaatatcccattgaatctttaaacataagtaagaatcattaaatatagattaaaacaactaactgtacagtttgcatagaaatcgtgagacgaatattttgagcctaattagtccataattagctataagtgctacagtaactcacatatactaatgacgaattaattagactcaaaagattcatctcgcggtttccaggcgagttatgaaattagttttttcaatcgtgtccgaaaaccccttccgacatccggtcaaatgtccgatgtgacatccaaaaattttctttcgcgaactaaacaaggcggtaaaagctagagcgcaataaattccccatgtctcctagaccctatttaataggcggcataaataacagaaatattacttgtgcgtcatgcatgattgaattgctgaagaggccgctagccttttgcaggctggcctttgtacaagctactccctctgttgttcatgtgttaatcttcacgccatagtgcattactgattgacggatcggtatatatacagctcccaagtcccaagttaatgtactgttaatacttgaagtatttgtcggatctctcatctatgctaatcggttgttgttgtaagaatgcaaataattaaggcaaattgagttcatttcagtgcccatcgagtgtaattaagactgatgtgctccgagcaatccatattatatagattctaatttctgcaatcatcacttctctgaaaaacatgaacattgatgcctggaacaatcgtttgttaactaggatattaaagctatattaatttggtacgggaacattactcagtttcggcacaactgaaatggtggcacacgaggatttactcagtttcagccagatacattaatttggtacgggattgccttgatttcaattaagcatctgaaagtttttgaaaatatgcggtcacttttctcatctctcggatcaaaaccaccggcaagaccgcagctcctgcgcacaggtgaacaggatcagcatactgtggtgatcacctgagttgtctcctcagtcgacagctgctgcttgctagccactactattcagcagccttaaccgaagatggcatcgagctcaggattatatgcacttgcttgactcgaaaaaagcagcgccgatggctggcattcgtgcggccaggcatgtttggtggagcagtgaatctctatcgacttggccacgaatcccggtataggtccgaattgcggctgctcgtcgcggcttctcgtctacacaagcccgtcgatgattgaccggaggtaggctgcccagtggtggccacgcgtctgcttgtgtgggcaataacaagggatgcatgcaggcataacatgcttccatgtctctctgcccatcaacgattcctgatgccttccaagcttagatagatagagttcaaacgtaacagttgcaaagttcagttggcatatgttaacttgtgagggcctaccatacggagtatgcatatatatgtatatattttgggggaggagctagcagacaaacttatttacagagtcaaaatcatgcagtctctttgctttgcatgcatacataagacaaacttatttacagaatcaaaatcatgcacgttgatagtctctttgctttgcatgcatatatatacatatataagagtattgatgagcagtcatgtcttcataagacctggcacccgttctcattctgagtagagttaccttcttctccaatatagttgtcattcttggattttgcttatttagcaaagagtaatgtttagtaaaaattactatagtgccctctattaaaaaaactagagaccggggcgcgcctttgcatgccgcctgtatatagcaggatcactcgctgtagcaattgaacaataaagttaaggtaataaagttacaggatagtaaagctggatctgataacaaacctatgaggtaagtaattagttgataaaatatgagtaatatatgtatacatatcttgatttttatttaactgtaaataaaataacagttcaattaaattaaataagtgtaatataaatcttaatttatttagctatctaattataaaacgacagtccaatagttatgattatgattaatttgctacctaacttactgttttttccattaaacttttagttacaaaatagaagagaatacaagagtacggaaggagaggagagaagaatgttcatacgtacgtgatatagtatatatagatctatatgcgtatcggtacgtacaattaatagtatggatgagaggatagtttattttcataaaataaattagttggcccacctgtttaagttatctatatatctaatggcttaaaataacagattcacgatttaaatgaaattcaagggtcgatatttagagtgctaggtggtgtcttgagagtgtttgtaggatgtccacgtggtagcttgagagcgtttgtaatatgtttaatggacttttagtatataactaggaagatagcccgcgtgatgcacgggcatgtattagagattatgtttgaaaaaaattaaaattatagtataccaaccagatgatacttgtcatttcaaacttactgtttatccataacttatcatcatcagtgtgtctattcgtttgtttggaaacatatggtgttttttcttatttaataaaatgtttaggggcgttctttttttagcaaagcctaattaacattattgttaatgaatatgttttatttgtaccaccaagctagtcctactagttggttcaattgacgcaatttgttacatatttacatataaattttttaaagaaaaaagaaaaatacctagtcaatatgactccgaacattttagtttaataattacaaaaataacttctcaaccaactataaatcactaactttgtgtggcttatatatgcaataatatgtggagtaactcataatgtcatgaaagcctataatatctaagcacttaaaaaatgatatggccatggaagatgcaatagttgttctaattttagtgaaaagtaggaaccaacgttccttttatatttcttgttttattttataccactcctattttaagttcaaaatatatgatttatagatctttaaattgttggtttaattatgaatagagcaatttagactagaaattagaagtgtggcataaaaattatgtatgttttaatattattgattatttctccttttagtttgagagctataaaaatatctaggagggatagaggggaaggcgcgagctgaggggtgaggggactaactagtgttgtgtttgtccacatgtgaggtggagggggaagtttttgttttttgggccagttcttccctactttctataaatgatttaaaaccgatgatctattgttttgttcctaaaatttcaaatatttttttctaactattaaaatgtaacacctagcggcttaaaattttctttaaaagtagttttaatggttcaaaataatggatctacatatttatgtcgaaactgatggtcaaatgttttttattataatttctaatattttatttttaaatttaatacttaatacatgacattgttagtgctctataaagaatgtatgatgatttaagatgatataagaattattatcaactttttattgttctatttttcttatttggttgacacgcataggtgtttacaaatgacgtactgtaaatatggttgatatggatcctgaattatttatttatttataaataaaacaatagttcaaaagaacttaaaaacccgatagtataacttaaagatatagtcatttagattttttattgttatttattttttattaagttgttaatgagttaaaatttagaataataaagaatggaatgagagaggagaggaggagaaagagtacgtatgtatataataagaatatttattttacaagtttaatacattataattactactgttttattgtataaaaatagaataaatgccttattgattgattaagatgcatcttttttagttatcttttcataaatatatttatatgtatacaatatattttaaaaatatatacactacaaatataataatattattttgacttactctaatatcggaatgagaggagtattttttggaacattatttaggttcattcagttttttcattgtatatctaatttaatcattgttaagctatatacggtgataaaatctatatcattatttttttccataattttataactttttgagttggacagaaaggtcgaaaaatataaccaaaagttacatatatattttttgatagttgcattatagtgaatgtgggtcgttaaatgtaaaatagtatgaagaatgtgctacgtgcgtaggcatggatgtcttgttattaaaataacattatttatacgatttagatatcatagttgcctaattttttagcacaattttttttccaggtgcgcgcttttcaaactgttaaacggtatggtttttttttaaaaataaatctatgccaaagttgctttaaaaatcatattaattcattttttaaaacatggttaatgagttgcttcattttgcgtgctagggagattaggtcccaaccccatagaagtaacataggcggttcattttactttttagaactgtagatctaatttaattatcgtgaagttatgtaagatgataaaatatattatcattattattattattattattattcatatttcttccaattgtttgaaatgcatgcaaaagtcagaaaatatagcccaaaattaaaatatttcttttcaacttttaattatagtgaattttggtctttaatcatgaatttggtcgtaaacaatctaaaggcatcgatggataaaaaaaacaattatatgatttagatatcgtagttacttaattttcataacaaataaagcaagaaaatatgagaaataattaatggaaatagaaagagggaagggagggcgtatgtaggtaacttagaacttacgtacttaatgctcggtggggccgggtttaggggatgatttttttaaaaaaaagtaaatctaatggttgtaaataatgggtctaccaaatttaatgaaaatcaacggttattttttagagtgccatgtgacggcttataagcgtttataggatgccacatagcgacttaggtgcatttgtaggaagattaatgaacttttagtatataatagatagatagatagatagatagatagatagatgatagatagatagatagatagatagatagatagataaaactaggataaacatattcatttctacatggctgctctttactaggaattgaagaactcattgacagatcaaagctacaaaatgtattcatattgagattttctcctattattggagaggtatacatctcatacttgacatatatgtctccttttatcttacaggttggactaggatttataggccgctgttcactgcatatccattccagcataacagaaataatggcacacgctattcacttacttccagccggattcactaaagttgtatataacggagctcgtgcgtgctggtgaactgatcagcaaacagcgccgatggctagagttcctcgtcagtagatagctgctgctggacctgaagacgccgaggtggcggctggccttcgatcgccagagttctctcatcagttcaccttgcagcagcggcttctcgacggcccaagccgtggaagcgtagccacaggcagagtgccgtgtggcagccgcgcgccgacgtgtaaacccaataacggatgtgagcaggcatgtcctgcttccacttgtattcttgtatgaacgattcccggtgccttcaagcttagacagatagagaccacaacatttagctggcatgttataaaagatgtaaactatgttagttccaacaatgtggactatattgtcatattatgggggaggagctagcatagtaacttattgagcagaaagcacatgggtcgatggtctctttgctttcaatgcgtacaattatttatgattattcacctctctttgagagcttaccctcgttctcattctaggtttacttagcttacaggggaagtgttctttttttcattatctgatgtagcatatgtgtggacgcgtgggagcggtgaaactagtgttctaccaactttcaagaagttaggatataatatacgaaatgtacaattctgtatttctattggcatgtgtggacacttattaagtacctatatataggggagaagtgtgtggtcctttaggagctgaattaatattcttgaggtcgtctaggattgtcaaagttgatttatacctatgtttttatttacattggttactttaattttgaactaaccaacggcaaataaatgagaatggagggagtatgtgtactaaatggtgtgacttgtttacttctttattggaggttttctgaaagatcactccaacatgttactcttaacataaggttttcgtcgttttgctggcacaatgagcacaccggtctcttaacataagttcaaactttcactatgacaagtttaattaaattccctttctatgcatgggcctaattatttggtatcttatcatacaccaaactacaaaataaaatccacaaatatacctagctttcagcacaaccgaaatccaaacatgcatccggaatttcaaatattttaatatgatttatttttcgaatatattttttcggtttgatgcaatgatcatcacaatgtgttgccatgcacggacacacatatagtttctcttcatatatctccaggtctttaaatagtactatgcattctcctctttggtgcaaccattctgaatcaaagaaacaaattaaagccagggattactcctccttcctttctgttctcaagattgatccccacgtcatcctactgcagcagcaaagcagaagaacaacacaatagcagcataagaagatgactacacgtctacacctctcctccctctattctctcccctctccctctcttccctgcagcaggaaagaacagcaacctcttgcttgtcccgggaggtattctgtaggaaaccctcaatgtagtggttgttttggcgtggttaggtgattaggagcatacttaaaagactcggccactactatgtagaccatcaaaccccaccttaaaaataacctctcctcacccttccttttctaaaagaaggcttacgacagaagttttatatgatatttcgccatttcaatataaatctatatatgtacaatactctatacaaatgtttcttttctaagattaatttatttttgagtttgttagcctgataacattttttccactgcaacatgcatccatagagtgtcatatttcagtgagcacgattacaatgaacagacggcacgaggccacattaacgccaataccgttatacatttttttcctaataccacttattcctactgcattgtgttgatcaactttttttttaactgcattgtttatttgcatattatctttcccgcgaaagaagaaatgaattataacaatgatattaagaaggaatgatatgagaatatacaagggagaagttataacagagaagagtaaattgcgtccgcggtacacaaacttgttaggtgggtgcaatttagtgtaaaaacttgaaaaactctctcgttttggtgcacaaacttgtataggtgcgtgcggactatgactaaacagaatagcaaatctaattttgctgagttggatgatgagtagaccgccaactaagcattcacgtaagaaggacaggttcgcctgctcgtaagcaatggccgtgttttatcagaaaaccccttctattgtttggtatttcgatcatgtataatttttcagtgaaacgaatctgagaggtgttcatagcggcggggagctggggaggtcgaatccgcggaggttgtagtgatgggggtcgagccgatagctacgccgtggggggagtcgagtccgacggtggctacaacgggtaggtcaagtttgacggcagtggctgcaacagtattgttgagactgacgatagtgacagatggcgaggaggtcaagtttagtgggagagcttagaagttgatgctgcggtaggcatttgagtggcttgctttaggccaacattggttatctcagactctgacaattcatatagcaactttgaagcctagctccaatgtttcagtgcagacattgaagcagcaaggaattaagccattgtgccgtcagattaacagcatgaacattaaatccactgaagcaacaaggatgtaatgcttaattgtacacattgtgacaaaatctgaacacaatgaaacacgtgagtgcatattttgaacagaaactgaaatcctgaataaaattcagtgaataacctgaatgaaaactaaatgcataacttgacatgaatttgattgtgcactagtaatgtaactcaaaattgataacatggaaccaactttatgaatgcatagtataaactactgtttctttttcttgggagagtttttcttcttgggtgctgcacttctcttcctcaatgtggccctgccttgtttggttgatgtggttagtggtggttgaaccccttctctcctattagtagcaatgaaagcagtctctggcactgctcctggattcaccctttcttgatggttgctagcagcctgtaaaagattatgtactaatgttatgatggttgctattagctgacaaaatgctagcttaatgaaggattgttttttctttgagaacttaatgaaggattgtcacctccttaataaaagcttccaccacagatgaactcagatagttagaattttgctggggtatgctaagtaggtgcatttcctaaaacaaatatatgttctgtttaaaattccttgttagtgcagctaaacatatacacaagcaaaatgagcatcaatagtacctgagtgatgacaggttcctgaaacaaatatacaatgagtttaaaattcatagttagtggagataaacaaatacacaagcaaaataagtataaatattacccgagtgatgacaagctcttctgaatcaacaattgatgaagtcgccatttgtacataggttgcttctgaagttttaagtcagccttcctttgtttacaactagttttgttgtgaccaccatttttgcagtagctacaatgcatctctactccatgctttgaaattttagtcccaccctctagttcctggggctgttttctcctagttttctttggcctccccactttcttctcatatactggtggcttcacctctataccctgcatcttctcccagtggatactatctctcagtggcattatgttgtagctataagcttgttcatagcacctggttgaatagaaaaatgacactacatcctctggcttgattctttcatgtcttagacaggaaatggcatggttacaaggaatcccagtgagctgtcacctcctgcaatcacatctctttacattaagttcaacaatgtattgagatcctttgtcgctaacctgaaatgctcccatcccagtaggcaaaacatagcatgtattagccatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctc

SEQ ID NO: 64984 - DNA, 742 bp, Oryza sativa
ctggccaagaaaatgaactagtaaggaataaattaagtgttccaattttggaaaaaatgaaacaactagtgctagagtcagaccctgctaaataaaatggatattctagtctccaagtcatctagcaaaacatgcacatatcctgcaacctctgccttctgaccagaaagatagcgatctgttatgccatgcattgatatacaactcaatggatctagcttgaatgcccagtcaactatagcatagaagtcctcctgaaaaatataagatacaaaacatgtgaacttgtgaagccccatttcctatcacagcgatttcattttatcatttcaacagttcatatagtaggataactgtccaatttacaaagggaaatgccaaaaatatcaacctgaataccatcaagcaactcttgaaggaattggtttagtactcccaactcagctgaactgttaactggaaaaaagataagatgttaaatttacatcacactgaaagcaagaagaattaaagcatgcaaggagcactattagtttaacagttggtggtttatattacttggtttggcactgcttccaggaggttctgaaacagcaacaggattattgttatctgattcatctgacggagctagcgcagcaacatcaaagcacataaaatgtgcaaagaatgagctctacatcatagatatccatcaagagaaaattgaattgtaaacaaaactgcattttgcactgtaaaa

SEQ ID NO: 64985 - DNA, 1453 bp, Oryza sativa
  unsure (1)..(1453): unsure at all n locations
tgcactccttcgcatcaaagtcaccaactattatggcagctatttcaccgcttgttggaagattatactgaacatcatccttagcattgcagcctagcaaacacaaagttatcttctcatcgccatgttcagcaagtcgtgacctggcatacctaaaattctgaacaagtttgttgtgcgtgtcaagcatggccgataaggctgcgattattttagggtcaggcctatcgttgctatcgcgttcattctcgaaaatgtttaaccgattttggacctcgttagcaagatcatagatgtaaagctgtgcaaattttgatgtcgcaccatgcgatggcaaaagagtgccaatcttgtggtgcacaacaccgttgattttgaaaacataaggtgcattcccagtgttaattgatctgtcgatggttgcgcccatcgaagtaaaagcaaaggatgaattgtatgatccaatctgtcttaaaaatctcttcgatcgagcatcaccatcagattttatcagagccgcaagaggctctgggggctgctcaaaacgaggcacttgtattttgccgctcttgcaacatagattatagacaattttcctctttgagacagcagagagtgacttaaccctctcctggaaccaaaagacagcaccacaatatggacactcatgcgttggaggaccatagtatgaccggcctgggtaggacgctgtaagacacacattttaccattgtgagacagacatgtttttttcattaaacaaagcataggttgtttttcctatcgcaggatacgaacccttgagcgactggatgtattccctatctgttgctgatgaggcagtgcttggcctgctagcagaagctgcaatacaggcagatcataaccatgtcttaatcggcgtgggtataacagaaggataacatgtctatgaaaataactntctaccataccacaaggagcgtgtggtggcggcaaaggaggcagctttgaccgcagtaaacaacggtgctgtctatgcagcttggataagccatctgaaaaatccataagggaacgcggcctcttactccgatctaccgcaaaggttcagacgatgttcccaccgtgctctgtatgtccattgcaaagggccgcagcaagacattggtggctcgcctttcacggcttgcacgtacccttcggaccctatctatactctgttgcgacatctgcagagcataaccaaacaattggagcaaacagggagcaacgaagaaaccgtgtgattgcatgacaacagaagcagcagcaggcacgctaccgtggtgaaaaggatagaggagaacgaagcagaatgcactcgaagaaaagagggcaggaagacatagctcacgacaggtacaacacctcaataaataacagcatataaaacaaagagtagcatacagaaaacacaacatctccgagtggc

SEQ ID NO: 64986 - DNA, 2623 bp, Oryza sativa
acaaccactaaaaacatggcgaacaatgcacggatccgctaacacagacagagatggaaaggaaggaagcgagaaataacctcggacgaagaggcccgcgaacgccgtgggacaacaaggacgaagcaagtacgagaggaggacgagacagagaagacacgaacgagtcgatccagaaagcgaaggaaagataggggggtccgcactgaaacaaacaaagcaatgtaatcaggacatatgaagcacaaaacataggcaggggatacataggggcctgccatgcggacccaaagcacgagagggaaaacctaccgcgagctgccgccgcggaagacctttgctgtgctgatgaacaggttcaagaaccatggaagcagcgatccacgccgtgcaaatcccggcccctacgaatgaacacaacagacaccaccgaacaatcagccaataagggataacaaaaacagaaagccgacacagccgcagaaaagcggagcgaccgcggagaggaacccgctgcaagccagcgccttaccctgccatagcggatggaaccaaacgagaccaagcagcggcgaattgaacgcggcagcacaggcagccaaaagggagcgaaaacgacggtgtaagccctagaaacgaagagcaggaagaagcactatcgctggaaggaaggggaaaaagagtgtagaagggatgcagggatccggaatgtgaacaacaatgcacccaccaacaaggaagcaaaggctgtggggcccataggcaataggcccaccgaaagtgcacacaggctagcacagcctcggtgcaaaacgaaggcgcaacagccgagtcaaccgagggcagacgacccaatcaaaacgcaccggacaaactgagcagctgccaaccacacccacgcctgctcctccaaccacccagagcacggacgcgcaacacaaacaccggtagacacagcgcacaggaaagcaggagcaacaaaaggcaaaggacccacgcatcagagaggaacacatggaggaacgatcccaccagacaaagaacaaaaaacggcagcactggtgccaccgcagcagcaacaaaccatggacacagctcacagtaggtaagaaacgggaaccagccgcacggcccacacggcagagagccaaaacacatggaccaagcacacgagcgcgctgagctgacgagccgcacagaagcaacgcagcagagcgaacgcaaacgccgatcgcccagcacggcagctaccgcaggccgtcaacaccgcacaagctcgatcgaacggacagcacagcaggcaaggagagatggccagccccagcgctcccagcgccggatgacgtgccgcgccccgacagcatccacgacagcccgaaaagcggagaagcgagcaatcgggggctagaatgaagtctttaggtattcaaagattgtgcatggtggacagatgatatatacattgtgcagaaaggtgttgacaaatcattgtatatgcatgacttattcgaaagacaaccttggcactaacttttgttagggctattaatgaaaaagtttttttttgaaatatttatgcagaattgacaaatagcaggtttatcctatatttcacgcaacttgataaagatgaagggggtacatagtatggaactcatcttataaaacttatgaaacatacacaattttttcctcgcaagaaaataatttttcaaacatccaacatttgtgaacaacatgcaaccgacagaattatttggctgatatatatattaaacttgaagatgaattgaaagagataatggaagatacaaacaagacaatattggataatgatatcgatcgtgcagtgccacaatactcttaacgtctagctagcatgttagatagaaagctgaagaaaagaaaccgatggaatgcatggtcgtaaaggagattcgcttctcgtgccggtgtatataagtcgtctatcatgaatttgtagacaatattttctttctagatcaataattgttgacaatattttgacataggaaatcaacctgtacaatatgcgtttattgtgatggtggacaaatgcaacgttggtttacattcatggaaagacgtacaattcatccatatacacacaactcatattactgatcaaagacaacttcgacactaacttaagacttaagagatgctgtcgggaaatgatatttcagtgattatctgttgaggaagcctgatgaagatggtgggtatatatagagtttcatttgagataaaatttatgtaaattatttttccgtatatatgcaacctaaatataactaaaaaatggtagcatgtgaagtttcaaaggatatttgtgcatatgtaaaaaaaagagataaagataaaatatatgtgaccggagtcactggacggttcattttaggggtaaagctaggcatcaagttgagattcttgtgtgggtaattaaaagacctctgctctctagtagttaatgtccttgttgccatcagattaccggtaaagcaaatgcttcccctgcaaagtaatccaaaacatctccgtgccatgcccatcaaattaaacaaagccgaattgttaatcaaacaaggacaagaaaggcagg

SEQ ID NO: 64987 - DNA, 1835 bp, Oryza sativa
gagggtgtttctgcggagctaccctctccagtgggactgggcgtcgccggcgccgggggagaaggagaagcagcagcagcagcagcaggtgcagggcgtcgtcgccggcggcgacggggaggaggatgacgatgagtacggcggaggaggaggagacgagcgcggcgggaggaggtggcggcggcaggtggcggtggcggtggtggagtggggggaggagaagctgctcctgctccggcgggtcaagaagaggctggcgctctacctcatcggctgccactacgccggccaccgcgccgcgctgccgttcaagtctcctccgctctcctgcaccgccgccatgctcgcccctcccgctgatcgatcgatcggccgcgccatggcggacatgcccatacccaccagctagctttgcaatcatcggtcggtcgatctacacaggttaatttcgccatagctttcgaatctccacgtacggtgctctgattatgtgcatcgaggatatgcatgaggattcatcggtaggccagtgaacatctcaacatggcctgtctgtacgtgtatgttagtacaggtaattaattaatgtaataagaagttcagagcttgtaatgggtgctggttgtgtacatgtaaattcttcaggacaaatctttaacatagggagttggggattttgtatgtatgatgttgaattgcaacaggaaacgttgcagacagattaataggtgaaaatctagctttagatacttttgtgttaagaaacgtgaaaagttctttttttgagttttgagcatggcctgtctgtttgtgtatgttactacaggtaattaatgtaacaagaagttcagagcttgtaatggtgctggttgtgtacatgtaaattcttcaggaaatgttgccatagaaagttggggattttgtatatggtagtattgaattgcaacaggaaatgttgcagacagattaataggtgaaaattaagctatagctttagatacttttgtgtaaagaaatgtcaaaagttcttttgagttttgagcatactctgtaagagagaaaaaaagtggttttgagcaacttttacataataataaagtcggggacgggacatgtattggagagtctttgtataaatcaagtacgttgctatttctttttccggttgactgctaggacacttgaatccgtgcggtaccatatggtggccgttgatctggcttcatcggagggctaggaacgtttagtaccgcctggcaccgcatgccctgactgaggaggtaccgtgggtgggagggtagcttcgtactttcgcgttcgcatctctttcgcactgcatgctgtctcgggagaagtttcactcggcaagaaccgtatatccccgtagcatggttaggattggatcccggtcgcctgaaatcgattgggagctcgctgcaattttacatagtgcttgtttagtttctaactttttcttcaaacttataacttttctatcacatcaaaacttccctacacacgtaaacttccaactttttttttcaaactttcaattttaatcaaacttccaattttaatgtggaactaaacacagccataggatgatctgggtatgcacagaaagagagttctagtggttcaaagtgacacaaagataatatctagtccaaagaaaaatattggttaaaagtggcacaaactaaaatttaagtaataaaagatggaccaaactattattgtcctagttcctacagtgtataactattgaactgcaagaaacaatgttgtggatattaattagtaggtgaaaagccagtataacatgctgttcttaa

SEQ ID NO: 64988 - DNA, 1620 bp, Oryza sativa
ccagacttttctagataaacaatcaaggccatccatctcccaaagggctaaatcagcactggcaacattaactgacctgtcggctggcacgatctctatcttgtcgccttgccattgaatcaagcattgatgcatgttgaaggaatgcaacaattggcgtgaatccaatcccttccaagcaacaagctgtacgaacccttcccatcgatgacaaaaaacgtagtacgaatagtcttactgccgactgtcagctccacatttaggacacatttggtttccgatggattaccaccatagtctttgagcaccatatttgtcttgatgagatcctcagcgttcctacccaacttcctgaatgtagcataaggcatcaaatttaccgcggccccaccatcgaccatcatcttagacatcggcttcccattgacgtagccatttacatacaatggtttaagaagccgattctctgtcccctcggatttctcgaatactgcctgttctggtgacagaaccaatttagccgattcctcttccacttcatcgacatcggcttgatcgatcctgaattcagctggcaatgtaaagaccatgttaattggtgccgctacaacactcttcccgtttgccaacctttttgcctcatcagctgcaacatcatcggctacaggaacctgattcttaacacaccactcctgtcttggatttggtttcctcagacaatggttaatttcttgttcaacctcctggaggcgctccctgttcctcaatctttgaacccttctcttctgattcttcatgaaaataccagaaggacaccattaattcttcctgattacctcatcctcttggccacgatctttattcaccggacccaatctttgatgaacagaaagtcttgcctgccttagccgattacccctattatatgaccggttcgagctctcgacgatatcactgcacccagggcagttttcgatagatggcaatctcatcccttcattccagcagaatctaaagaactcacaaccccaatgaggatcaaaaccatcatcgtattctgctgcttgtcatacttcctctgatatttgttgataatcttagccgaatttacttgaaaaccctttgcacggaccctatcggctgtttgaccagccgtatgcaccatattaacaggaaaaggattaccatcgactttcatcggctttttggaatcatcaaacctaatctttcccccctcaatggcaacttgaatttgctgtctaaaaaccttgcaatcgttagtagaatgagatccagaattaggccatttgcaatatctctttttgcttaattcctcagccgatgggattgtatggccaacaggaagttgaatttgcttctctcggagtagtagatcaaagatcttgtcagctttggtaatatcaaagtcatacttctcctcttttccaggactttttacccattggcatggtatgacctttttactcctcacccattcggctgcagctatttcagaatcatcttcctcatcatccgacccatacatgtatggaaaaacttgattaaccttcttagagcttttcctgacttccgccgacctatgctcatgcaaggttacct

SEQ ID NO: 64989 - DNA, 5986 bp, Oryza sativa
ctacttaatcgctgtcaagtctgataacttcatctcatgaaccccactgtagaggtagctgtggaattgcttctccaaatcggcccaactatggatcgacccatatggcaaagaggaaaaccaagtaaaagccaatccagataaaaataacctaaataacctaacctttagagcatctacagccgatgcttcaccacactaagctaagaatcggctaatatgctcataagttgacacaccatcttgtcccgaaaatttggagaagtccgggactttgaaccgattgggaagaggaactctctcaaaccactcagggtaaggctgccgatacaagcttccagtctcttttggtttaagcccaaactgttccctcattacgtcggcaatcacatcggcccatggtcgctgctgagctgctgcttgtggctgttgctgcatgggctcaaactgaccatactgagatgcgaactgaggttgagccaatccccctggctgatattgggcttgcggggaaggaggctaatattgataactcaagttacccccttggtaattatgaaggttgggctggatattgtgcaccaagtgctcaggaacaacctgaggcattactgtgccatccggctgtacatggtgaaccaaatgctctgggacgactcggtttacaaaatgttgtacaggttgacctccaggcgctgcgaacccggccgatgcgcttactgaccccgggtgctgaatcggctgaacgatttgctgcctcaacggagtctgttggatcggctgcagaagctgctgccttggtggtgtttgctgaactggttgcacgacctgttgctggattggttgcacagcctgttgctggattggttgcacagcctgctgaattgggggtgtctgctgaatcggctgctgttgttttggatcaaccgcatgttgaggcggcaaaaacatagcagcaacctgatcttgagtcggccgattcgcaacatgcccactatgctgtggatgctccctcgttaacaaccgagggttcatcggctggcctggcaccatggctgatgtagcaggtaagggagtcgatgctggcgccgtcggctgagttgtgggtgcaacggacggaactgcttgaatagatggctgaacatcggtgatcaaagatcgataatttgggaagacacctccttgcaaataaactgggcctgcagcctgatgctcagctattgaaccatcggctattgtcttcatcatgtttgacaagcatgatgcacagcgtaatcaacccgatctgggaagttattgaaaaaatcttgtgccacttcactattctgattaagatttcctccttgtggcccctgagcaccatcaccttgaacgccatgaactccttgagaattgtcgccttgatcgcctagagagccgtcggtagcacctttgatactcggctgagccgagccgcctggagcttgtttcacttctctatctttagaagaaccggtcccgggactatcagcaaccacttttattttatacttctgaataagtgtccccttgcgggtctgcatgaatgagttcaagaactgatcccgtgcttgctgcaacgttgcttcaaactcttcctttttctcaggtgtgaatttctctggatcgatcggcataacgttttcttcaatgatgtcagtcaatcccaacttcagcgccttgcctttaacggaacatgggctagatggtggtggtggttgtttctcggccatgaagaagaattgtcggctgacttcttacgagtcccaccaagcatgccaaaagcgtgttgacagaaaaaaagtggcctgggagatctgcttaactccagtgcaggtccaaagctcgccttcgaatgtatgagcgtgccagttgatttgatcctgtaatcaacaagaaatagaagcaaagaaaccgcggttaaatctataaatgatagccgatcggctaggtgccgatgatatatcaattatctttgagccgatgtcatatgtgtatcgatcggtagtcatgaataagtaagaaggaattaaatctactcgatcggctgtagatattaacaatatatactccttatatcgatatatacttaaatcaagtgattgggatagatcggtcgccatgccgagacagtataaatcacttagatcaaaatatatatcaataacaggactatatatgtttatagcatagcgatcagatagatctaacatgtatcggctaatactccgatactactctatatcaggatattaaaacaggtataatatatcaaacaaaggcctaatatacttagatacagcaatatcttgacatgaagggcagatttaacatgtcaatgaagcatatagagcaaatatagttaaatcagataagatcggctgaaactccgatgctaccctaatcggcaactagaaagcaggctagagattgatattctaagcacgacttaacatatcaaactcaactgatgcagtattaagtatgaaaagaagaacaatatctagacaatcaagccgctggaagtctcatagagtggtagatatcttacataatctgaaccaacgtcaaaatctaacctaatcggctgccctctttgatagatgttagccgattgtaggttagatagcgatattgccagagattatgtaagatatatgataactcgacgaattacataaacaagattagagtgtcataaagatggaagcactaatcccaagaatacaagtcatcataataagttttacctcttgttgaagatcgaaaccaatgcagctcaacccgaaagcaagaactcgtcgaaacaaaactaaagcaaaagggtggcgatgcgccgaaatagtattgaacgtgtgtgttaaaagttacataggactcgggtctatttatacccaagaattaaaagatacgtccataacggacatgactactatctctaacaaactctaagataccataagtctttgctgcaaacttttgcccaaacctatctctaaggaaattacataaaacatcctaattaatagatacaattgcctcctcaggactctatccatgtgcggcaatcaccttgaagcaccttgatccaacccgacatcacacatcaagttgtattgtcgggatcggctacatcggcttacctagcccgactcagactcagccgatcttttcgtagccgatctggactccagccgattcatgctctgttttcgaactcgatctccgcctccaactttgctttgatctgatctgatcttctttcccaatgccgatgttaccaaatttggttgttaacaacagcctcgagttaacaaggcgtgtatctattatgggcgtaggatatatgcacgtacgggactcgctgctttggcttcccacacgtaggtagctgtctacggattcaagtgaacgaccagcgaaactatttctatacctaatcttaactaattaaaagattagtatttttccaatcgtcaccaaaattagtattagtattttttcgtccgtatgcgctatttttttcactcgtctgtgtgcgatctcctcccaaaattttggttcgtcagtccacgcgagatcgagagactgcatcgctcccgtcccgtacgcgcgtacaagcccagaactatgcacggaaacaagagaaactgaatcacaaatccaacaacaataaagcaaaaccatcccaaaatataaatcaccggggccaaaaaaaggaaaaaacttcacaaaaaaaatcaagcattggccggctcggcgaggcaatggggaggaggagacgaccatcggcgactcggacgcagcccagtgcgcacggtccacccctcaccacggaccaccaaatccatggacccgcgcgagagtgggggcaaagagacgacggatccgtgcgggaagggaagaggtcgctggatccacccctcccatcgccgctgacggcagatccatgcgagaggagggcggagagatgacgggatccgtgcgggaggggaagaggtcgccggatccgcccctcccgtcgccgccgatggttgatccgtgcgagagggagacaaagagacgacgggatccaggcatcggtggtggatccgcacgggcagcatcaacggcttggaacgttgcatgaggaggccttgccgtcgcctccagtcagccactgcgcttcttcatcttctcgctgtcgcgcttctccatcttttgccggatcaaggagaggtggcgccgttggccgctgctgcagccagtaggcggaaggaggcgccgctactacaggaaggaggtgcaagggctgagtatgggaggatgtgagggcgcacgctggtggaggcgctggatgcctggatgacggcatgcgatgtgaatggggaaccagtgaggagggagagagacagagagactgggatagagaagagcctagagagtaaacgaagagcctagagctctcggagcagaagagctctcggagctggcaacctcctcggtaatgaagtacgaggttcagttttttcattaaaaaaaaactacgaccggtcaaaggtcctttctttattgtgctattgattttcactgaaaaaagttttttttaatacacgtaaaagtacttcacaactaatgatgatttttctttattacttttattgttgacatcaaaatcacttaaaaatctcttaaagtttcagttaaatacaaatatttgtttgagactaaaaaaaatatcgactgaagaaaaaataaaaagtttccacgagataagccaaattagaatatttgcgctatcatccacgtgtcacatgacctgtctccacgtgagtccacgtataattttgagttgacagatcgagaaagcacgcatgaccactagagactatgagtaaatatgcaaaagtgactatgagtaaatatgcaaaactattttttatctgcgacactactacatgatatattttcctggacactgcacccttttgtttccatgcggtctgtatgtagaaccgcatggaaaaataaggggacaggcgctgggctgtcgcccacacaggaaaacacagtatcccgcgtgggcggcttaagccaaccgcacccaaattttcacccgcacgggcccaccgcttttaaccgcgcccacacacatctccccctccgcccgctcctctcctcccacctccctctcccccactccactcctctcctcccactctcctctcctctcctcttttcccctctctcccagccggccggcggcgcgacagcatgtggcggcgcgcggcccctccctccctctcccttgactgcgggtgggaagaagggcggcgagagccagcggcggcagacgaccacggcggaccctcccctccgtccccttgcagatccggtagagggggcggcagatccggcggagggggtggtagatccagcggcgcgcggcccctcccctccctccccttgcagatccagcggaagggaggcatgggggcctggcagagcggcagcatgcgtcagtggccggcgtggaggtggggcaacggcgtcggcgaccggcgaatctatctctccctctccttctctctttgttatttgtgattctttgtgatttgtgagatgcgtttttgagttcatttgttgctgtgagatgtgttcttgtgatgtgagagttcatttgttgatgtgagatgcgttcttgtgatgtgaaatcattgtgtgtcgatgtgcgactacggatccggcgccgtcgaccagaagggaggttgtcctctgcatcggcaacgatgacgatgacctcgccctcatgacgtcacctaccccaagcgtgacgtggacaacatgcagtggttccgggaaatcacgctgctataccgtggccaccgcctctccgcacccttcgtcctcggcctcatcgtgctctgtggccacgccccgcccaacaactagtgcccatggggacgagaagggcgtgggctgcaggaat

SEQ ID NO: 64990 - DNA, 3548 bp, Oryza sativa
acacgggggcgggcgcgtagcagcggctgcggaggacggcgtcgtcgacgagggatgacgacgggtcggtgagggtgtacgggtggttggcctcggagaagacgaggacggcgacggccgcaccggtgaggatggagagctccgaggccttcctgaacagcccggcccgcctcttggtgaaggtgacgtgccgccgggcttgtcctcgatgcggcggatcccgatcgcctgccgccccttgctcggcctcccgcgcggatgaaccatcgctcgccggcgcgcggcggcgctgcttcttccctaaactgaaggatgcggcgcggcggtgcggtgatagcggcggcggcggcgcgcaaggagtttatgaagtggaaagtgttgcaaaaaaaaaaaaggcgggagggagggagggagaggcggtgaaaacggacacggagaagatttgaattgagggggtgaaaacgaatcctcctcgtacaaggagaggttagattttggaaagttttcctagtcatccgtaattccgtacggccttgttagttttgggcggggtcaggcactcggctcggcttggattaaagcccggccaacaaaaaaattgcgttcagttaagcctgggaaggattggatccaggcctaccccggcctttcccctcattctgggccgggaaaaacatgtggaaaatatccacgagatggcgcaggatgcagcgcgtgcggcggcgggcgactcaaaggcgacggcgacggcgaggtggcgctctcccctccggtggccaccttatcaccggtgagtctctcttccttcccctctcctcttccatgtgggtggccatgacctagggttttcttcgagcttgtgttcctggctcaccccgacaaccatcctcgctgctcggtactgaggatgggccagtgccgctacctgagcctgtgttgattagtgaaaaatcaaaagtgggagaagataatttaattctaaacatattgcaatttaattctgcttcgttctccttagaaaatcatttggacgattactgaaagtatagtagcaatatagtgggagaagatttttaataagtatttgctgcagatttcttttaatactatggtgagacatcctcaaggtatgtctctgaactttggccacatttgctgacagtaaaagtgcaatcactatacaatttgggcaaatactcttttttatgtaattaaactgggtatatactaggagtggcaaaataagaatttaattagataattatactaaatttaccagattgtgtatgagtggaaataaggacattatgcatgtttataacttgtgagggctgatgtgttccaagcaacttcctaggatgtcagtgtggaatagaactttttttttgttttgatctgtctgatcttggatgttttattttattggctgtttcctaggtcacttaattgaagcatgggtttttcttgctcaagcacaattttatccaactgtttgtggtaagcatctagctgaccttgacaactaataagatctttgttcatgatccagatgaaacgggctattgtgaaggtgatggggtgagtgtactggcttgaggggtttgtgaggcttatgttcttggatgaccagacattctaattatgagaaacgtcaagggcctaattgtgagggtggcatcctcaccctgtggcattaattgatgctgctgctatatttttgcatgaattcagacatgtttgtgaaatcattatctttgagctctaggccttgatgatactacaatatcattgttttaatgattaatccatagtgcaattcttgcactgagacatcagacgtggttatgttagctgaattgatgcatgtgtgaaattgatgcatgtgccaaatccctgccaaaacgaacgcatggttttaagagaggggtttgaaaaatgcaatggattcaaaccccacagattggttaatatggaagggattcacctaattcctcccctgataggttctccttgggattatttcccaagcaaccgaacaaggcctacatggaaattgctctagctagtcacggtaattttttatttttatgttttacgcgtggaacgaaacggtgatgtgagtgagctgccatacacgtacgtacaagtgttctactccctccatccttaaaaaatatccttttatatcttttaatttactagaaaaaatacccgtgcgttgcaacgggtgaagtctattttattcttattattgtttcgttaatataaaattcactgtgagagttcgcttagatattcttagaaaatcatatgatgtagttatgagtccgatcgtctcaagttagcattcgagtttttttaaacagatttcttatatgattccttctgtattaccaaaaatgaacaatcttaaaaaccgactgaaatacggatatgtattttcaaaagcaaacgaacttaaaaaccgactcatacacggatgacgtaccaaaataccggcaaaaacatctttaatttttataatagtagagatctcacagagagtattttataagttataaggtctaatatcttaatactactacttaatatttttcttcttattttagccatccaaccatttaccctcttctcctccctttctcctcctcaaccatttactctcttctcctcgtgttgttaccctccttgtttttttctctctgtattaatggagagtatgttttttatttctcgtacttaattgcctataactttctaaaactacttctttttgagggaatataaattctacaatgttgctcatattattatgtattttctacttatatattttttgataaatacgatatatttacaggtttaagaaaattataacgtgtaaacttgtaagaaaaaaatgtaattttaagacatgttccttataacgtgtttttttccccactaactaccgcaatccacagaatgtaaaagcaatgcacgacgattggatacccaaatgggaaaaaaacgcaacgtgcgcgagaatggacggatgtaagcgacgacataccaaattataccatgaaaacaactttggtagagatacaatttttctaatagtaaagatatattatgtatcagcctattttattactaggtccgaacatattttgaaatttatagttaattttagaggattttttcatcgttattgttgccaacatctttcatgattgttaaaagaagttaataatctacctaaaatcattcttcaaaattcgaactaacaacttcaaagccactttgaattataatccacatttgaaccaagcacagccataaatgatgcacattagctcaattaaaagtacattaaaataaaatatttaccgtttaagataagattttatcaaactataaaactttggcaacctataatttctcaaataattagcataaaaaagtatccatatatttgcttgtttgagaagtactattataatatcataaacttgttctcatataaagttaacagttaacggtcaaagttttcaaaattttaatta

SEQ ID NO: 64991 - DNA, 1612 bp, Oryza sativa
atgcgtacggtgtgagccccgaaaaatggacgacaaaagttgaaatcaaagtgaagaatgtttctgaacatgcaaaccatccatcaaagatggagactttggtgtcatctttctgcgatccacaggcctataggtttgacgcggcgaaaaatgaacattatgtttgtggttttgcaaaaagcgttgaatcaatcccaaggtctatatatctgaaactaaagtatgaaacagtcgatgtagtttgcatgaaatcgtttctggtaaacctggaggctcgcttgtacacagaggcagagggtgatattggtgctgaaggtaagatcaatgttatgccggaaagctagtgtgtggctaggtgaggctcatttgtgttttcttgtgtttctaaaacttatggatgaatgctgcagaaccagatcctgagatgtatgaggatccagatgtggtaagggaagcatttgaaatgcaagctaggcttcaacgtatcgcaggtagtattggttattttctttggttagtcgatcaatacatgaacacagaaaaattctgaccgccataccatctattgtctatgcatgtataagatggtgatgaaagcagcagctcagcaggaagctctttaggcatgagcgttgattctgattggagcctgaaatacagcggtcgttgaagaggggaagcatgctggtggcaagaaggtgtaaacgtatgaaatgagcagggatgaatgtgttagtaaactgtagggattatatcgtatggtgtatgctcctagtgtgttagctctgcgttgaatggtgacctgtacgctgtaggaaccatgtagtaggttcttggactgggttgtattatgtgcatggatgcgctagacagctagaaaacacatctgaatattatgtgggtattgccagctagttatctttggctgagagcgttgatgagctagattgttgttatggctggtggtaacctctctgttgacgctgggagaaccaacatagctatagcgtgaaatgggggacaatgtagcagctattgcagcagcgctgagaatggcggagacgacgagcgtagcgtgcgctgctgcataatggatgcggcagttgtcataggctgcagaaacagagctaaggaagatggctctacggctatcataccaatccgagagagaaattaagcgcaacatgtggcgcaagatgacctgctgatgatcccaacatgtaaacacatcatatagcataggtgtgagtggtaggggaacattgcatattacacaagagtgccatgttctggagtaacagtggattttcaaggtccaaagatagatatagacgaacagaaaaacgactgcaggaaacaaagactacttatgcaaattgataaggaagaggtcttgaacaaaaggcctggctagcagaggagtacatccgctggtgcaaacgatattgtagggggaaacaaaagtagcagcatactttttctttgattcactgcaaaaagaacagaggaaagggtatgtcagctgcattgagcgaagcatgtatacttatctgtggggaagcgagatgactacccaagtaattaccttgttgtcgcccttgctggggctatc

SEQ ID NO: 64992 - DNA, 1297 bp, Oryza sativa
tgagaatgtagatcattttgtaatgtaaaaatgatagttttaaatttgatttatatgtacaagttgaaaaaaacataatatgaaaaaaaagaatttaatttgtttttcttctaaatatgtatattaagtttaattaatttggaattgaaatttagtgatataatatattgctatcgtatcaatttttttttggagattttgaataactaactgattcatattatatttggtagacaaagtaggaacaaattaacaaggggatataccatacaaggaagcaccgttcctacaattccttcccctcctacaataaacgcaatcctatttcgcacatgtgaaatatggaaatctatagagttaagtctaggtgaaattattcaaaagaattttgagtacgatgttggcaattcattcaataaacacaaatttgatgattttcagagccatatgtagcaaacacacaaaggaaagttacaaaatctattattatatattaaaagtctattaaactttatataaacgctcccatatcgacacgtggcattcctatgaacgctcctaaatttcctatgaatgctcctaaattaccacatggcattccaataaattagtaaaaataaaaaacatactcccttgattttaagtaaattagtgggtccaatatcctaaaccatcatatctaccctataatgcaccgactcattttactcatctttcactcctacactattacatttatcactcaacggttcagatcgtccagtgtaaaatcgaaggatcgagatcaatcccacctccacctccctgaattgcgcactccccccctctctctttcttgccttccagatccgcgtctcctctccatcctcatcccacacgcacatccctctccccgcctctttctctcgcactgccccatctctagcatgtcgccgccgacgaatctcctcaccccgccatcgccccttccctttccccccaccgccgacgaaactcctcaccccgccgtcgccccttcccttcccttcccccccaccgttcatcggcgacgatcccaccttcggccctaccggatccctctccaccaacggtagagaccctcatgccctaccggattgatttgataactacaagctccatccacacccagtgctccactcaggtttgatcccaattcgctgcctgctccactcctttgatccctgttccccccttttgtccagataatcgcacacttgggcaaactcaaccaaatttcgattttcagatatattgtcatatagtgttacacaatgag

SEQ ID NO: 64993 - DNA, 1909 bp, Oryza sativa
aatggggctataaatagccccctagggccatgtaatagggggatcccaaaaaatttggtcaaagtaatacaattgttcttttatttcccatccactgttgagagaaccacgtctttcgacgtgacgcagttgtctattcgacaacacatactttcaatatacttatctataatatactaagaaaacattaaaattcctagaaatgctctttagccatcacatgagacttctaaaaatgctcctataccaccatatggaggtaacatttagccctcgatttttacttaaataggtggtctattattattttagaccattaggttataataaaaaagaagttattcctccctctcatctcacccgcgtgtacatacgcctttcttattccgttcgtatgcatgtaacgtatatgtgccccactttttttactctccatttaaccttttctttatttagttttatcttgaataccctacaatacatttgtctcacctaagattttttatgctattgatatttgagcatatatttaatcattcattttagtataaaaattatgtaattataataggagatcctaaatactccgagaaaaatacaaaacattcgacccttgatttttactttaaatcgatagaccatttttttataccattagatcatatctattaggaaaataacacttaacaaaccgggaaaaaaaatgtcccatgtacgtataaatacatagtactgttcgctgggcaaaaatgccaaaaaaaaagattatcctgtgtacgtgtgtactcctactattcgccgaataaaaatagttttactatgtaagatgtgctttaataccccttattaaaaaccgcatgaattttaaagaagatgaatggactagatcagaaggcacctaacatcctaacactactacagaagatgccatatgtgccggttcgtaaaggatcgttcatccggtaccaatttatcggtaccaataccagcaaccaacacctatgaggaaaatagaaccgacatctttagctttgcacgagaagaaaaaaataaagctagctcgagtcgaaccgaactcgccaacaacgtaccatcgctgccatcatcctcctggatccaccgtcgtcgtcctcgagcccatttccctgctgctgaggccgatagggagaggaagatggggagggaaggttgttgccacaccgtcatcgttgtcaccacactgtacccctgccgtcgctgcaccgcgccccgacgaaacagcttcggtcgtgcccccgctgtcgttgcgccgtgccaagcaaacaactttcgtgctataccctcgccgtcgtcgctccgtgccacgaaacgtacagctgatgcaccatgctatcgagataggaaggggagggggagagggatgtcaccgctgattgggggagagagaaagcggaggggcagaagggattatgattcttaccaccgagatattttaagggattatatatgatacacattttatgactcacgtttctttacaatgaaatggccgaactatagaactcttttcccagctagattaatgactcgtgtatagagctgtttatgtcgaccaaattaaccaaaaatggactgcaaaatgattggagaaacggccaaacgggagagtaaaacttgtctggtagttcttggaaacaatcaatccccgactgttatggacacacgttatttccacgcgtatacgtccatggaacgccaagattgaacgactattattaatacggatacggatctagcttcttacataacctctgattcatacagatacttgttcaaggttgtctaactattaacaatcttgaccatcccacgtcattatgtaaacatcaggacaacaggactacctatatatatatagtccacccgttag

SEQ ID NO: 64994 - DNA, 1696 bp, Oryza sativa
gctctgggcacaggacaactcatcaatctggcaacatgttcaattatgtttgatgatgcttcttccccaatagtgatcgattccatcagaaacatactacatattgagaaagatagctttgaggaccgatacctaggtttgaaatcctcgaaaacaacttagaaacatgccggccttatacttaaatccaaacttctcggtcaacatgatattccatctttgagaatacaagcttgggctcatcgactccaataggcaatatatcaccatccgtaatcttaagaaactctgttttccaaacttttcaagataaacaatcaatcccttccatttcccaaatatttaaatcagcactagccacttaaactgacttatcggcttgcacgatttcaacctggtctccttgccattgaatcaaacattgatgcattggtgaagggatgcaacaattagcatgaatccaatctcttcccaacaacaaactattagaaccctttccatcaattacaaagaatgtggtaggaattgtcttgctacctactatcaactcaacgtttaaaactcccatggtttcagaagaattgcccccaaagatcttcaatacaatatttgtcttgatcaaatctctttcaaaccggccaaactttctgaaagtagtataaggcatcaaattgacatcaacacctccatcgactagcatcttagacatcggcttgccattgacataacctttgatataaagtggcttcaaatgtcaatgttgttatttttaaggcttctcaaacacggcttgttctgatattaattttaactcagtcgatggttcgatttctcctttatcggccgtgtgtatgctgtattcggtaggcaacataaataccatattgatcgaagttgaagcaattgcttttccctcggcagatgttgaaattctattcctttccttatcgttttcaacctcattggctatcacaatctttgattcaactcgccactctttccttgtacgtttcagccgatgatcgattttctcattaacttcctgtatctgctctctatttctcaatctctgaactctccttttctgactccttgtaaaaattctagttggacaccatcgagggttctaagcttgatcaacttcgtcattttcaacttgatcttccatatgatcttgacgaatcggcccaatcttcaatgaactgatctcctgggttctggccgattcctatgtgatttaagactgttaccctgggaagactgattgtaagaattcgatccaccacacccagggcaattgttgattgatggcaacctcattccatcgttccaacaaaacctgaagaactcacaacttcaatgatgattaaacttatcaccttgataatattcttcatcttggtcatcttgataatatatatcatcttggtgatgactacaattctgaaaattcctctgaacttgatgtcatgcctcttctggtacttgttgatcaatcttctgctgtcaatcgtggcatgcaccacatttacaggaaaaggatgttcatcaatcttcatcggcctttttccatcatcaaacttgattcttccttgtttgataggcgattgggtctgctacctgaacactttgcactcattggtatgatgagatactatattgtgccacttgcaaaacttcctctgggctgcaggaa

SEQ ID NO: 64995 - DNA, 1506 bp, Oryza sativa
gaaatttttaagcctaattaatccataactagcacatgtttactatagcatcacataggctaatcatggattaattagtctccatagattcgcctcgcgaattagtccaaagttatggaatgagttttgtcattagtctacatttgatacttctaattagcgtctaaatatccgatgtgattttagtccctgatccaaacagcccctggctggcaaattctatgaatgatgaagtaacaacacacaattcactatcaacgagcatatcgtctgccacttcattttaggtataatattcaaatttaattctatcataaaccttattaacgttgattgccttgctgaatctgattaatgtctttatgtttataataaactttattgatgctgattgcattgctagccctggctgagacagggtatatatatgaattgtctttatctgatctaacaaaatattaaacgatgaggttagtccatgcattttttatattaatttgtcctctcttcacaaagtaaataagctaatgctaacaatacatatcgatatatctcaattcatgcaaattaagatcgaaatatggcaatcgagttagctataattcccgttataaattccaacaagatactgtctccattccaaaataagtgcagccatgggtatccgtgtaccgtccatctgatttgaaaattttataattttttaaaaaaattagtcacacataaagtactattcatgttttataacctaatacaataaaaatactaatcatgaaaaaaattcaaataagacgaacggtcaaacgctggatatgaatttttataaaactacacttattttgggacgaagggagtacatatttttcctttgttaccgttagcacgtttttcaaactggtaaatggtgtcttcgagtgaaaactttcttcatagaagttgctatagaaaacaaataaatccatttattaagtttttaataattaaaattcaattaatcatgtgctaatgacttatctcgttttgtgtgtgtacttaatcttcatcttccatcagcttcaaacgggccttaaatctttttacatgagtttatttaatcctctagggttaatttaattttggtgacgtataataattgttttaatatttatgcctttaagggtcagcaaattaattttttcttgatctgaattagaataaatttaattttattagtccataaatttaggtttgaataacacataacgattgccatatatatttctgtgttatatctatgtttgcaaaatttggtctttaaaaaccttaattggatcattatttaattttaaactactaaatacactatttaaaaacgtgaaataaagtttattgatgcttttggggatatttaaaaattcagagaacgtaataatttctagagattgggcatgagtaaacaaatgtagtagtaggtttatatttcattaggtaaggacattccctgcgattgtttttctatggaactat

SEQ ID NO: 64996 - DNA, 2526 bp, Oryza sativa
gaagcgcctcttttctgagatccgggaggtgaagggggagctggagagcatccatgccttcttgcaggcagccgagcggttcaaggacgccgacgagacaacctccgcgttcgtcaagcaggtgaggagcctcgccctgagcatcgaggacgtagtcgatgagttcacctacgagctgggggaaggagacggccggatggggatggcagtggcactcaagaggatgtgcaagatgggcacatggtctcgcctggctggcaatctgcaggacatcaaggtcaacctgaaaaacgctgccgagaggaggattaggtatgatctgaagggcgtcgagagaggcgcgaaatcgatggcgggaaggaggagctcaaactggagatctgactctgtactcttcaagagggaggatgagcttgttggtatcgagaagaagagggatttgctgatgaaatgggtgaaagatgaggagcagcgccgcatggtggtcagtgtgtggggaatgagtggaatcggcaagacggcactggttgctaatgtttacaatgctatcaaggctgactttgacacctgtgcttggatcactgtgtctcagagctacgaggctgacgatttgcttaggcgaactgctcaagagtttcgcaagaatgatcggaagaaagacttcccaattgacgttgatatcacaaattacagaggcttggtcgaaaccacccgctcttacctggagaacaaaaggtatgtccttgtcctagatgatgtatggaatgcaaatgtttggttcgatagcaaagatgcatttgaagatggcaatattggccgaataattcttacatcaaggaattatgatgtggcgttacttgcgcatgaaacccatataattaatttgcagccgttggagaaacaccatgcgtgggatctgttctgtaaagaggcattttggaagaatgagataaggaattgtccgccggagttgcagccctgggctaataattttgttgacaagtgcaatggcttgccaatcgcaattgtgtgcattggacgccttctgtcatttcaagggtcaacttattcagactgggaaaaggtgtacaaaaatcttgagatgcaactaacaaacaactctatcatggacatgatgaacattatcttgaagattagtttggaagatctaccgcacaacattaagaactgcttcctttattgctccatgtttcctgaaaattatgtgatgaagaggaagtccctagtacgactctgggttgctgaaggatttattgaagaaactgagcatagaacacttgaggaagtggcagagcattacttgactgaacttgtgaaccgatgtcttctgttgctggtgaagagaaatgaggctggacatgttcatgaagtccaaatgcacgatatcctccgtgttttggctctttccaaggctcatgaacaaaatttttgcattgtcgttaaccactcgaggagtacacatcttattggagaagcacgccgtttatcaattcagagaggggattttgcacaacttgcagaccatgcaccacatcttcgatccttgctgcttttccaaagttcacccaatgtcagttcgcttcagtcattaccaaagtctatgaagttgttgtctgttttggatctaactgatagttcagttgataggctgccaaaggaagtgtttggcttgttcaacttgcgttttctgggtctcaggcgtactaaaatctccaagcttccaagctccattggaaggctaaaaattctgctggtgttggacgcttggaagtgtaaaattgtaaagcttccattggcgattacaaaacttcaaaagctaacacatcttattgtaacttcgaaagcagtcgttgtttctaagcaatttgttccttcttttgatgtgccagcacctttgcgtatctgctccatgacaacccttcagacattactactcatggaagctagttctcaaatggttcatcacctaggctctcttgtggagttaagaacctttcgtatcagcaaggtgcgaagttgccattgtgagcagttgttcatggccatcactaatatgattcatcttacccgtcttgggatctaggcagacagtagtcaagaagtgctgcatcttgaatcacttaaacctcctcctctacttcagaaacttttcttgcaaggtacattatctcatgaatcattacctcatttcgtgtctgtaagcaatctgaataacctcacgtttctacgtcttgctgggtcaagaattgacgaaaatgcattccttaatcttgagggattacagcagttggtaaagctacagctttatgatgcatatgatggaatgaatatatacttccatgagaactcatttccaaagctcagaatactgaaaatatggggtgccccacacctgaatgaaattaagatgacaaaaggagctgtggcaagcctaacagatctgaagttcctgctctgtccaaacctgaagcagttgccttgcggtattgaacatgtgaggactct

SEQ ID NO: 64997 - DNA, 1213 bp, Oryza sativa
ttttttatcattttcaaaaggacataaatgcccttggcttcgatagcatgtaagaatgtaaccccaaccagacccaatcatgtcgcacttgtcgttcaccccacatctgaaatctgcatccaacctaaccctaggtggctggtggtgacggtggtggcttcagcttcaaccgtgactagaggcggcggcttctgctttggctgtggcgggcgatgagcggtttcttctttgacggtggctggtggcggtggcgggtgagcgacttctgcttcgacggcctctggcgatagcagtagcagctttggcttcggctaggggtgaaaatggagcggattcagacggatagtggtcataccatatcctaaaccatattttttaagcggattcgaagtgggtgcggatagtgtgcggatgcggagtgaattgtttcggatgtcagaaatggtgtggagtcggtgcggaatcggttcggaaacggattaaatttatcggatgttacgtgcatatgcaatcaatgcaacatcgagttagcaatccaaagaacaataatacaataatcaataaatgacctctcataataattatatgattaagtgctaaacaacatgaatacatgatgtctataatataaaaaatatagatacgtgagggtgacatgaaacaataaaagccttagactaaaaaatctatgttaattgatgaattagggcattggatgtaccaacttatgttatatgcaatagatagagtggttatatatgttgataatttcagattatccggcaaacggcttatcggataatccgataaaaatgtcggataatccgcatccgccggattttatagataccatatccgcatccgcatccgcctcatactatccgcatccgcatccatcggatatctaaaagcccataccatatcctcgtttcggacggattcggagcggatcggatcggatattatccaatccgttttcacccctaggttcggctatggctgcggctggtggcggtggtggccgagcggcattgggaagtgatagtggtggtggtggtgttggtggagcaaagatggatggctcggcttcaacttcgttcttgcatcgccacaccggtggttggggttacatgctactgaggccgggggcatttatgtccttctgaaattaaagatcaaagagccgatcgactgacaagccaatgaagtaatt

SEQ ID NO: 64998 - DNA, 3099 bp, Oryza sativa
tacaaatagtaatagattcgtaactgaatttggagcttgtttgatctgttgccttgaaatattttaacttactagaaaaaaaaatgcccgtgcgttgtaacgggtgaacgctattttaatcttattatacggtttagttaagatgaaatatactttggaaattcgcatggatgtatattctgtttttagaaaatcatgagctgcagttaagaatccgatcgtcttaagttagcatgcaagtttttataagagatttattatacgactcttatatttccaaaagcgaacggacttaaaaattaactcaaatacggatatgtatttccaaaagcaaacgaaattgaaaaccaactcatacacggatgacgtaccaaattaccggtaaaaaacatcttcaatttttataatagtagacgatgattttggaaactattactctaaacactgtcaatgtatttaaatagtattttgtggcggaagcagctctatgataaaaaaaaatagaacagagatggtcaataccacaaaacacccaatacaagtcagcacttaggggtgaaaacggtcacagaaattcccgatcgaccgaccgagcgccgttttcgtataagggtaccgtttctgacggtacctttttggctatttttaaattttgttttttctaatttctttctgcatcgtattaatgtctacactgagtagtttagatgataaatatggtcaattactagccgatcgagcatcgtttctgaagagatgctaccaattctgatcgtttccgaccattttcacaccttttgaaactataggtgccggaagtgctaaaatcggcacttatagatcttttcccacctccacggactaaaaacacaaaaaactggtggctttaagtgattataggtgccggttatgtaaaaagaacgaggtgtcggtttttttaaaaatcgacaccttttaaaaactgagccgtgagtcgagccgccgagcagcagataagggaggatagcgtgcggcgatgagataagtctctctctcggtctcatcgctcctctctctcttgcgtctctctctctctctcatcgtgcctctctctctcgcgaagcggcggtagcactggcctcccctttgccagatctagcgggaggggaggcaacgacaacggcggtctcctacgggtggcggcgacggcgacgtcgatgggcttcggatcccacgggcgacggcggtgtgctccccactgccagatccggcggcctctctgtccacctcccctctcctgcctcggcctctcctctccatctagcgagcagcggtgaacgacggtgtcctggtgcttccgccttcggtgagcacccgtgccgacttgcattatctttctctctccctccatctcgttctactttaaccctatcttcatttctagatatggaaatagcttttatccgctgaatctagtcgacggcgatgcgactacatgatttgttggtggtttttatgatgtttgattcaacgatgtgaaaaactgatgaacattcgatccataaacttgttgttgattgtctgatatgtagttttttctttttatttggatttttggatttatttctggcgcttcgatgcatcggttcggctcaatttgagccgagccagatctttttttcaaatcctatacctcaaaggtgctggttgggaaaaccaacacctatgggggtttctcaatcggcacctattaaggcttttggtagtattggctcaacaaatataaccgaacacaactcataccgacataggcgcaaccgcatgcccgtgggcccgtgcacggcacagagtttccctatgcatattgatgttgacaattagcatagtcactaaagcggcgaaggggaccgatatcaagtgaaagacaaacgattggagcctcggcgtgaagggttgcgtaatcacgaaattagaagatgaaactgttggtttttttttttttttgacacgccgataacacgaactggatccacctaaaattttgcggtgttatggtgttgccaactacctgatttttctgtcacatttcctctttttggtggattcatttatgttctttgctttctctacacggaatccttcatttcgagcacaagaaacgcttgtgcaaaacaacaccatcttttttcttttgttgtcccacacgaactgaaaatccgacatgactagcatatgctatatagaaatcctgggcagattggatgtcattaaaaatcattccaacttttggttccttggaagcatcacattcaggtgtccaacttgaggactgaaaaactgtgtgctgatggttagaatgatatctccatagtaagcaaatgcaattgatgttcttgtacttacacagaatggtgcactccatgatttctgcggtgtgatgcacatttgagttggagtagaaatgttctttacggttgattcagcgtcagaaacaatctcatggggctgcaatggcacagccatgctcacctcaccatcggactcaaaaaatagttgtgcaagtcagtacagacccaaattagctccaaacattgaatccatagggaagtacagagcaaaaacgaaaaaaacagaagctatattgatacttcactgtgtaccttatttcaatgaatcaaataacacatttctttctcctcactgcaactgtgcttgtgggtgtgcgaggcgatagagcacggacaactcctagtgtgcatgatagtaggcgccactctcagacttaggggcggagtgcttgtcgaacaccttgagggcgacgaagtagctgctgcgatagttcctgcaaaaaatatgggttctgtgaaaatgtagccgaatagtgtacacacttgcttatagaaaatatgaagcttcacctagcgcaaatcagatctaggtgtacgagcaaatgcatttggcaatagttgtgcaagtcagtacagacccaaattagctccaaaacattgaatccatagggaagtacagagcaaaaacgaaaaaaaacagaagctctatttgagaacatatcgaaacttcactgtgtaccttatttcaatgaatcaaaccacacatttcttt

SEQ ID NO: 64999 - DNA, 4135 bp, Oryza sativa
cccttcttcttggatgatctgtctgatctcttcatcggaaggtccgtaaatcggcatgtagaatgtttcaaacttttctttgtcaatcacaccctgtcaattactccaaaatctcagcttctcaggatgccatagatagtactaatcatttgttcgttagcaaatggtgaagttctagcaaggtaaaacagttaaatttaccatagtgaccatgtcacttagggtcatggctgtggattcccatgcgtgcgtgagttcggaggcgagatcaacagatcgcctgcctgcaagtgagagtaccattcggcctcctgggaccagttctacagccctcatcttcagaaacgccatgaaatccttcctgaactgccgtgcataagccccaacgaccacggctcgtctctctctcctcacgttcgcgtcaacgtcgtatgccggaattccgttcatcttcagatcttcaggagcctgctgccatgaaattgaaacaaaattttcgcctcaaagaataataaattcagaatgcatgctggtgatcagtactgtatgattcaaatttttattattttctaaactttttatttaaaaataaacttttataaaacttatttcaaattctgaaccttttaattacgctaacgtgacaaataacaatgtctgcaccacccatatcgagcgtgatagttttgttctatcacgacagtcatggtgtgtggtagaacaacgctgtcatgccagacaaactagcgtgacaatgttgttttgcctctgttagtatggttagaaggttcgtatgctcaaaataagtcttaaaaaggttacttttattatagaagaaaaaaaatcttaggatttctgacctcggagagccagtggaggctgttggacgagcagacgagatgcagggattcagcggcgaagagcctcccgtagaaggagccaggcacgacgccggtcaggaggacaggctcgtcgccgttgtttcgcctgaactccacgaggctcttcaccaccgtggcgaagtcgttgtcggggagatcgttgaggagtacgcagagctccgccggtggcggtggccgccggagcgcgaggcaccggcggcggaaggcgtcgacggcgatcgacgcgagcgcgagcgcgttcgggccggatgagcagcccaggtcggcgatcaccatgcttctgctgcatacgaggtcggcgatggcgtcttctatcagcggcctcatcctgttctgttcagcgttctgcaggtgcgttttactcgggattaacagcttttctgaaagccaaaaaatttcgggggtgactataaacccgaaattaagaaaatttcggaatatatcggtccgagaacatttgtattttgagcaaatttgaagacattttgcaaacttcttttactttatcgaaaagtctgacttatatatgttcagttgattttcattttttctctctataaaaaaaaataataattacattcttcctctaagcagaaaagatcataggcaattgttgattaactaaaaaaaattgtagattaactaattaagagcagagaaacgacctgaagaatggagtttcgagcatagcttgtttccccttggcctcgattcatatgtaccatctgtttggatgccatggtttttgcctaatttgcttggagcagcgctgaacaccagatacttcatctgctagctagagctagctagaaaaaaacgcagatcttgtagttgtacactcaccggcgaacactaggtatattcttttctgtgccaatcatatggcataactattctggctgctaatatatagacatttggcacaattaattaatgccatcctgcttccttttcaattatagaattagtacatatggagtctgaaagtttcagcggtacgaaatatcaacacacgatcattttcgtagcaccatcaacatgtcaccatcagttggcctgtttgttgcggcgttatctacaccactgccgccacaatatcctagttagcctcgggaaaaagtttaaggtccattaatgtacatactacatccatcctaaaataattatcgctttaagtttttatttacaatgtttgatcattcattttattaaaaaataaaatcattatttattttgtttatagcttgctttattatcagaagtactttaagtataacttatcctattttatattaatactaattttttaaatataagacgaatggtcaaacgttacaaacaaaaagtcaaagacactacttatttgagacggaggtagtactattattattgtccctagttggcctaatctacacaacacccgagcacaatgacaattgctcattcccaaaataaggccaaaaatagagtaggtgtaaattttcaggaatcgcactttgaaaatctcatataaaaatgctaatatacaatcgattgtatatatatgacatcttgtcacaaatggattaaagatggtaacagaatttcagttatttcatgtcttagattatcagtcatatcttgtttaccaatattaacttgtgcaaaagcagtgccaaggagcactgttttgattcttattctcacttaggagtaagtaataatgaaattggagaaaggagcatgcacaagccactggtggagaaaccatctttggtcggtcgaccagatttcacagtagtctcggttgtattaaaaaccgggactaaaaatatctttagtcctggtttaaaagctccaggggtactttccaatctttagtaccagttggtgttaccaactgggactaaagatctatttgtagtcctgattgataacaccaaccgagaaaaaagatcgccatatactcttcaccaccttgaagctctggaattgttctgccattttcttcagagtccactgtttcactatgttctccgtacctgcgggtagcgtgaacgtctcgagcattgtggtccacatcatctctttctctgattctgggacaaagctgtcattatccccgcgtgcccttgttctgcgccagtacaccgtgctgacaggcacgttatccctcacaacccaaccactgtggcgtacaaaattcttggctgcttctaccggggcactaggtcggccgtcttcgtccaccttagttatgatgtgccgaccctctatcttcttcgcggcacctcgttgtccacgtgccctcttctgtccagcggagggatgacttccactagcctcctcctcctcgttcccctccgcatccctctccacgttcccctcctcgttcaagtactggtttggatcctcgttcaagtactggtttggatcctcgttcccctcttcttcgttccagtactggctgcttccctctgcaattgtatcgtacagtatctgttcctcatcgcgatcagccatctgtgcatacaaaaatatttgttaagtctataggtcatatttgctaagcgtaatattaaaactctactaatcttatattaaatatctaataatcttatattaaaattgtagtaatcaaatatgctaagtctaacaatcttatattaatactctaataatcttatattaaaattgtaataatcatatacgctaagtctaacaatcttatattaaatctctaataatcttatattaaaattgtaataatcatatatgctaagtctaataatcttatattaaaattgtaataatcatatatgctaagtctaacaatcttatattaaatctctactaatcttatattaaaattgtaataatcatatatgctaagtctaacaatcttatattaaatctctaataatcttatattcaaactataataatcttataatcttatattaaaactctaataatctaataatcttatattaaaactctaataatcttatattaaatctctaacaatcacttctttacatcacttgcctgcgcgaattccttcgatggctagctaccacttcggcttgagggacaacgatgacgtcttctctgcaacattactaggaaaatgtattagtctaaacgggccaagttacatatattgtatttcacgttttaacctatatatataatcatatatgtatgctaagtttaataatcgtttaattatctcgttcgtacgggctgcagga

SEQ ID NO: 65000 - DNA, 2329 bp, Oryza sativa
  unsure (1)..(2329): unsure at all n locations
tttatgtcacattgcctagtagaaatgaggtgtggtgtttgagagaaatggtaaaatcgccataaatgcatttacacatttctttaaaacttgtatacacttcacttgttttatttggatataaggttgaacaggcttattttacgagcacatatatatctacttaaatctcatcggatccacacaaactcggattacttatctttaaaaagcgaggggattaattcaaatcccctcatgtattattccaaaaacgcttactaccgaacgtccgatacgtggagaaatcctggatgggcccacagtcaagtcgaaacccatccgttcccaaccttatcctcattcctcctcatccagtcatccccaacctctcgcatcggcttcttcgtgcagtgcggccacagcgtcatcaggcagcggcgccgccaccgtagacggcggggtctaccgttgcgggcggccgtatttggccgttcagccaacaccgcgagaaaacagtcgatgccggttaggccttgacctcgctggtggcaacggcaccacgacaaggtacaaccgttgtcaaagaggatccgagctcggcggcggcgacacggcggcggcgatggcggtggcggcgtcaacgtcacaaggagatacgcctagcgacggttagggccctgagcttgccggcggcggtggcactgcgagggagcggactaaaacttgaggcgccgttgatggagatggccctgcgctcgccgacgaaggtgaggatggtgggagcatcgagctagcaaggatgttccatgctagtttctttatgttgcacacaagtgtttcttgatgttccatttggtatttctctatgttgcaattcatatttctggatgttgcatttggtacttgatgttgcagttgatttctttgggtgttgcatatgtttttgctcttgaagtctgtgtttttagtgtttgcatccgactgaaacattttcggtaaaataatgaaaaattcttccatgaagaatggcacatcaaagaaacaactcacaatgaaacattttttctggtgcagtgaaaaattgcaacaacttatggtcaaacattgcaacatctctttaacacgtaatagaacattgcaacatctctttaatatgtagtggaacaccgtccggagatttgtaaaactccggacgtccgatatgtagtcgtcaccatattattcggaaactcgtgatctgccatgaatagtttctgacaagattgtcagcacgaattatacgcagccgcttgctgcccgcaccccaccaattagggttagatttccagtgtggaggtgttgggcttttatgtggcattcaccatttatttatggtttatatttgttaattacctcgatgntgggaatattcgctgatgtggaattttagtcgaggaattagtactacttaaggtgtcgaaaacgtctgtgtgagaaaatagtagaaggaattaatttaacatatattctattggaattgcatatgtacatatgtgatttcgtcatggtacagcacatggtggattagctggataagtttataggatcgactctaaaagctattgacccatgcatatatatatataatcatattgcaataatatattctcatatacgatatgatctatagctagcacatgtcacatatgtttgatagatactactccctcttctcaaattgatcatcatataagtttatataccaataccaaggacaatttaaatcgcatcaatcaagataccatgtacacattctctcacaatgcatctatcaattaaaactccataccaattacacagtagcatgcacacattctctcataccgcattaattgtattctgaggaaatccgtgtccatacagttatatgataatcaatttagaaaggagagactattgtattgtagactcgtaaaactgacaagtattactgacatgattcaagattctgacagtgtacagaaaatagataatgcacatactccctccggcccaaaaaaaagacaaactctggttttcgtgtccaacgtttaaccattcgtcttatttgaaaaaattatgaaaaaaaaattacatataagacggacagttaaagttggacacggaaacccagggtttgccttttttttttggacggagggagaatttgggagttgaataaataaattggtccctaaccctaagctcatcatgtattatggtatagctagcatcataaaaaagattatggtatagctagcatcataaaaaagacaaatgcatataatgtggaccaaatgtttgaccaaatgttctttattaaattaaa

SEQ ID NO: 65001 - DNA, 812 bp, Oryza sativa
agggcctcctcctcgacaccgtcggcggcgccgtcgccttcctcgcctccggcatgtcgccgcgcgcctccgtcgtttttttctcgctgtgcacggcgaagggcgtcgacgacactgcggcctgtggctgccggcggcgagcccgctccagcgcgtgttccggaacaacgccgcctaccacgacgtgcaccatcagcgccgcggcggccggtacaacttctcgcagccgttcttcgtgacgtgggacaaggtgttagggacgcatatgccctacgtggtagaggagaggcctggaggagggctccaagtgcggccggtggccatgtcgccgtcgtcggcgactgcagcggcaggcgccagcgggaaatgaaacttaaactgtacgtgtgcgcggtgaagggccaccagctgactccacagctttttcaaaaacaatgttcaatttttttctcaaatttaaattagttgataattcgttcattagagggttattttcgttacacgcattttggacccatgtaaacttcatcttcattaaaaaaagtatgattgtactgtattacagtacttccaactattcaaattacactactacaaaagtgatttttctatacgaaaccccttgatttttacaaattgaccataactagtggcgtctgcaaaaaatcgagctgcattttcacagacggctcctttaagacgcccatatggaaaaatcgattttcccatacgagcctcttaagaggtccgctcatttttgtcggacgaagaaatgatccaacctaaactgtacgtgtgcgcggtgaagggcc

SEQ ID NO: 65002 - DNA, 729 bp, Oryza sativa
acggtattcctttctgtggaggaatcaaaacaggaggagagctaagatactccttaatattatccaaagccatttgctgctctgccccccaagtaaactgctgatcgcctttcaacctcaataacggtgtaaaaggctctaaccttccagacaaattagaaataatccttctaacaaaatttatcttgccaatcatctcttgtagttctgtcttattctccggaggctgaatcttcttgatcgcattaacgctcctttgagttacctcgatccccctttcatgaacaagaaatcccaaaaactggccggtcgacacaccaaaagcacattttgtcggattcatcttcaagccatattttctggttctctcgaaaactttccttaaatcggctatgtggtcctctacttctctagacttaacaaccacgtcgtcaatataaacttcaactaaccagccgattaaatcatgatatatataattcatggccctttgatatgttgctccagcactcttcaaaccgaaagtcatgacgacccactcaaataagccgattgcaccagggcatctaaaagctgtcttatggatatcttcttcagccataaagatctgattatatcctgcgttcccatccataaaactcaaaattttgttccctgatgcagcatcaaccagctgatcggctactggcattggatattcgtcctttggtgtagctttattcagatctc

SEQ ID NO: 65003 - DNA, 1521 bp, Oryza sativa
ggcgggaagccgccagatacagtgaagacggcagggcgggggcactcgtgccgtccgttggggaagagaggaggaggccggccggggaggggggaggaggggggctcaccagcgtcgttgacccctttcggccagccgacgagtccgggcggcggcggagtcagccgcacacgagaggatgctgcggcggcctggaatgacgaggggagagataggggtttagggttagaactgcctgcacgaatcttaaagcgatccaacggtctagaatttgtatgatttgtgaggtgtttttctgtcaaatgccacttgttctttttacatatagtatatatgtattaggagttcagattaattgctcagccgttatggtgaggcgctggagattatttctgtttggcaatacataatggatcggtgacaagggatctctttgctgtatgcctagctattccatgattgaaaactgatatctcgcaatgagccagaactgagattaattacgacagaaataaaaatatccagttgtaccatctttgcctgaagttacagccaattccactgaatcgtaagttttaattataagtgtccagcctcatgaaaaagtgccagctcgatctttcttagtttttgcagaattttcacgaaaaatgaaattctcatgaaacacccccatattcttgatgattgaaggcactaggctctttgagtctatatatcccctgggatggatatattgtttcctttttgaaagtagcaaaatatttgccaactttaaaagatggcagagttccaaattaaaaaaaaatctatgagtttaagtccacccgtcacaaaaaatacatttttccgtaggttgcttacaggaccaacagaaaataccacggctcacagggaagctgagtctagtaatgacgactctacagctgtgactaatagtacagcatctttcataaaatttgcgaacattttatagaaacccatcgagaaataatattctacaatatatatgccatcgacaagaggtcaattttccgattttccatctacagatacgagttctacaatattccacctacttcccccttttcccatttccattagttaatatccattagctgtttggaattttattcacagtgctcaaagtactctcgagagagaagaaattaaaaggcacttatacggtggcatagtagaattcagtttcgttgatggagaaaacatagaattgaggatttgtcaatggctttttgtcatatagtttctcaaacattgatccagcaatgaaactgacttgggactttgtctctcttgtttaatttggcgtggaaaattttgatgtcagcatccccacactggtggagaaaccatctttgatcggtcgacccaaatctacaatagtcccagttccatttaaaaccgggactaaaaacgatttttagtcccggtttataagaacaacaggactagatgatctttattcccggtttgtatgaccaaccgggactaaagatcatc

SEQ ID NO: 65004 - DNA, 3815 bp, Oryza sativa
ttcctgcagcccattgcatgatcctgtgatgtatttgatttgtgtgtgatgtgaacttgtgatgtatttgcgatgaattttgtagaacttgtgatgtaatttgatttgtgtaattttttttaggatttgtgatgtatttgatttatgtgtataagtaacttaaagatttgtgatgtggatttgggatgttactttgatttgggatttggggatatgcatcccacttgattcgggagaaaataaaaaagaaaaaagaggaccatctgtactgctgttattccctctttttaccaaccgggactaaagataaagtatctttagtcccggttggtgttaccaaccgggactagagatcgatttttactcccggttatttcacccgggactaaagatagcgatctttagtcccggattcgtagtcccgattgaaaaaccgggactaaaggggggttacgaaccgggagtaaaaaccacttctccaccagtgccatctcatccaagttagacatggctagtccaaacgaagggattccatttattatcagctcagcccttctggagaaagctagttggcattcttcttgtgcagcctgtatcctgaaaatgacttgattagcaatgttcatggacagttttatgtgtcaggccttaccttaatttgtggcatttgatcatagctttattagcaagtctgcttaagtaaccgagacgaggggaaaggagaaatttgagaatggtgagccgttagcgcataagtaactgagtattaattattttaaacttgcaaaattgattgatatgattgaaaaaaataacttaatttttctatagaaattttttgaaaaaacatattgtttagctgttcgagtagcgcgtgtacaaagaacgagggatttttcttccgtctgtgcttggaatgaacgcaaacttagattaatatatatgaagtgacttggtgtggttattgttgatgtgctgtttgcaactcattttgcctactgttgaaattataagcacataatgatttaatttattccataaataaatcatgacattgcaatataaactagcataaacgcatcattggatctacatatgtaaattaagcagtaaaacatgaacggatcaaatatacacaacatgttgaacatgtaccgaggttgcggaacaaccggttgctcgacaggaatcactcgcggttgcgggcgtcgacgaaggcgcgcagcacgtgagtgaacaggaagacgagctgtcgcggacgaacagggagcagtcgcgctaagcgcttcccaaaaaccttattgccgccttctcccagttgtagacccccgtttttataacagaaatcattcgtgtaaacagtaccatttccctggatcaagtagtctggtacacacgagttcatagctgaaataccaaatgcacatacacgagagtctagtactaattattacaccataagcccttaggcattgtcttaaatcatcggaccgagcggttcggaatacatccaaaagcagaaatagataaggcagcggaatttaggcagtggcatgccattgccacaggcaacgaccgtactaagacctactgagcgccatcgtcttcatctccctcctggtagtaggcatagggatcctctgaagcttcatctcccgcttctgattattttataattgcaagggtgagtaccaaccgtactcagcaagccaccacagcaacaatgcatatgaaaggggtatttcaaaggatggctatggctcttttgcgtaaagccaattttgtaattcttttcacaagcctcagacctagcattgactgatcaaattttagtaccagtgtttgtattcaaacaacaacggttctgtccaccatccattgtgatcccaaggatagcttcccgccattgaatcgttatggttttctgaggacacccactttccccctcctcaggaagtggctctaacagcatataaattcatcatgcaactacccatcccacacaagttaataatttagagactagccaagtctaatacatgtcccggtgctcaataaccgcgagcacggctattcgaatagatttggtttactcacactgcagtggatgtacactttacccacactccatgactgcccaacacatgagcctcgtcccaacacatgagacgcgtcacggcaaagcttttcgataacctcgcattggcagtacccgctccatgaactttacatcctcttgcactctaggcgtacacggtttctagtagtgagagaagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggatactgcctccgctcagctatctattccgctaggtctatacccatacgagaagtgcggttgtacaagggtcgtttcatgcttaactttatggctcggtccttaattgaccagggacggcactagcctttttccggataccacccaaatcctccatccgccccagtcgaaaacatttgtttagtttcattttcctttcacaaatcatgtcatcaatatcatggcaatgtggcgctcatgtctccacatgccgcatctcaattaccttcccaaaggtaattgcctaagcatatagcatttgataaatatgagtatgcataaatctagagtaacatttctaagcatttgtcatagttgactagggacttttacgtaaatcatcgttacaaggatttaagggtaaacaataatcaaggcatggcataatcacaaataggatgttcatcattgcatgcaattttatttgtaaacaaaacaattttgcaattggtatcaacatgttcaaggaatagtgatgacttgccttgctctaggtcttgtgggtcttggtcttcacccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtgcttaattacatctagatcactaccgcgaattaatctcttatagagtttactaaaaataatctataataatctgtaagaattcatctaattgtttagttcttaaataattgatcctataattaaatgctagtattttaggtatttaaatagcaagaatttatctagctatattttcattaagcctatgattaaattctaatatttttaaatattttaaatttccccctaaatttttcctttccttttctttctctccctctttcttttcttttcttttctcttttcccttttcctttctttttctctctctctccctttttcttctcctctctttctttttctctctctctccctttttcttctcctctctttctttttccctctcttctctccctcccggctcctttctccctctctctctcggcttcttgctctcccgggcggcgacgacgatggacgcaagggggggggcggcttaccgacggcggcgatggcgacggtggcgacgtcggcgcaaggcgcggcgtggcgcggcggcttcgtggctgcggcgcggcggctctatgcgac

SEQ ID NO: 65005 - DNA, 2628 bp, Oryza sativa
tgatttcgatttgattgggattgggatgtagtttttgggttagatttgtgatgatttgggattggttgtgggatcttcagagcggatgaatcagagggaggaggtgcgcaatgcacagactaagatggatttgtgcggtttttattattcttctcgttcgatttctcttcctctacgttctatgtttggttggattttgtattcgattgaatttgtgtaatatcgatgtgtggcgcatgtgggaacggagggctcgattccgattgggattgtgggggtgggggggaggggattgcgacggacggatgaaaaggcgaacgttcgaggagacgaccggaaaaatccaaatcttttaattagttaagatattgaagggtaccaatgtgactgaaatttcggtccgagattatttgatttttaacaaaatttgatcaaatattaccaaattcacaaatgaaaaaaagaaaaaaaaactttccaccgaaagagtttcttctatgcttggaattaattaggatccatgatcacctataatccaacgcactaagattgaaggtaccaggagcaaggtagtaaaagggtggaccaggtacaagaggtggaaggttaaaatggtaattgacttctatagttaactaggaaggtagcccgcgcatatgcgcgggcacttatttaatgttgcttaaatttttgttaggaatgtttacatgtagatgtagatgatatttttaaaatagatcttgactctattttaatcatgttttcgttaatatctagtttggacatattacttgaaaccgtacaaccttgaatttatgagaacatgtgtcacgataatggaatacttgagttgtttcatatctatttgtactatatgtgatttttttaacctatataaagggtcttttaaatactaccacgataatctccaaagcaccatattattagttatattttgacaaatatatgtaattttgagtttgtttattttcaacgcttatgattcataatgacatgagacacttttactaattaacctggagaatgaatctattttcccaaacttatttacaataactaatttattgaagtatactttatagtcacattaatagggtatatgacataagcccatcaaattatgcctgatgtgttggaattcctcaactacaagaaaatataccataagcaagatcattggcttaaaatatttttcatatttgttttacatctatgtaacattcatgttgctaacttatcatatactaatgaaataattctgaagattcaaaaaaaattgagaatctcaatctcaaacgaattaaaattaaattagatctacttaaaaatacacaactaaattatgttattttcatttattttacatatgtagatttaaattagcattgtatagtcgtcaagtgatatttgacacctgaaatataatgtaaaatttttttgaaataggaaaaagtacaaattacctccataaacctgaaaacatgacatcttttactctcaactattaatagaatgatttaccccctaactcaacccaaagtggttttgttcctatgtgacagtccagtaagcatttttttcaaaaagtaaaataggtggggcctacctgtcacactatctaccctctctatctctgtcccctctcccctctctctccctcatttcctcaatcctattcccaagcctctctctttcttatccctccccttgatgcaggggccggctgggcaggcacgtcgccgctcttctccttctccttcgtctattcccctactcttgctcttttgattgatccacctcgttgtttttgattggtgctttctgtcttgtcaggagagaggcattggtggtggggatcgattaagaaccgtggtgggatggcatgctgtggtagatggagctacgactgcatttgtttggggagttctcgatggtaggggcacagtcgaacctggccatgaaggagcagcgcaggtcctcgcctccggtggccgtcacgtgacgatgagatgtgatggaaaggatagagatggcagcctttgtcggagtgcgcatgtggtggccgagatagctgaggaggagccgcctccgccgcttgagctccaccgcccaccactattgtcctcttcacgcgccggtagaggctaaggagaagtcacgtggccatcaaggaggtgctcgccggcaaaggctgaggaggagccgcctccgccgctcgccactcaagctccttcgccccactgctcaccgcccctagccttgccgattcacagacgtggaggaagaagaaagagagaggagtgaggggtgaaggagatatatgataggtgggtcccaccaatttgtttttgaagaaaatgctgacaggactaccacgtttgaccaaaaccacttcgagttgagtcagcgagtaatttgtccggtattaatagttgaagttgaaagatgtctagctttcgagtttatggtggtaattcggccgaccataatagtttagggtgtaattcgtcttttttactttaaatattatcataacattatttattatatgttggcctcatgtgactggatcacaaattagatatataattttcaaataatttaaag

SEQ ID NO: 65006 - DNA, 922 bp, Oryza sativa
taaagacattgttatacctgccaaggttgaagatctgtctaaagagcacaaggcagagatggagcagaagatgcaacaactgaaggaagcatatcttaattctttttcagtgactcagcaaggaaaagtgattcaaaaatacaagttccaaatgctagaaggagaaggatcatctggtgccaaaggagagcagaaagaagatgatgataataaaaattagttgatgactttacaagatcgtcttgattcagctgtgcatcatgctttcatctactaatctggaatcttggtcaacacgttgtaaaatctgatcaagtaagtggttgatgggttaattgctgaggagaagacaagaggaccagtatatttaccaagtggtgtttttcccaaatatagagaaatcaagactagtcttgggagtggtcaacctcaaggaaatctcatgtcggcattaggatcagcacaaccaaagcaacagccaacgtcaggagctctgggatcaagcaccatgacacctgagtagctggctcaattattcaaaacaatgcaaatttctgaaagttcacagccatcggccacacagccaacggcaagccagctgccagtaattccttctcagttaactcagccatcttcaggacagccgattgagaatccatcaatcgaaccacaatattgcaaagtggaccctaatgttctacaatatcaacaaattccagggttcaactttaatcagtttcaacctccatcacctctacagtatcggcaggatacacctcttttgtccaagctccagacaaccaatgtacaatcaatatgaacaacaaaatcaagggggagttcaacaacaacctttagccgatataattgcagatgtggtgaggcaacagtttggaatcaaacctaaagacaatgggatcat

SEQ ID NO: 65007 - DNA, 17623 bp, Oryza sativa
  unsure (1)..(17623): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaagagcagtggattctctcgtggtgcttctatatacaggggtgttacaaggttcatatatatattggtcttgtactaatctttcacttgtagcctagctagccatgtttggcctcttgcacgtaagtctcaggtaactgatgttttgtgtgatgcaaccatgtagacatcaccagcatgggcgatggcaagcaaggatcggaagagtggctggcaacaaggatctctacctcggaacattcggtaattaagtttgtacattaatttccatgttgaatctgtcgtccatgttcattttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctactttgaccaagatgtaagcatgcccacatttgattcgaaatttgtcatcttttgcgcgccatgcatgatggttttggggctttatgcagcaggcaaggaaaaaagaagacacaccatgcttagaccatggacgcatgtatatatctatggctgattgatttgcaaacctgaacactactgcctttcttcgttcactgcatgtagcagcccgtgtttggaatatcattattactgctattaccgcgctcggctttccacaaagcatgtgattggtgattaatttactactgccttgctgaaccggccattattattgtactatgttggatttaactaagcttgatcaccacactgggctacagtttcgtcagttgttgcttggtccaaagtcttactggtgcaacttgctggttatctataaacttactggaaggctcactgcactatgatgccatactttgttaagtacaattagctaattcaaatatgtttcatgtgacattactattcagccattagtaatttacaggtggtgttgattttacttcaagtacctaaataaaattgacaataacgcatcgttcttctgcatatgtgtggtgttcaacagctgattgttgcttgcttccttctttcaggcactgaggaggaagctgcagaagcttatgacatcgcggcgatcaagttccgtggcctgaatgctgtcaccaactttgagatcggccggtataacgtggagagcataatcagtagcaaccttccaatcgggagcatggccggcaaccggagcaccaaggccggcctagagctcgctccgtcgagctccgccgacgccatcgccgccaccgaagcgaaccacaccggcgtcgcgccaccgtcgacgcttgcgttcacagctcttccaatgaagtatgatcaggcagattacctgtcatacctcgcattgcagcatcaccagcaaggaaaccttcaggggctaggcttcggtctctacagctcaggtgtaaacctggatttcgcaaatgccaatggcaatggagccatgtcaaattgctacaccaatgtctcattacatgagcagcagcagcaacatcagcaccagcatcagcaggagcagcagcaagatcaacaggatgatcagtcacaaagctccaacaacagctgcggctccattccgtttgcaacacccatagctttcagtgggtcatatgaaagctccatgacagcagcaggcacctttggatactacccaaatgttgcagcctttcagacaccaatctttgggatggaatgatttggggaggtggcactttgcaggcaaaaaggatgaagagcctgatccctgatcagaggtgatgaggatcaagactgacatagttcattctcacacaacaacaacaacaacaaacataaagagcaggggaaaagagaggtaatgtagtagtagtggtatgatgataaagtatgatgcaaacatagtaggaagcagtatgcaggagagagatactgacaggtcagagacaggaggagaagactctgctaacaaaacgatgcagcgcaagcatattgttttattttactgcccttttacccttttgtagctttgttttcttgtgcttttgtcatcgctgagctttgtttgccgctcagcttcttttgagcttttctttctactgacatgattctgcaagtgccatgatagcttagcccatgtacaatggaagcagggacgtctctttgtagcttttgcttcttttcttttgttagatcgcctttggtagcggcccctgtttactcaagaagttgctctccctccacaagtatacaatgaaatgtactgcaggaactaaacaatataagtttttgtaacattttccataaagtttagttcctagttttcaaacaccccctaaatatttcattcagtactttaaaagaagtaaaaaaaatcagtactcatcacgagttatgcttgtactttctccgtttcacaatattaacattttttatatttatattaatattaatgaatctaaatagatatatatgtctaaatttattaacatcaacataaatttggaaaatgttagaatgatttacattgtaaaacggagagagtactgtttacgttgctgagatctgttacaggctgatggagcattatctccgtaaaaaaggacgaaacaaagttctgtaccaatattttcatcatgggccgaaaaggatgagatggtcggcctgacccacaatccttttttgatagttctcgttgcgccctggcccaagaagaatggccttcaggccggcccaactactggcctgcaggccggcccaactactatgggaattccatcccagccgaaaaaaagatgggctgcaagtgggcgggaatcttatcatctacgtagatgggagtcccgtttcggccctattatgggctgcacctacactaaacttctattctggcctaaagataatagccttctaagcaaccgtatcaacctccaagtacacatgtgttcacatgtgaatatgaagatttccgagcgcacttgtgaaacggatgactacgaagattaagttgtcgtatgtaaaatgagagagcgctattagtatataattaattaaattttaattattataaacttgataaatggatatatttaatattttaaaacaacttgaaaagtttccgcccaaaacgtatagtttaatagtttaaaaaatatactaatgtaaaataagataaaatctaaatcttaatcagaaaactgagataaaatttgaatcttaatcagaaaagaatggaatagtgccatgcacgaagtgtccacgtcaactcccctcaggctgtcgataagtagggtgactagggtgacaacgacgatcgtcaccgggcctaggtgctttgggcagcgcgaggtggcacacgataagtagtgggacactctagaatttgtcttaatcaattggataacatatattcaaataagtacttcctctgtttcaggttacaatgagttttgacttcggtcaaagttaaactgtcttaaatttgactaagtttgtaaaaaaaagtaaaatatatttaattattgatttgatgaaactaatttaatattataaatattattatatttctctataaatttagtcaaacatgaaacaatttgatattgaccaaagtcaaaacgtcttgtaaccgaaacgaagggagtagtatatgtataataaagtacattttacccataagaaagtataggtagtttttgctaatataatacataaacatgtaagaggatgtttacatatagtgacacataagcaaaactaccaatgtgtttattattcttattccacgactgatgtaaatgaaaaacactgcaaagcaaaatcaaactggtgtgtagatcagagggcatgaaattccataggaaatatcgtttccacaacacgccctctcctccatgctctgttcctttattaacagccacctccgccgccgccacagccacctccgccgccgccacacccgccgccgccgccacagccacctccaccgcctccacacccgccacctcctccatagctgggccgcttccgtccaccggagctgcccttgccatcggcgcagttaaacacgacgaacgccacgatcgctacggccgccacgaagaccagagctatgccgacaacactcctgctcacgtcgggcatggagccgccggcggcggcgaagcctgcgtccacggcgagcctgaccatatatatatatcaagatcgagctgccccgcttgttggtgagatcgggtggtaattaaagggttggagggagctaatagcttagctgtctatatatatatactactccaggtgaaacggacacggaacagcggaactgtcaagttgaaatatcttcatcgagtggtgagctaactatttctacgaaattgctacgttatactccatctcaaaagaaaaagaacttaggagagaatacatgattctctctttctagtataatgaatctgaagaatatcacacctctttctagattgtttttttttttttataaatagagtatacctgtaacctgcatgcaggatgtatataggatcattgccttgagaaatctagctcagaatggtacgttacgttattttcttgtctcctttttttctttgcgagaacaatatacgttacgtgtattacagatatatagcttgattgaccgggaggttttcatatatatctaaggatgactgattcaatcgttgtccatctagaagttagctaattggcaattgttcccacggcggctagttttacatatcagcttaaatgcttaattatctgtattgcgcgtccttgattgtacgtcatgtcgacaacgtcacgaccacgttgctgtttgaccttattgctaattagctcgatatctactgaaattaggctttgttggccgatggggacaaagtacttctacatccaaaacatgagatgcacttacactactacatgataaatttttctgcacgccgtccccttttattttcatgcaatccgtatgtggaaccgcacgagaaaataggggaaccggcgccgggttgtatcctgtacgagaaaatgcattttcccgtgtgggcatcttaatctaaccgcacgggcagtcgacttaagaagaccgtacggaaatatcgattttcgcgtgcgaacctcttaagtggaccgcacgcgaaaatactctcccttctctctaatttttttccctcccaacacttcaaaattttcatccttatccttatttcaacatatcctctcctcttctctctctcacatcccccctctttctctcatttctcccttcctctccccatctttttctctctcaccgcgagcaggggcagtgggccgatgaggaggcgccaggccgatctggcggccgccgccctccccggccttcctcctctacggagacagcagcgatgatgatgaggtggcgcgcaacggtggcggcggcggccacccctcgcacggatccagtggcggcggacctccgtcgcacagatctggcaacagcgacgggagcgggcgacggcggatccggccacggctacggcaacgatgacgaagacgggagggtggcggcggcgacgacgaggtggcgcgcgacagcagtggcggccaccccctgcgcggatccaacggcggcggacctccgccgcacagatctggcaacggcgatgggaacgggtgacggtgcggacggcggatccggccacagtgacggcgacgagagggcggcggcggcggcaacggctagggtaagggtttcgtatatttcaatattgtttttttttcgattttttatttttgcctgcaggcgacataagcacccgcacgcgaatattttcacgtgcgggtgagccacccgcgcgcaaaaatagcgattttcacaggcgatttgctccatacggaccgaagctccgtacgcgaaaatccgattcgaccgcacgggaaaatctatcgtgtagtagtgttaatttgttaactatatattaattatacattgtgttcatggaaattggctcacgatgaccacgcacagtgttaataaacctgtaatcgcgagcgacgagccgtatacgtggatcattacggcgaaacgcacggacacccatctgctgatgattcgccgcgagaagctactctctccatccaaaaaaaaaaacttaacctaagagaagatgtgtcccctcctatgtggagatgtgttccctcatagaaggatgaatatgtactacccttactccagattcatcctcctagaagggtcgtaatccagattcatcctctcctatgtccaacgccgacggccgcggagctatacgagtcggagctcaagtttctcgccgccggcttccagctgagcggcgcggctggggcggctcatgtacaatggaagcagggacgtctctttgtagcttttgcttcttttcttttgttagatcgcctttagtagtggcccctgtttactcaagaagttgctccccctccacaagtatacaatgtaatataatgcaggaactatcagaaattcttaagtgtagtagccagcttcataagctaaatattgcattccgtacttcaaaagaagtaaaagattcagtactcatcacgagttatgcttgtactgtttactgagatcagttacaggctaatagagcagatttatctccgtaaacaaggacgaattgaagttctgtaccatcattttcaacatgggccgaaaggatgagatggtcggcctggcccacaatccttttctgattgttctcgttgctgcctggcccaagaagaatggccagcacgccggcccaactactatgggaattccatcccagccgaaaaaaagatgggctgcgagtgggcgggaatcttattccccacgtagatgggagtcccgtttcggcccaataattatggcccgcactatactaaacttccattctggcctaaaagtagtagccttgggctgcgttcttcagtaagtttccaacctcactctattatttcccttgcgcacactttacaaactgctaaacagggtatagtttacgaaaactctatagaaaagttgctaaaaattcatattgatcctttttaagttttttaaactaataattaattaatcacgtactaatccattgtgttgttttcgtgtcggaggtgagagttcccaaccctcacggactcacctaagaatacagtgcacatgtgaaacggatgaatatgaagattaagttgacgtacgtaaaatgagatggggctataattagtatataattaattaagttttaattattataaacttgacaaatggatatatttgatattttaaagcaacttctatatagaaaatttttcacataacatataccgtttagtagtttaaaaaatatgctaatgaaaattgagataaaatctgaatcttaatcggaaaagaatagggccatgcaccatgtcgactcccctcatgctatcgatagagggcggcgagccagcgactagggtgacaacggtgatcgtcagcggatcgaggtgctttgggcaacgcgttaggtggcacacgataggtagtgggactctctaatatttgtcttaatcaattggataacatatattcaaataagcacatgtatagtaaaggatggacattttacccataagaaagtattgttatataatacataaacatgtaagaagatgtttacatacaatgatacataagcaaaattaccatagcgttcattatttcacgattgatgcaaatgaaaaacagtgcaaagcaacatgcgtcaaactgggatagatcaaaggacatgaattccataggaaatcgtttccacacaacgctatatatatacctacaccgctatatatctctcctccatgctctgttcccttcattaacagccacctccgctgccgccgccgccgccgcaaccaccgccacctccgccgccgccgccgccgccgcaaccaccgccaccgccacctccgcctccgccacctccggtgcgcctcctccgtccaccggagccatcggcgcagttaaacacgacgaacgccacgatcgctacggccgccacaaagaccagcgctatgccgacaacactcctgctcacgtcgggcacggagccgccggcggcggcggtgaagcctcggccaaggccggcgtccacggcgagcctacccatggtgatatatcgatcgagctgccgcttgctagtgagatcgggtggtaattaaagggttggagggagctagctagctagcttagctgtctatataggctgtgtgtttagatcacaccaaaattaaaagtttaattaaaattgtaacgatgtgatgaaaaagttgaaagtttgtgtgtgtaagaaagttttaatgtaatagaaatattggaagtttgaaaaaaaaaactttttaactaaacacggccttcacagacacggaacagtggaactggccagttgaaatatcttcatctggtggcacgaactatttctacgaaattgctgcgttgtactctgtcaaaaaaaataattagaagaggatatatgattcctcctagaacaacgaatctgtacaatattatatctctttctaggttagtttttttttttttgactaattgagtatacctgtagcctgtaggatgtatataggatcattgccttaaaaaatctagctcagaatggtacgttacgttatcttcttatctcctttttttttttttgagagaacaatatacgtcattgattgtacgccaagtcgccaacgtcatgaccacgttgctgtttgaccttataactaataattagctcgatatgtactgaaatttggcttcgttggccgatcgggacaaactacttctacatccaaaacattatacgcacttaatttgttaactactatatattaattgtacattgtgtcgatagaaattggctcatgttgaccacagtgttaaccgctcatcatcgccggcgtacgtggatcattacggcgaaacgcactgacacccatccgctgaatgattcgccgaggagctaggctactgccaggacggtgacggagtcgttaggcccatccaaatgtttgtgaaaagaaaatttttagatgtcacattaaatgtttgactggatattagaatgggttttcggacacgaatgaaaaactaatttttataactcgtctgtaaaccgcgagacgaatcttttaagcctaattaatccatcattaacacatgtggattactgtagcacttatggctaattatagacaaattaggctgaaaagattcgtctcgcgatttctatgtaaattgtacaagtggtttttatttttatctatatttaatgctctatgcatgtgtttaaagattagatgtgatgtttttaggaaaaaaaattagtaactaaaccagccaagtgctcgatcgccgtttaattctgaccgcttgcttgtacgccaagacatgatcgacaacgctgctgtttgaccttgacaattgacggtctcgatcacttttgaaaattatcacttggcgaaaagaaaatttttagatatcacatcgcacgcttgaccggatatcggaaggggtttcgaacacgaatgaaaaaactaatgtaacgctccgcttttcgtgagtcgttaaaaactaattcggcaaaaatcctaattgcgaaaattttcgttctttgtgtaagagtctaagttgtgccaaggatctcaatttaatcccgttgttccctctcatcgaaatcaaaatcctccacctcgaaaattcctcttccgattcgagtctctgaaatcaaattccgaaagtcaatcccttcccttgaatcctctccaaataattgttcccattcccgaaagtatcaaactcccactttgtttccttactcgtctccttgaacccttgtgtacaagtatcaaatttagattcaaatccccttttttgaatcccgttggcgactcctccatctcatccaaatcctaattccggaagtcaatctctcccttccttgaactcgttgccaaatctttctctcgatttcgagaggatcgatcctcatccgaatcatttccttgacctcaccctatgctcccttgaacaaatacccaagtattccttttgaatcttttccatgacttctccttgagtttcccttgatacatccctaaaccctcgagttcgaatatcaaatttgaattcgaatctactcctaatcagttttctctgcaaaagtctattttacctccctcgggtgttgtgggccgtattcccccttagcccacctccctccctcagccgtttctcctccctcagcctcgcacgtgcgttgcacgtgctgagccgagccgagctccctctgtttctccttctctctcggttctctctctctctctctcgttctctctgtttctctctctctctccctcgtcgaactccctctccccggcgtcgatttcccgccgtcgctgtttgaatccggacgcgccctcgcgtccgcgcgcgcgcgctcgcgcatggccgaccgcccggtcgccgccgcgtcggccctgccgcgcctgcgccgcccggccccgctgccctgccgtgctgcaccacgcagccgcacggccccgcgcgcgtgcctgagccgctccacgcgcgtcctgccaaaacccggaggccgagctctccctctccctcctactcccttcccgaatcggcttggagcgagcctctctttttcccccttctttttccctttcctcgaccaccgccggcgtcatcacctgtcgccgccttggctgcacgcgtcgatgaccgccagctcgctctccttgaccgccaatgtcggttcttcctccctaaaccgacattgccatctattaaaccgagcctccctatcttcctctcgttcattccctcgccaccaccgtgcccttgccaccttgctaccgccatcctcgcctccctcctccatcgctcgtgctggtgaagccggcgtgcgcgcgagaagctgacgcgggactccaggcgccgtctccttccccttccccggcccgaggccgaagagctcgctcccccgtcgtcggccgctcgtcacagcgtccgtctcggctcggtagtgcatctcccgttctccctcctcgctccctctcctctccttagctctgggtagtagtgcgagtagccttccaatagcaagctggcaccgtcccgaccgccgccgctgctcgccgtaggctcgccgccatcgccgcccaaactcggtagtagccgctcgtcgccggccttcctcggtatagctccacccaatccgactctagaaatgaactcaggaggtcgcgtagatgctcaagtccctaggaatcgagctctcgtcgcatcgtcatcgtttccctcttttgccgccgccggcaagcgccgccgggattcgtcgtcgccggcctccctccggcgaatccgatccggtggctcactccctctcgtccgtcccattgttcagatgtactccctctctctcgaatcgtcgcgacgagctccggtgaactccgccgccatccgccgtccatcccgggcgcctcctcctccttccctttcgcccctgcccgcgtggccgaccacgtggcagcaacctcagccccgggcccgcttgatcgggtcaagcacctagtcagccgcccccaccgccctttcttctgtgcgcgcggtccacggagagcccttaggcttcgcatgggccctccacctcttggtccacccgcgtgccacgccgtgagccgcgaccgcaaaaccctagcaccccgcgccgcatgaacccttcccccgtgcgccgagtcgctgactcgtgggcccgtcccgggacccggcacgatggatccggtccacccggacccatccccctctctcctcccgcgcgcccacccgcttgggccgcgcgcccacccgcttgggccgcgccttgcccggccatgggccgcttcctcgcgcccgcgcccggcccattagctcggccgcgccgcgcttattccttgggccgtacccgagccgccaaaggaagtctaaatcccatccctccttccttttcttatccaaagggattaataaatccttttccctttttcataaatcaattccttattcccaaaattccataaatcatttccttggtcccgcacgtcagtgacggtcaataatattcttgagaatattatttctataaatttcataaatcaatttccccttttccacaaatatcttcctttgcccagaaattccaattaaacttccaaaattcatatctctcaatccgtagctcagattgactccgttcaacttccagtatttccataaaattgagatctatttaatggcagtactaattagtctaaataggatctttcttttggtcttttgtttaggtttttgattgtttgcgtatagttacggttaccagattttcgtcgatcgcgagttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgcgtgccaaaccgacggacctacccagtagtcgcactaattcctgtaggttgtactaccctgatttccttgtcgctccacctttgtggtacctcggtatccgtgctctctgagcgcatataccaaatatcccacatacaccgttgtttgtcgaaaacttgggaaatgggtttgagaagccttgaaaacccgacatgtggcgtcggtgtgttggaaaataaaatggattgtgaaaactcgcgatgcgggggttgtgcttgtgtggcactgtcccgtattcgcatataagtaccgattcctgtgggaaattcatccgagcatataacaagtgcgaccacacgggtgcaatgggacgcccctggctgagtaattagttaatcgggggagccatgatgccaagagacatgtggattcaacggggtggtgtcggggagaaccctcgggcttcctggcacagtatggtctgggacctaatctagtgttggtctgggacccctctcgttggcatatggtgaacctgtgtcggctttccaaatgccttgtcatgaaagccttaaggtctcccgacgtggctgatctcacgggctgggtgatccgggttagtaatgtcgtgtgggtaaagtgtaccccctctgcataggttaactaactgttcgaacagccgtgcccgcggtcatgggcggatgtgaggtgtttcctgtagcgtagatttgtttgcctatgctttgtgaaaagttgttgtggtgtgggaatcgttaccagaatcagcctatgtggcagatggacgacctgagtggtcaagaaacgaatctgtgtaattcgggatgtctatgggcatcatagattaggcttcccgagtggaagcggattgttgtgctactgggcagctggactctgggagtccgagaaaatgaaaaaggctctgggaaccgattaatcaagtggaatggctctgggagccgagaagtaatgatctgacccgggaggtcggtacattaccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaaattctcgtgacttgctgagtacgaaagtactcacccttgctctatataaatatatatatatatagttcctctgccttaaagagaagatgaagtgaagtgaagaatagggtttcgtcctggttcccagccgtcgcctgtggtgttgggtgttagttcgttggttccgctgctgctgctgttgttggtgttctcctcgtccgtgtcgtcggttgcattctcgggctgtctgagctgcaacctaagttaaggtaaagaagtcatctatttattttaaggattgcaatgattcatatttgtcaccgtggtaccagcgctatgtcctgggactggtactgtgatcgcggtttcgtaggaagcggtttgcgccgtttttcctacgacatgctcctatcaggtgccattatacggcggtgccagattggggtgtgacaactaatttcataactcgcatggaaaccacgagattaatttattaagcctaattaatccgtcattagcacatgtcggttactgtagcacttatggctaatcatagactaattaggctcaaaagattcgtctcgcaatttctatgcaagctgtgcaattagttttttattttatctatatttaatgctacatgcatgtgtctaaagattcgacgtgacgtttttggaaaaaaaaattatgaactaaacaaggccttaacctatcgaagtatctttagggtgtatttaattccacgctaaaattggaagttttattgaaattggaatgatgtgacggaaaagttataagtttgtgtgtgtagaaaagttagatgtgacgttttttggttcaaactttgcaactaattaaacacggccttacccaataaataatttgcacctcatgttcttacattgtccatatatatatctttttaaattaacagcacaaaatgcatccaataattaaactgatcatatataaattcaaactgagacaagaagtaatactcaaccggacaacctcgaggagctatgattttttcacaatctattacattcgtcgtaaaataaatatagccgtggatattcatattcaacgtttaaccgttcgtcttatttaaaaaaatttaaaaaagtgtacatgttttatcatctaataacaataaaaatactaatcataaaaaaatcaaataaaacgaaaaccaaatgttaaacattaacaatgtaaaactacaattagtattaaggaatgacaaaggatttttggaggaatgagattccaaagaattttttccttcaagcctctttgattcataggaaaggcaagtataaattccatatgattgcattcctatgagtggattccaaaggtaacttaaaaaaagaggtcagacctcttggaattcttctaggcgcagattcctttgttttccctatgcctctatcaaagggatcttcttacgtttttctctgttttctcttcctgaggatttcaaaatcctaccacttcaaatcttgtgttttttctaatcctgcgtttttcctatcctgcgaatcaaagggacccttatttgactatgaaggtagtcagagtatctcgtgttacaaaagttagtcaatatagtggaacgacgactaaccttcctgatcgcttttagtagtggcccctgtttactcaagaagttgctctccacaagtatacaatgtaatgtaatgcaggaactatcagaaatttttaagtgtagtagccagcttcataagctagtattgcattcagtactttaaatgaagtaaaagattcagtactcatcacgagttatgcttgtactgtttactgagatcagttacaggctgaaagagcagatttatctccgtaaacaaggccgaaacgaagttctgtaccattatttttaacatgggctgaaaaggatgagatggtcggcctggcccatccttttctgatagttctcctcgttacgccctggcccaagaagaatggcctgcacgccggcctaactactaggctgcacgaagatcggaattccatcccagcccaaaaagatgggctgcaagcctacaagtggaagggaatccattctggcccaacttgtatgagcaccacgtagataggagtcccgtttcggcccaataattataggccggacctacactaaactcccattctgacctaaaaataatacgccttctttggaagccaccgtttcaaaagaatttatgggtgtttgttggtaatataatacatataaacacgtaagacgatgtttatatatatataggaggtctattcactttgatgtcatttttaacattatcaaattttggtaaagttaccaaaaaaaatatctacatttagttttctgtcaaattttggtaattatcacaaaattttgacaataccaaaatttagtaaggttgaaagtggtatcaaagtgaataggcccataatgatacataagcagaattaccaaagggtttgttatttcacgactgatgtaaatgaaaaacactgcaaagcaaaatcaaactggtgtgtagatcaaaggacatgaaattccatcacctacaccgctatctctctcctccatatgctctgttcctttattaacagccacctccaccgccgccgccgcaaccaccgccaccgccaccgccacctccaccacctccacaggcggggccaccgcaagcactacctccacagacggcgccaacgccaacagtaccgcctcctggattggtgagccgcttccgtccaccggagctatccatgccatcggcgcagttaaacacgacgaacgccacgatcgctacggtcgccacgaagaccagcgcaatgccgacaacactcctgctcatgtcgggcacggagccgccgccgccgccgccggcgaagcctcggccaaggccggcgtccacggcgagcctaaccattgtgatatatcgatcgatcgagctgccgcttgttggctgtgatatatcgatcgagctgccggccgcttgttggcgagatcgttcgggtggtaattatagggttggagagagctagctagctggctatactagcttatcttcactgacacggaacagcggaactggccggttgaaatgtcttccatcgagtggtgcgaactactccctccgtctcaaaatataacaactatatacataatataacaactatatactagatgtgatacattctaccctgtccagattcgttgtactaagatgtgtcacatctagtacattgctatctatattttaggacgcagagagtattaatttctactctctccgtttcacaatgtaagtcattctaacatttcccac

SEQ ID NO: 65008 - DNA, 8639 bp, Oryza sativa
atcgatcgagctgccgcgtgttgcctgtaatatatcgatcgagtccccgcctgcttgtagacgagatcgttagggtggtaattatagggatggagagagtgagatacctggctacacgagcttattttctgtgacacgatgcatcgcatctggccggttgcaatgtattccatagagtggtgagagcaactccctccgtctctccgtttcccaatatatgtattatataccttttatacactagatgtgatgcatttgaccctgtccagatttgttgtcataagctgcgacacgtataggacagaatgacttacattgtgaaacggagagagtacgaaatcgctgtgttgcacctgtagcatgtaggtgcgccgcaggcagggttaaacctttcggtttagccgatttgatcggactcaccggaatgccaaaattttagaaatttccaaaattttgaataaaatttagttgaacttgaataaatatcaccaaaattcacggaaaaaattaaaaaaaaataaaaatttcaaccaaaataatatagtatcggaggggtctgaaatgaccgcggaaatttcgttccggaatttccaaccctatgtgctctctctctctctccataaaaaaccaaattctattaatgtatctagataatgtgtctagatttatctttaggatttagtttttttatggttcagaatggatacactacgttatcttcttcttcttctttttcgacaacaatatatgcgttacgtgtattagagataggttgatcgatcggttttcatatatatctaaaccaatcgaaggatgactgattcgatcgttgtccatgtagaattaactaaggcaattgttcccacggcggctagttttatatcagcttaaatgcttaatcatgtgtagtgcgcgtccttgactgtacgccaagtcgccaacgtcatgaccactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccgcatccatccacttttagttctcgtgcgctacccccttttattattgccgaaatcatgtttcgacagttggcgcgccaggtaggggttgcgtcgagtttcttatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgattggtgcctccgcctacacggccggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacaactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggctgcctttgggccgattcctagcacccgggggctcgttggatggaccgagtaacgcaaggtgctaagtattattcggaataaatcaaaagcatagagataagataaattcattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttacctcttacgctccaggaatggatcagtcagaacatcaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgcctacgtcttcaccgaccggcttgccttcgtcgccgccgaccgatgtcctcgcctgcacggctggcctttatgccgccgttgttggacgtctacgtcttcaccgaccggcttgccttcgtcgccgccgaccgatgtcctcgcctgcacggctggcctttatgccgccgttgttgggcgtctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcatctcgtctgctgctgactagtgccctcgcctctacatctggtttatacagctaccactactgatggacatcatcgtcttccgccgccgactcgtgttatgccgccgccgaccggtgcttttatcttcacaactgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctctgctgttgctaatggatgattatgttttcgctgacttattatttcaccttcacggttgacctactatgcaaatgctgatgagcgtctttgtcattatcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatgttctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggactaaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacgaagatgattgaagcactcggccttggagtaatctagttcgagagaaggttatctttccgactgtgaaggtctcaggggctactgtggagattatgggtaccccatacccacacggcatggttatccgactagttataggggataacttatatctatgtaatatgtaacagatcatggcttgggtgttacgtttccttgtatattacggaacagcctaaagtccagatttaggaaaccgataccgtattggttaaggtttctatcttgtaatcctgccccccatcctatataaggtgggcaggaggccctctagggggcagatgagacaacctgatcgtcagatcaatacacacacggcggattcaaatccccaaacaggagtagggtattacctctcattgagagggcctccctagtattttaatatatgacgccgttgactttttgataaacgtttgactttccgtcttatttaaaaaaattatgtaattataatttattttattgtgatttgatttatcatcaaatgttctttaagcatgacataagtatttttatatttgcataaaaattttgaataagacgcgttatcaaacgttgattaaaaagtcaacggcgtcatacattaaaatacggagggaatacttcctccatttcacagtgtaacttattatagtatttctcatatttatattaatattaatgaaattagatatatattgtgaaacgggggagtagctcgatatctagtgaaattatgcttcgttggccgatcgggacaaagtacatccaaaacatgatatgcacttaatttgttaaatatatactattaattatacactgtgttcatagaaattggcttgaccacagtgttaattaaccggccatcgccggcggcgagacgtctggatcattacggccaaaagcacggagccacgcacacccatccgctgatgattcgccaggacggagtcgttaggcggttaggcccagccgcccagccggctgtgtttaggccatgtttagttccacccaaaatcctaaccttctgttacgtcacatcacatcgaaaactttcctacacatataaactatcaactttttctctaaactactaactttctcacagcttcataacttctccaccatctaaacacacccttaattagttcacataaaaaattgaaagtttggttgaaattgaaatgatgtgatggaaaagttggtagtttagaaaaaaactttgaagtaaacacggtgcaaattaaaatgctcgatcatatcgccgcttgattctcaccacttgcttgtacgccaatccatgattgacaacgttgctgtttaacattgaccttgtctcggtcacttttgaaaattaacctgacaaagtacctttacccaataaataatttgcaactctgttcttacattgtccacgtactccctccgtcccataagggattttgtagcgcccgttccgtcgtggcgcctagcggaaaaattatctcctaaaaatcctaattgcgaaatttgtttcttcgcttgtcgtctagtgtccgtgccgtctcaagatctcaaatccccgatctatcgtcgagttcaattccgaatccaaatccttccaaatcaaattcctccgcaaaagtctagtttgcctcccccagggtcgatgggccgaatctcgctcggcccatctctccctccctccccggctctctctctctctctctctctctcgctccccctccgctccgcgccgcccgcgcgccgcgcgcgtgcgcgtgagccgctcgcgccgagcgccccctttcccctcgctctccttctccccatccctggcaagctccccgcccgcgaagccggctcccgcgcgccgttgttcgcgcgcgcgcccacgtggttccccgcccgcgccgagtcgagccctcgctgctgctccccgcgcgtcgttcgcgcgcgcgcccgcgtggtcctcacccgcgtcgcgtc

SEQ ID NO: 65009 - DNA, 10453 bp, Oryza sativa
  unsure (1)..(10453): unsure at all n locations
cctcccgccggcgtcatcctccctccctcctgtcgccgttttggccgctagccggagcgccagctcgcgccttgaccgccaaagtcggtttccaaaccgacattgccgccccctataaacccgagctccctccctttttcctttcctctcccattcgcctccgcgccattgccgccgcctcccgtgctctgttcgccgtcgccgttcgtcgttgcgcgtgtcggaagagccggcacgagcaaggacgcggaaggggactctgggcgcaccctcttcttcctcttcctcggcccgaggccggagagatcactcccgcgccgtcggcctctcgtcactgcgcccctcctcatctcggtagtgcctctctccgttctccctcctcgctccatcttccccccttagttttcggtggtagcatgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctagcatcggattcccatggccgcgtggatgctctcaccgccgggaatcgacccctcgtgacctcgtcgccgtttccctcttccctccccgccagttgccgccgccgcgattcgccgccgtcaagctccctccggcgaatccgagccgttggctcgtctcccctcgtcacgtgcaaccacccggtgtgctcgcttttgcctgtatcgccgtgggttgctccgtcgctcgccgctgtcgaccgccgtccgttccggccggcgtcgtcgtctacctcccgccggcccgcgtggcagccacgtaggcgccacgtcggcgccagcacagccaaggccgggtcgagtcgaccccggtcagtcccttcccgtgcgcgcgttccaccgcgagccgtgaggctgcgcgtgggcccgccgcatccgcgtccaccgcgaaccgcgcgcgtgcaccgcgtccctcccccaccctagcgccgcgccgcgtgctccctccgcacggtgagccgagccgctgacaagcgggtcccacccgggactgcgcgtggtgagcccggtccaccggccctctctctcctcccctcccgcgcgcgcgcttgggccatcttgggccggccggcccatttagctcggccggaccgccccatctctctcgggccgcgccctagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgttcgactccgttcaacttccaaaattcctcaaatctcgagatctatctaatggcacgcttagaggtcattaatagggctttattttcgccgtttgttgagttgtcccgtttcgcgtgtagtctcggagcccgaagacccgcagtgcgaggattgcgaggatcaagctccagatctcgagcaaggcaagccacctttgaacatcttgagcctatatttgaaatttaattatgttgcttgaaaaatattatgcattgataggatcgcactttttctgtcgtcccgtctgcaaggcagattggcggacccacctagtttgttgcatttgatccttcctttgttaattgttataccttgtccccttgtaaccatctagttgcgtctcgatattcgtgcaccctgtgcgagtatcgacggacgccttcaaacttaaaaatctgaataacaacttgggtaaaacttgggttttacaaaagatttggaaaacccgacacctgggtcggtgcttgcgaactaaatgaatttccaaaaccgcgggccggggaacgtaccgggtgtacggtttcccgctctcgcacttaaggaccgatttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggataggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgtcgtttgagaagcactcacctagttgtttttagaaaagagttcaaataaaatcaattgcaaaaacaacagcctttcttcgaagcctgcattaaacacttatttcccatggcttgctgagtactcccgtactcacccttgctctatataaatatccccccctcagttgctgaagaagatgaagcggattctgttgatgaggagttcttccaggagcaagccggctacgatgagttttagggtttcggcctagttcctaagtcacgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttagagcgtcacgggctagttccggtcggtactagttcggggcgtgacagattttaagtttttgattgcaaaatttgaccactcgtcttattcaaattttttttacaaatataaaagacgaaaagttgtgtttaaagtattatagataataaagtaagtcacaaaaaaataaataataattttaaaaatttttgaataaaatgagtagtcaaacgttgcagacaaaaatatcttttttaattaaggctgtgtttagttcatgaaaaaaaattaaaagtttggagaaaaagttaaaagtttatgtgtgtaggaaaattttggatgtgatatgatggaaagttgaaaattgagggtaaactaaacacggcctaacagtaaaaaatgcatccaataattaaactgatcatatatacataaatacaactgagacaagaagtaatactcaactggacaacctcaaggagctctgattttttcacaatctatctcatattataatgtacataatggcaacatattagtagcaagcaacacgtacagtggccgagttaactcccgtgacgtcagaacccaccaccaccacccccgccgccgccgccgccgccgcagccgccaccgctgaatccgctgcttgccccatggtcaccggagtagtggtgcccgccgccgccgccatggtctccgccatggtggtgccagcctcctccaccatggtctccgccatgcccgtggtgatggtggtgcccgccgccgccgtggtccccgccatgcccgtggccatggtggtggtgtccgccgccattgtctccgccatgtccgtggccatggtggtgatgcccgccgtgagcatccgagctagcagcgaaaatgcacaaatcacaacaagagagatggaattaagcactgatagcacacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtgccccagaggatatcgtcaaaaaagtgtgaaatgagctaaggtcaagccttcaatgttgacgaagagtttgcgatgataaaaacggaaagtccgcagctagacgacttctaattcagagtgtgtttagttcacattaaaattgaaagtttggttgaaattggaacgatgtgatgaaaaaattgaaaatttgtgtatgtaagaaagtttcgatgtgatggaaaagttggaagtttgttaaaaaaaattggatcggtctgaggctgcatacgcgttcagaagttgcacagaaactggctcatcttgacccatgggcacagttatcgccgccggcggcgagctatccgtgtgattacgccgaaactcacccgccaccgaccacgcccacagatgataattcaccgaggagattggacggtgagtcatcgcgatgaggcccaggccaaatgacccagggggatccacggcctggcaagtttttcctcgatatatgggccgaaataggcccactctatcggcctactccatcacataaagcccaccaaatgagacggcgatatgtttgaaaaaaattgcaccgaatgtctctcaacttgtcatcgagttaaaaaatcgttccccaaccgcaaagccagatatatgatatccttcaactttcaaaaccatttactttagatccttaggtggttttgaccccggtttgtccgacgtggcggctgagttagcgtaaggatccacgtgggtcccacatattagggtgaccacgtcaccacccaatctttttttcccctcttctctcctatcctcctctctctctctctctctccgacctctctgcgtaggttggccgtcgggtggggaggaggttggcggggctaggcgggagaggagggcgtcgacgacagtggtgacagcgacgatgctggagaagagaggaggccggcggggtgaggagggagagaaggtccggcggcggtggcaacgatgcaggagcaggccattgcgccgggtggggaaccggctggccgatctcctctccgtcgcccttccccgcgcgcatcggtgacttcgctaccgccaccgtatcatccctcggccctcctctccaccgcgctcctcccttgccagctgccgaccgcggtgggtagggagccggccagtcgatctcctctccgctgctcctttcccgttggccgtgccgaccctcttccccgtcgccggccctccaatccgccgctccgcctgtgccaccgtgcatcaccgcctcaccccgacgacgacgtgtgaccacagcaatggcgccgcacggcacgtagagggggaggaggagggcaggcagacgaccgccgcataataaagaaaaagaatgaaatgaatatcaggccagtccaacaatatttttataatgagtgtctaggttgattatttttctatattatggtatttataagggtagaatggtcatttgattattgttcttgcatgtgaggatgaaatggcatacccacgtgacgttttttttttgtttaaaggactaatgttatgctagatgataaattttaaacatttgtttgtgtgtttcttatcttggtcttatcacttttataatgtttgggtgtgtttaattctatttgaactacactttttgttcgagtgttagattgtaataattggttgtaactctgttgagtaaagaccgggatgttaactattctattattaaaaaaaattattgaaacgtcaagcactaaactaatcctgaaacttcatggattggctattcaccctaacaaaaataaatgagctgccgcacacaaagtacagactaatggtcatgtcgtgatgtatgccacctatatatcccaagttttaagtgagcgtgcaggtcagaagaaaatattagatatgggagaaaccctaaataatctaatgtattatgttgtattgacactgtaatgataggtatatatagagagagtacatatgaggtagatacaagttagaatatacttatctttaggactcccttttatcagtacaattcgtatttaaactctttatctccacctgtacacaactatagctactacggccacggcaatggcgccgcacggcacgcagagaaggagaaggagggtaggcagacaaccgatccgtgcaacggtagccatcggcggcgccacccgtcgcatcggctatcctgtccactgcgctcctcccctgccagccgccaaccacgctggccctcctccctgccgcgtcgaggacgccgccgccatcaacgcctagggggaaaatgagagaggaagggagagaagagggaaaaaagagagagggtggtgatgtggtcaccctgacatgtagagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaatatacttatctttaggactcccttttatcagtacaattcgtatttaaactctttatctccacctgtacacaactatagctactaacacccacctccgccgccgcagccaccgccgccgccacaaccgccaccgcccccatggtcaccggagaagtggtgcccaccgccgccatggtctccaccatggtggtgccagcctccaccatgatctccgccgtgctcgtggtgcccgccgccgtcaccaccaccatcgccccgtctggaccgtcgtcaccgccgccgtcatcgtcccggcggcggcggcgcttgtccttcttcctttttggtttctgtttaggtcgatcggcacagccgaacacggcgatcgccacgacggctacggccgcggcgaagccgaaggcgacgaggacccagccggcggctggagcagtagtaggcacggcggcgaagccattgcccgcagtaacagctaacgctctcaccattgctacgtgagcaggaataatcggctaataaccttttcttcttgcagctgcagataattaacgtactctcaccattgttaagtacagcacaagctcttgtgttacgtgcagaattggagagagagagacattgtaagattcaacgcggttttctgagtcgtagagaggaattggaggagttgtacagactcttccttgaggaaatgtcgtaagcgtgtgaaatgagatcatatcagcctgaattgctgacgagtttgctactatatataaacagtggaatagtcaataagtacatctggcagctatacgacttttcattcaaccccccagatcagatcatcaaatgtctgttcacagaagttgcacagaaactgggtcgagctcatcttgaccggcggcgagctttctgtgccattacggcgaaacgcaccggcgccaccgaccacgccaacagatgattcaccgaggaggctagtcccagaacggcgaggccgtgccatgcggcccagcccaaataacccatggcaatcacgtccgcaactgaaggaatctgtaatagcaggtgatccattaaatctgagccacacagcctgatcgaacggctgatagagatcctgggggttgggagttttagactccgaccccctcgaacacccaaaatcaccgctctgtccaatttaccagccgctgacagttcgcgaggagcagctgatcaattaatctgagccgtacagttcgatcgagcggctggtagagacccatgggggttcggagttttgaaccccgcgcgacccccattcgcagccggaaatccaccactgcgcgtctgcgcctcatcgtagctctgccgagatcttggctgcgtcttctcccttctcctgcctcatcgagctccatatggccgcactccatccgtccagcgcctgcaattctgaatttcagatttagaaaccgtgcttcacatcgctctgcaaaggagacttaattcctgaagccgattaagaaaccgatgattcagaaagagaagaagacacagcaatgcttgggagtttcaccattgtttttcagacgaaccgaacgagatgaaaatgaagtatcatcttgttgcttgctgatctttttacagcgagatgatacgtggagtttcagtaaaatattcctggtctgtccctgatagtcagataagagcttaacaaccaaatctttaatatgaagatgctccttgggtatttgcatgctagctgtttgcagcacgcaggagaggaggaccagcgtagcaagactatgcgctattgcatccatcgtctacggcataacaattgtctggacattgctgctggatacctctttgtacctcttaaactgtaaaatttctttggaagacttagcgcgaaagtctattctgatcactagatacaaacaaattaacttgaaaaaaaaatatgttggcgtacaacaattgcatgctcgtaggagcttagcgccgtaaataatcattgtttttcaactagaaattacgtaaaagagatactgtaagctgcttaagccaagatgaaaatggaagaggcgaatttgatcgtgagtcaattaaactgtactgttattactcactatcactgccatagtagtgccatgcataatgaataatccataccacgaatcttgtcttgatcaactggatccgtcaattaacctccgtctactctccacctcctcctccgtctgcgcctccaccgccgtctgcgccgcccccgcaaccgtctgcgccgccaccatcgccaccgtcatcgccgccgccgccgccaccgccgccatcaccacctccatccccgccggcgccccagcaacaacaacaggtggacctccgggatctgttcttgcggtcggcgtatccacaaaggagaatgaccacaatcgctagcacgaacacgacaatgcctgcagccgaagcagcagcagcattggacgtcgcgttgggcacgagaagatgttgctcgctagccatttgtatgatctcttcgatcttcttcgtctaattggttgatgattagggataaaattaaattaagctgcaagctagctcgatcgagtggtaattatatagagaggccttccggcgcattaattatgttttctccgactttgcactctagactggtgctagcgtgtagcgccttgcagatgtgtgctggatcgatcgatcactggagacgacgtctacgactttgccaatcgatcccaatggaaaattggaatgcattggtaggatagaacatgggccagtgtggatgctgctgaccttgacttaatttaatcaagctcagcctgtatttgtatactgtctacgttgaccatgagaggggcagagatcagcttcacatgtatacgcccgacggcctgacattgtttcagcccaactttaacgggccggacgttccttgccttttcagcccaactatacgggccgcatggcccatatgagaatatactggactattatgcgtacgtcgccttcctgcggcccagttttagtggtttgatgattaagatccggaataagttcactttgtaaccctgaaaaagtaatcgaaatctaatccgtgaccctaaaccacaaaaccggatatctagacccccaactcttaaaatcggtgcaatttgactccctcaacagttttgaagggtggttttgctaacgtgacgcctacgtgacaatattgactcggtcttctttgcacatggcattgacgtggcacttaggtggcattagaaataaaaaaatatgtgtgggacccatttatcattcaccaaaaatatgggtgggacccactgacatgtgggcccacataaatcatcctctcttcatcctccccccccccccnaaaaaaaaa

SEQ ID NO: 65010 - DNA, 12757 bp, Oryza sativa
  unsure (1)..(12757): unsure at all n locations
catcgcttaatttagctgtagctccgcttgttgatccgtagctggcggatctgcttcctctatcctccccatcggaattgttcgtaccgtcgcggaggcgctgttgcattctactgataccaagattacaactacagcaagatcggatgagagagctagctgctgcctaattagtttcgagatcaatgagagttgctagctggacagggtggttacgtacgtaattatatatagggttagatcgtacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaaatcagtgtattgaaagcagttttggcttacgtggtactaaagttttcatctaaaaatgttcagattggagaccacatagccttgcaaaaacattataaagcaagaaattgtgtactacttctacttgattaggacttttgcctctactgaccaaggtttttgtttcttcgcgaggaggcgcagtagaataactggagaagcatcacaaatctgtatatacagcttgctcttttttgttcttttgcaaaatcttgatttacattatctacacttagatcatggttaaagctggactactggagttgagaacaaaggtaatcttgtcatggatatttatattttgcattagaacagaggcaatcttaccatttgggtgaaaaaaaagtgaatatacattttctaaatttatatttatatacatgtttgtggggggaattatgaaaatatacatgtttataaatgcagacgtgaaaatattacgcggcataatattgaacagattgaatccggttttaacaattgaggaattctctatatttgattttgcggttgaagaatacgaattaaaatgtgtctatatatgaggcatgtaaaatgaactttttttctggaaacaaatactgtcgttggacaaaacaaaggttgccgcacgtggatggcaatcacgtccacaccgcaagagccgtgggaaatcgtttcaaatgaagagctgtcatagatagacaatcatctgtgagactgtgatggctcttgatcctaatatatctcttacggtagatttaagcacccgtcacagatataattatttgtaacaactctctaagagagccatcattgataactctttttttttcatttttgttacatcaaataagttgatcatgcataatatccaaagacaaacccgttatgaaatgatcttacctcatcattttttatgcagtttgcaggcataaatggcatcctctactatactcctgaaatacttgagcaagttggtgttggaggttttttctcgaagtttgatcttaattagttcttctacatctatacttttaagtgccatcgcaaccttagtgatgattccttgtattggtgttgctgtgccgttcgtagatacgaaaggaagaaatttagtattctaatatttataattactttctccgtttcacaatgtaagttattctagcatttcccatctagacattcattaacatcaatatgaatgtgggaaatgctaaaatgacttacattgtgaaacggagagagtactacttattgtcattatttaattaaaaaggtaaaagaaagtacanaatggtaatttttctccctcgcttcatgcatgcaggcatattctccttggcacgatacccattctgctattatccctagctattatgcttgttgctaatattatgaatatgagcactgatttacatgctatcacctcagcattatgcgtaatcgtttatcaatgtgtttttgttatgggatttggccctattccaaatattttgtgtgctgaaattttccgtatagtccctcctcattcacaagatccatggatacccccggagcaccctcttcaatttttttccccatgaatgataaactaaaggtccctaaatagttggaggttgaagaaactgtataattgagcccccccccccccccaaaaaaaaaaattctgttcatggatccgaccatgatgcttggtaatatgtagcctagcattttggatttgtgataccatcgtcacatacacttttcctgtgttgatgaatgcgattggtcttgcgggtgtttttgggatctttgctactgtttgtgcactagctaactatttgtatatttcaaggtgccagaaactaaaggtatatacctcttgaggttctgtcggagtgttttgcttctaccaacatctcatccaaagatgattcgaaagaagataagtaatactccctccgtatttaatgtatgacgccgttgacttttcgaccaacgtttaaccattcgttttattcaaaatttgtgtgcaaatatgaaaatatttatgtcatgcttaaagaatatttggtgacgaatcaagtcataataaaataatgataattagataaattttttaaataagacgaatggtcaaacgttggacaaaaagtcaacggcgtcatacattaaaatatgaaggtaataatgaattggttggctccatgtaggacggattttattgcaatgccatatattgatgtattttttgctatattattatgtattaaatttgtgaaactgtcatatgttttgtgtggtggcatctgtacatgtatctgtacttgcctgtacatatatgtacctgtgttgtctactatgttctaatctactttacatacaaccctttgcatgctgtccaaattattggtatacatctgaattacattatttatacccagttagtacagttttttttcctgttttgccatgtgttaactaattcaatcatatggtaacctttcgtatcgtgcattagaaactactccatccgtttaaaaaaacgaatctaggattgaattattttactacaacgaatctggacatatatttgtctagattcatattattaggatatgtcaaatccaattctagattcgttttttatgggacgacaagaataattaactatttgtcactcttacgagtggtgctaaattatttgccactggacccacatatcatagacacatgagggtccacatgttatatacagcgagtggtaaatagttaaatgtcccagactctactactaattagcatgcatctagagagcattggcagcctgagtcgagcagctcactgactttgcttccaccatgtaccgagagctgaacacgcaaaatcacataaaccacatacaggcatggtttagtttccaactttttcttcaaacttttaactttttcattatatcaaaactttctacacacacaaacttctaactttttcgtcacatcgttccaattttaacgtgaactagacacagccataatcagggtgcaattgataatgcttatgttagctgtgaacactttttttttaacgcaaactggtctcaaagctatttttagataatggaataaatatcccggcctttactcattaaagctatagctaattattacaaggaatcgcataaacaacgagtgaagttcaaataaaattaaatacacccaacgataaaaaaacaaaaccaagaaaaggagcacacatttattcaagtctatttttgaatttccatccatggttcgcaaatatttacataaccgtcgtctccaaattacggcatgcaacctttataaactctccatcatcttcacacttttgcaactttgcccaaaaccggagccaatatgttgccttgaatattacctgcatatatgagatagatggtgatttgtcagaaactatatcattcctactcaaccacagagcctaacaaatggcagatgctccaacaagtatgagtttactcatcttcttgtgaacccctaaaagccaaccatcaaacatattagatatggaactagagaggtttaaaccaataaaaaactgtactactctccaaacaaattttgcaaaatgacagtcaagaaaagatgttatacggtttgcaatttgccatggcttggagccttggagctgactgacgaacggttgacatgtcacgctcaaagcctctccccccataattgtcccatccgatgcgaacacactcacacaaacagggagagccgcttgctgcattcattggcgtgcggacagatcgccgcccagcaatcagcggcaggccaccaaatagacagccacaacacctatcaacttatgggagaattcagccgtggaagaagccggcagcagcagcagtagtagtaggtcgatttggtttgaagagccaaacaatgcccacgagatatggctatgctgatgagctgctgaggcagtgatgtgtagactgtagatcctatttaatatagtttaagattgtaaaaacagttggttagtagtcattttctgaaaaatctgatttctattttttttccattttgtaactatagctattaaaatccaaaaaaaaactagactaatttaaaagaatttttaattttgatagaagttgtagaagctcccaaacagtcgaagtagctatggtgataatactctcttctcccattttaagtggtagttgtaaatttctgtgtttaactttaatcggctatcttatttaatttttttttatgattagtatttttgttgttgctagataataaaacatagtagtactttatatataacttatttcttaattttttttataaaatttttaaataaaataaatgatcaaatgaattatgaaaactcgtgactgcatttaaattaggacgcgcgaacaaagcattggcgtttgcttccgttggcggctgggacccaactgtcccgcgccgggagcacacgcgtataaaggacggtaggagtggaggcctcgccgggctcgcagttcgcatcgcgctgttccctcctcggctcctcgcgcaggagcactggcacggacagtgacatcgtcttcccttcacctcctcgtccttccctctcgtggcatcgcatcgcatcgtgtcctctgcgactgcgagagtgcgtgtgtgcagcgcgcgctcgtcgagacagacagcagcagcagttgctctttaatgccggtgccttgctgaacagagcaaggtctctccaatggccttgaggcattcaatgcgcccgtaatccatctcttgaacggccgtgtgtgtgttcttggcgtgttggtgtgcgtggattgggtgggtgaggaggatgaactatctcaggagccggagcctcaagcggctcctgtctctcggtcgccggagcaacaattccgatgagtccaatgacgagtgcgtcttcgtcgtcgaccagccgccgccgtcgaacaagcctacttggaggtgcttctcgtatgaggaggtcaacaaggccaccaatggcttccaccgaggtacagtagatatatattcttgttggtttctttggggatttggcattgagaacatggcgccatgacagacaatatggtggggagaggcgggtacggcgaggtgtaccgcggcgtgctggaggacgggagcgccgtcgcggtgaagcggctgtcgccggcggcggcggcggacgagaagaaggagaaggacttcttgacggagctcggcacggtggggcatgtccggcaccccaacgtcacggcgctgctcggctgctgcgtcgaccggggactccacctcatcttcgagttctccgcccgcggctccgtctccgccaacctccacgacgagaggctgccggtgatgccgtggcggcggcgccacgggatcgccgtcggcaccgcgagggggctccggtacctccacaagggttgcgcgcgccggatcatacaccgcgacatcaaggcgtccaacgtcctcctcaccgccgactacgagccccaggttcttcctcctcctctacctctcctctgctcgctatctgttcgtccggttgctcaccgagaaagaattgaattcgcctcagatttcggacttcggcctcgcccggtggctgccgtcggagtggacgcaccacgccatcgcgcccatcgagggcaccttcgggtgagcacacatacgttctccatggaccatggccatggcagtaaaaacagggagacgagacgacgctgagccgacgacattgatgtgcaggtgcttggcgccggagtacttcacgcacggcatcgtggacgagaagacggacgtgttcgccttcggcgtcttcctcctcgagctcatctccgggaggaagccggtggacggctcccacaagagcctcctcgcctgggtacgtacgtagcacattcatacgccatcgccgccgtcgcgtcgcgcatcgcacaacacgcgcacggcggcgcgcttgtggcggccaggtgttcggccagggacattgacattggtgccgtggcgcgtgcatatgcaggcgaagccgtacctgaacgactgcgtggcgcaggggctcgtggacccgcgcctcggcgacggcggctacgacggcgcgcagctcaggcggctcatgttcgtcgcgtcgctctgcgtccggcccgccgcggcgtggcggcctaccatgacacaggtaagaagaaaaggaaaaagaaagcaaacatttttttttctgcaactgcacttgctgttccatctaggagtagactaaattgacaacaatttagaatccataaataaatgtgagagaaaaagcatccggattgaactgtccatgttaacaagtacagtaaaattgacactgaacaataattgaatttcattattttcctaccaaggtactccactctagtactagtactacaagaaatggaccattcatcattgtgaagggtttctttgctgacatcagctccgaaatggcatggtagcttgggattagttggcgacctaatcgttctagagtgtgcaaaacacttagcttaggaatgttagagtaggtctgactctgatctgacagtctgtgtagcattgcaatgcatgggccaccaaacaaaatctctcaacatcacccaaagaggacaagagctaggaaagctttaattcctttgtggtgtggtgtgctaattgggttgctgcttgacccagcaactcaaataaatatggcattgcaatttgcaaccactgcaatcttcttcagtagattgttaattacataggggaaacttgatggtttcttatggtggcagagtctagttgattttcgttggagtttgcgtatccacatacacattggttgtcaatcttgttcaggtaggttgttaattatatagaggaaacttgataatttcttttggagcatagtctggttgattttcgttggagtttgcatatccacatacacattcgctataaacggtttgtatatggcattatggtaggttcaacagctctatcaaaccatacaacgacatgaaaaatctcaacagaaatcaggagaaccggtatacaggaataattgttaacggctggtggataaattgatgaggggatctagtctaagggacatcattgtattatatggattatcaagcaagttctctaataacactggtctaaaagaagttcactaatagtactcaagtcatactctgtagatgacctcattacttttttcatggctggtgctaggtagctatctcactcaagtataattctcctatctgaagttatattttatacagcataatctgtatatgcttggtctaatcagacatccgggtgccctaatgcaatggcaatgtatgatgctaatgtgattgtcctactgctactagtctaatccatatcatccacttgcctcctatggttgttaaatactgccacattgtgttgtgtcagttgtgacagccactcctttggtttttattttatcttgctagcatctagcaagccagttggcgagtaacattgcaccaaacttgattgcgtataccttgtcttggtctgtcatagtgtggtgagatcccatttttaatgtgaaactaattgaatctctttcagtaggattccacagtgtgtgggatgataatgtttgtttatgtactacaatacagaaacagaggtatcagttatgtatgaggatatcatacatgaaagaataagttgaacctaaggaaggtagcttgaacacatcaatgcatatcatcaatattgacttctttgttttttccccccaaacagaccctaaagcttgatttactcttcaccttttcgtttcgtttttactacgtaaggcccacatattgttgtgttccaatacttgaaagtttcaataattcttgggtattttccaaaaggtacacactataaaataatttcaaaaactcaagcaacaaaaccgaatttttagacagtaaataaaagatggtaagtatcttgtagttctcaagttcttagtattcaaagtgcaattttactttttccagaccaaaggatagtctgatgaagcaaggggaaaaagaactctaaatattgttttttagatggaaaatataacagcattatcatttcaaagaatgtataacttcttttatggacatattgtattcgcaatctttcgtaatagatggtatttacaagtcaccaacagttgcaaccagaattactcttttagtttagaccttcaagacttaaagcaaacaaggggaaagcttacccattcttactagaccaagtagttgcacaaagccacagagtaatcttacaattttacttgacttgagaagaagacaagagtttggcctcatctaaaatgtggccggtttcttgattttagaagggacattggatgctctgtagcctcctaccttctccattatccttttcttccccccattgattcacgagaagcccagagccaggtgaagtgggggacacaggacagctcaagaacataaatcttgggacaaacgtacaaaacatgccaccccaatgtgcacatagaaaacttggtcacctctaatcaagatttaatcatgcactactttattagtattgcattgcaccatactaccattggcacacaagctacctactgtgaacagttactttggttttaacttccaaatgccttggaaggtggacatatacatacattcagacattcannnnnnnnnnnnnnnnnnnnnnaatcacaactaaatttagcactttcagcaaataggttagcaagcagggttatgcagtttgttaacaagctattgcttacaactgaccgacgatatctagttgaatttgttatgagaacaatcttgattttctgagcaacaaacttgatttttcaatgcattgcgtttggctttcttgtttctctaattgcaaaattcagtgcattttgtcatcgtgtatctggtatcttgtcaaaaaaaaaaatccaactactgggaacatccctggaaagtttagaatcatttatccagtagttactagtaccaacaaccggtcaattgtagagcgtactgcagctcaactgtgtttcgtactgccacttaataaatttgcaactgtgttgtacttaactgactcggttcacatggggaaatggcaggtcctggagttattggagtccggcgagatatctcaagatcaatggctgatgcccgaggaggaggaggaagacgagttttgggatttcgacgatctcgacgacttcgaggacgacgacgacgacgatgatgacaactatgataacgacgatgaatcggattctccctcgatatcgtcgtcagcgtgcagcatccacgccaatgattagccccaaaatatttgagtctgtcagtcttgacagagtgccccaattggttttggtttttaggggatactatgatcgatgggattatattagtgtacataaaccacctagacaatagtaaattcagaaaagaaaaaaaaactgttcaggcccatggttttgatcatcatttcatgtctccattagcaagaatctccttgttaaaacccatactactaactccatcagctgatctgttcatctgacagtgatggttcagacggtttctgtcaaaccgtgctagatgaacagactgacacaagtttgtcatgatgccatgcccttggcttagctttctcccaaccaactggaactgttgttggtttacagtttcctgtggatggattggattggattggagacgagctgattagggacatgatagtcctttcagttaattgtttagctagcaaccagcacatgccaggcaccggcaggtgggcttcggtttggaatccgttggttagctcgatcaggtctcaagtgcagttgggcgaccctgcttagctgctgctgctttatttgttcgtccttcctgttcagctagatgtcgatcgatcaatgaagtaaccaagaagtcattgagcaaagttcagattggatcatgcagttctgtcaacgcaagaagtcagtcacgtttcattggactcactaaaaatggctaaaaatcaaaataaaaatatggaatgttagtctgaatgtctggagctcaaattggaaaaggagttgaagaattgaactgtatcatctactgccgattaagctgaatcactgtgcttggcagagatcaacagtatacgcattgacattcatggacctgaagaaatgtcgccgatccatcgatcgatcgatctaccagtggccgtatttgtacgtgaccaccaccggtccatgcaagatgcaccacaatgatagatgcaaacctctgaccaccactcatcgacatatggttggttcgttgtcatctcctgcttgccagatctacaaattgctgctacaactcgtcctagtttggaactgtagctacgagcctacgaggatggacgagatgcttggtgcccattggctcactcactcacacaggtccaagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatgctagtttgtagtaggggtttgagaaatgatttgtcaattgcaatttggtaggggacaggtgccagatcagtgatggttgttgatcagtagtgtccgtcagaaaagatatgtgggtttcgatcttcagtttttttaatgaattaacgactaatagaacttttctacgagactacaaattaaatatgttcttatagttcttctggataccaaagcaaacaatattatcagggatagggaagaaattagcacgttctgttcgtttttttatctgaacctgaatgcatggcgacgaactgaacaattaagctcaaagtgaccgaccgatcatgttaactgttaagcagtcaaggtccagtgctgataaaccacatgagagagagagattctcagatcccatgtcaacacatccattcacagcagatcgaagctagattctttgcaagcgtgctgctcgtcaagcatgcagcgaatcaggggagagattaaacaagttgggtgcagataaccttcactgcagaacgacaaaaaggcccggattgaccatacaatgtaccatatcaagttatgcgattctgtcggtaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcagg

SEQ ID NO: 65011 - DNA, 806 bp, Oryza sativa
tccaaatgccttggaaggtggacatatacatacattcagacattagtgtcaataccatgttttcagaaatcacaactaaatttagcactttcagcaaataggttagcaagcagggttatgcagtttgttaacaagctattgcttacaactgaccgacgatatctagttgaatttgttatgagaacaatcttgattttctgagcaacaaacttgatttttcaatgcattgcgtttggctttcttgtttctctaattgcaaaattcagtgcattttgtcatcgtgtatctggtatcttgtcaaaaaaaaaaatccaactactgggaacatccctggaaagtttagaatcatttatccagtagttactagtaccaacaaccggtcaattgtagagcgtactgcagctcaactgtgtttcgtactgccacttaataaatttgcaactgtgttgtacttaactgactcggttcacatggggaaatggcaggtcctggagttattggagtccggcgagatatctcaagatcaatggctgatgcccgaggaggaggaggaagacgagttttgggatttcgacgatctcgacgacttcgaggacgacgacgacgacgatgatgacaactatgataacgacgatgaatcggattctccctcgatatcgtcgtcagcgtgcagcatccacgccaatgattagccccaaaatatttgagtctgtcagtcttgacagagtgccccaattggttttggtttttaggggatactatgatcgatgggattatattagtgtacataaaccacctagacaata

SEQ ID NO: 65012 - DNA, 9315 bp, Oryza sativa
  unsure (1)..(9315): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgagatcatttgtacagctacggtactattgcagaaagataattttctacggctagatcggcagtaataaagcgtcagtagagccaaggaagcaacgaaattgagggacaaccaggtgggatcacggtaggaccaacgcgaagacccaaaccctagaaaggaaaattcacaacgtggcagccatctcaacgaattaccgcaacctccctaccaaactaacatctcctaattagaaaaagaaaaacgctgaaatctcatcaaacaaaccccgaaatcacgaacagagagcacccagatcaccgccgtaaatcagcggaaccgctccaaccaattcactcaattctgctcggaaacacgaatcgctgttcaattcttacctggagtgagtcagctcgagcgaattcaaccccgagtcgcgcccccaccctccaaacctccctcgtcgaccgtccgcgcgcgcgcgaccaccaccggagaggaggctaccgcgcgaggtcgccgacgagagacacagagagagaagaggagcacctcgccgcccgcgcctcccgcccttctcgccggccgcgcgctcgggggggaaggcgacgcggagtcgcctcgcctccgggggctcgcgcagcacaacgcagacggagaaggggggagagagagagagagaaagagagtagaggggagaggagaagagagagagagagaagcattagagggaggggggtaggggtatttccgtcactccacgggaaaaaccgccttcgacgcgggggttgtgaggggcagggatgtcattttggcggggagacggaggggggaggttgcgtgtcacggttggttagcaagcggggtgtgtggatggacggtccggatgagaggtttgtggtgatgggggtggcatctcggccgttgatgttatgggcgaccgtggtctgagtcatcggtccacgagcccatcacgtcaccggagagggacggagaaagggaaacgtggttacgcttcttctgtatctgtagcaaagtagtagaagtaatttcttttttcgaataagaaaagtaaaagtaatttcgctgcatgtttaaaggagtattattatactgtaatctgtgtgaacttcaccttaatctgtgtgtaattactgtgtactgcagctacggctccacttcactagatcgtgtgtattcgtgtgtggtatagtttaccctgacacgcatgcacgatccggcccaaatataagacggcccgcgcgactcgacggaatcacgcccaattatacagtgggcctcacgttggtcgctaataccgctccggcccagttaccgaaggccgcacgggtgccgtgatcccgttcaggcctatttagttgcgaggaaaaagtacaccaaatcaacttgtcatcgagctacaaaattatcccccaactaaaaaaaccagatatatctggttccggtatctggtttgtttagatgagggacgtccggtatctggttttatggttgggggatgattttgtaactcgatgacaagtttagggaccttcggtgtacttttttcttagttgcgatccagttccagcctatagttgctacgggccgaaacgttgcgtgtgtgggccaggctcccaggtcaacttcgtcaggcctttgttacgaggaaaattaccgttcctggttttaacagcgtttgtgcaatctagagatgtgataattgaaaatttttactcgtactcttaactatcacacatatctataaaattttcatattcaaatttattatactttagccataataaaataaaaaaataacagttttaagagtaaaattttattcaaatttagtcttgtgagctaaaatattataaatttgaagataaaatcttatatatatgtgtaatattattagagctatgtgttcaacttttttttatataattcttttaggatacttactactccctccgtcccaaaatataacttctcccccaatattcttttcccaaccaataacaatcatccaccatttacttttccaatctatctccattactcaaccaatcacaactcttcaccattcacttttacctgtttttgttttttttaacttcttctacatgtttttttaataatcgtgttcagctcttaaaaatgtttggggcatttgcaaatttgccaccggttttttgaatattgcaaggataccactcgaatgacagttctagtggcatttttgcaattttctagtggcagttttgcaataacgattcaaagtagtggtaaatttgcaattgccccaaaatgtttatattggacggatggagtagttgtgtataggatatgttaattaggccgatagagccaaagtctcgaaccaaatctgttggaaattcggaatttccagcagatcagggaggggatttgagctctgatccaaaaccaaattagccaaatcatcatcgtcatccgagacttgagctttagtccaccccgtgaccttcgctgacaccgtcgctttctctctcatcgatcagccatgcctactctcgacgctcgcctccgcctccctctcgccggactatcgccggcgacgacctccttcccgggatccacccccaagccgggcagcctctcgttcgccctcaggccgccctccgcctccctgtcatcctccgccagtgccccggcggcggcggcgccgcccatcgtcgtcgtgggctccgccaacgccgacatctacgtcgaggtcgaccgcctcccgctcgtcggggagacggtggcggcgcgcgccggccgcagcctcgcgggcgggaagggcgccaaccaggccgcctgcgggggccgcctcgcggcggggcccacctacctcgtggcgcgcgtcggggacgacgccaacgggcggctcctcgagggcgccctcgcggacgccggcggcgtccgcctagaccgcgtcgcgcgcgcgcccggcgcgccctcgggccacgccgtggtgatgctgatgcccggcgggcagaactccatcatcatcgtcggcggcgccaacatggaggggtgggcctcgggggtcggctcggacgacctggacctgatccgccgggctggcgtgctgctgctgcagcgggagatacccgattgggtcaacgtgcaggttgcgcaggtggttgctctaattctctctttagatttgaacaagtttttctcatttacgcactttgttaagtggtcgtcaaattggattgaatttgatagtgtttcgtagctagatatgttccttaataaatttgctaatggcttctagcttggccgtgcctttgaccaaaacgaagtgagaaaatgtggcctacagttaaccgaaattgtgtggtatgatgagcttattgcattagtgcagattagttcaagccttctaggtcatattgcagcaaaaacacagtgtggattggcttttatctgttagctgaacttagctcctgttcatttagtttgatctacatatatctgtgtgatggctactccagattatgattttgatctggtcgttggtaggaaactggatagttgattagacatattgagcatagattagaattttctaagcggaagatgcatgttttttttgttgttgacaaaagtattccaaattttgatgtgctgtctgttcaatgcttatcttgttcttagtgaatttgtgttttatgcttattattgcttaatgcactactaaagcttaagtctatgttactccctccgtcccaaaatataacaacttttagccatcaggatttgtcctaaaatataacaacctctccacaaacattctcttcctaaccaatcataaccctccaccattcacttttcctacctaccttcactactcatccaatcacaaccctccatcattcacttctacctactttcttaataaccatgtccaactctaaaacttcttatattctgggacggagggagcataagttttggtgggaagaaccaactttggatttggtattctttcctcatgatatcaaatgatctgagcaaaataattttatgcacactattttgtacactgtgtaagataggatatatctggccacacggcatgttagagaagctatgttttttttttcctaacctgtatgcatggtattatcccaacagcattcacacagtctcctctatcatcaacatcagtttgaacaaaacagggaacatgtctagactaatggcatcttcatttggctggaatttacagtctgttgcgtatgagtgtttaatggacttgcacttgaaacctaggccattcaacactctgattttgatatatataatgctgttagcttgtggtaaggtgctttgcaattatcctatctgtttcactaagctccatagaagcataacaaaccaaccaatgagggttaggacaaaacatgtggattttgtacagggagagcttgttctcatgtgaggacagcatacttttacaacatccagtttctgctttcttctgtaatgtatttgctcataaagattaggtttgcagttacctttgttttcccctattggtgattctgtgatgtctagtattgtttgagtgcaaatgaaagtagagtcatatgttgtgacttgagaatttatatgttgtgacttcaatgcatttaagaaaaataaagcagcgctatcatgattgctgagttgcttcaacatatgtctgaactctgaaaggaatcatatatatttgtctgtgtgactgatttgtgggagtaaagagttaatgattcctgaagatccaacgatgcagaaagaagggtgattcattttatttttaaattcttatggtatctcaagcatgcctccatgcagttatgtgggcaaatgttagactgatctagttaagcacagcatcacgtgcttcagtcctttctgaagaacttgtgaagattagtatcttagggactccacttggaccaaatgatcttgttggctgcacagtgctactttcgtgtttatgttactccgcaatcgatttcaatgtattatcagaatgataaatccaatcttattcgtaattttcatctttcatagattgcactatcatatacttaagaaatctgagcattcatagtagatagttgggaatgctgtaaccaccttgtgtatttacatatccaagcgtagtaaagctgttttgtaataagctgaatttttgttttcaggcagcaaaaggtgcaggtgtgcctgttatcttggacgccggtggaatggatgctcctgtccctggggaactactgagcctggtggatatttttagtccaaatgaaacagagcttgcacgtttgactgggatgcctacagaaacatttgaacagatcagtcgagctgcaggagcatgccataaaatggtgagatgtccaaattagacttattttatgtggtttgtttttatgcacattcttcccctcatattcataacttaactatagctcttaggttacttctccgttcagatttataacatgtgcacatatttctagatttcaaacttcataagttttcaccaacctttaggctatttacattaggtttagcagtacaaaggtggtacctctaaatttgtatttctatgtaattttatataatctttgattttctacattgagcattatgttgcaagatatttctggtcaaagttcaatttgaagactgcgccaaaccaattcgtgtcttgtaaaatagagggagcgaatagatggcttgtattgctgacttgtatcaatactcattggttagttttgattaaccacgactgtttgtttaatattatgtttaggataattgtaacatgaggaattgcatcaaggtaactaatttaagaaaatgcaaaagcctcctgcccttctttcattatcccatttgtgtatgtctctgtgtgcatgtgttttcataccgttagtaggatagatcttgtgttttagttctctggtatgcgaacacatatgttgtctacatgcaagtggatcgggcatacacacgcaaaagggatatttgccatgaccttaaattggatcgggcatacacacgcaaaagggatatttgccatgaccttgaatcactacctatgaatcgtattgctaagtggctagatgactgggtacagaaaacatgattaagcaagatgctgtaacaatttgtgcattttggtttacctaggtggctaggctggcatgtggctatgttatacaccaatggcccaacaattacatgtagtgctaaatcctagatttgagtagttatgctggcttttggcttacttttattgaacaagtgagtttggtaaaagcaggctttgttctctaataaaatggacaggacatacattagttagttgtttagaaagtcaatcccaggaatgatactgaactagtaggttgaataaccctggtagcacaattggagaaataacacttcagcatgtcagcatctgatcagaaactggccgctggctggaagctcttaattaacttcagtacacagaatctgtgtgctttcttcatggagaatctggatgtctcttcatgcttgtctgctgtataaacaggatgagatttttgtggctgcaattacctgaaagtatgtaacctgtgcctaatgtatattgcggtgtaagaaaagaaatgcaaagaaactacaggtgtgttatagctgccagtgcaggggtttggttcttcaaccgaacgtttttcatgtcatttactccaatcactctctttaatagggcatgttcaagttgttctcattggatccagtgtcgagtaatatatatatcatacatattgacggtgcataattgtttatgagaatatgattagaagttgtgatccgattcatctgtgtttttctgtctacagggtgtgaaagaagtgctggttaaactcggatcacaaggatctgctttatttattgaagggggggagccgatcaggcagccgataattcctgccacagaagttgttgatacgactggtgccggtgacactttcacctcagcttttgctgtagctctagttgagggtaaacctaaggaagagtgcatgagatttgctggtactgaaagcaccctctcctcgtcatttgattgcaattgatttcttgttcttcaacattagcatactttgcttgaggcttcaatttccaatttttaatttcagctgctgctgcatctctatgtgttcaagtaaagggagccatacccagcatgcctgaccgaaaatcagtaatggaccttctggaatctgttcaggttgaataactgtagatctcatgattgtttctcttcagcctccattcatcctcaataatgtaagttgtcctccatgctccttatcacttcattctatgatgtatatttggatttttgctgcttaacattgaggtagcggaaaagaagagaaaatagcatcgctttccattcctcctcacatatagaaacagtaattcggaggggattttagttctgttggtttctataactttcctgtttgtgccatactgccatagctttacttacgttacacactgcctgtccttctcgacctaaatcctcactgttggtagatctcatttaatttcacacatgcaactgatgcgacaccctcaaaaacgtgaattctggagccctgtcaatctcagtacccttttgttgggagacagtgttagctcatgctgtcactcaggacaggagggctagtcagttgtcattatccacctcaaatctaaccatcattcgttatcttttttgcagggggcgcgcggccaaattcgacggatccaatgaagctcccatagaccctcatggcctcatctgctctgctcatcctccaataatgtgacaaccttggagtggaaaaacgcatttcccgggtgccactgccatccatagtaaacgcacccaacccccaaataaagaatggacatttcacgcatccatcctgttgctgtaggccactgtaaatacaatgaacagttttcacactgccctggagctatcagacggtgacaccgtgctgttactataacctttttcttctcctgctgctgctactcctctctcccaaacaccccctaagattaacccatctttgtcatctcagccggcaccacaccagtaaacctgtcaatcgtggccagctgcagatcacccggttacgcaggtcaattctggctctgtgaatatcaccggttgcttcttccttctcgccgtcgccgtacgacgccgacaactgcatcgccttttaaagttcggtgtctcatcttctctttctctctctctctttttcccttttcgctttcgaggttctttatcttcttttttttcccttctcttttttggctactgttgtgacggagcaatcgcacggcctctcgcaattaagccccgggacgatggtacggcggctacagagagagacgccagccaagccaacctttcttcaatcgtcgctactagctatagctagcaagtggcatggcgatatattgcaataaggtttgtccactttaagtagttctgaaggctagaactatagctgaagccaaagccttccattccattcaccatcatcctttccgtccgtccaggccctggcaagagagagagagagagagagagagagagagagagagagcatatatcatggatgcatcatcgcctcatcgatgaacgaacgatcgatgggcgtcgctttcgcagatggcttggggatccagcttccttcgaacaccgtcgtttgattaatgcaccctgtcttgtcgtacctgcatctatttatggaaccggccggaggggacacggacgatatatacgtatggctagctcgcaacgtgacggtgacaattatatacaaaaatgtttcttttggtgaaaaagaaggatttatatgctagtactactactactagtagcagctctattggggataatttagtttttgaacgacgcgtgattgcctagttgatactatcatactaccactactttgctcctatccattatccaaggtgatcgcactcccccccccg

SEQ ID NO: 65013 - DNA, 11757 bp, Oryza sativa
tactatgatagtttatttaatgataaatctagtaacaacacttttacatggttaatcttttttaatttttttctattaataatcaaagttaaaaatgtttgacttgtcactatactaaaaatacttatattttagtacggatagaatacttggtatcactacaaatagcataaggcaacagcacagaggtctctgcaatgctcggttgcactggctgcactgcagcacagccaacgttagccgcaagtgatgcacgaggaaacagttggtactgcacggattggctatgcagcaagtgcagctactgcacccgagtggacccaactttttcctgacagggcatgaaaatcaccaggaaattaccgggagtactttctctcagcggagcaaagctctgccgtcagggatgatatagaaccgtcgggaaaaaaaacgttcttacaagtgatatatgcacatcatgtatgtcttcacacgttacagtaccagtactaattattcgtttggcttttttccctattagaaaataaaaataaatttgtagataaaaattttatatatgtattcttggtgacttaaaaaccaatgctgaaaaagaaattaagttaaaaatatttaaaaatcaatcttaaaattaaatttgaaaatttaaaatttggcttttactttagctgattatgccacctgataggagccacaatctttttctccctatctttgtgtcattgtgagaccggtcatttcatcagcctgaccgaccggtcaaatttctttgtcaactgcaagctagtcctccctaacctttgatgtgtatcggcatctagcaggccaaagtatttggacgtttgcatgggagtggccattgcggagttataacggtgggcttgacctggatcatatcacttgtgttcaaaggcatggaacgatagctatctagtttgttggtgctaagcagcccaattaattatcgatgcgacggttgctgctatccgtgttaagccttgttcagatgatcttattaagctaacctggaaataaattaaatatcttggacttaatctagaaacacactattgagctgatgtatgcagtggcagcttgcaagcccagggctccaataagctaatttaaccagtcagtcaaagagatctgcgcatgcataatgcatcatgcgtaagtacgattagttaacacattaaacattatcaagaagtagtatgtaaaaaccacagtatatttcatattaatgaacgttactgtattaattatatacggatttttgtatttgatgaactaaacaacaaagggtgtgttccccgtaaagaaaatgtattgtaacttaatttctccggccagtgaactagcattatacgcttttatatagtagtattttcggctgtatctttattgacttacatgtatattcagggttggactttgaacacgagtctacgccgtatttgtcttttgtgccggggaaaaataaacgttcggtgagttggtgcacaccttgcgctgtggcctttaatgcttttgaccttctagtatgttgtctggttctctgatgcctatcaggatttggccatatatgcgtaataattctaatatcccaacacaaaaggttatagtcaaaattaaattacatatactgcatgattgatccatccacttgtgcccatcacatgtaaaatagtactataggaaaattcagcaagctaaggctggaaaaggcacaaagaaaacaaaatctaccagccacaagctaggtagacatgtgtaacagtccaagcatatatcgatatctttcttactcacgcaacaaccatcagctgatcataatgaagagaatagtgagtatatcgcatgcacgatctcacatataaatatagctccaaattgaagagatgcaattgggcaccctctggtagtacaagattgagggtacgtacctgccaattgaatgaggccgtgagaatctgctgttggttaaaagctgcacaagattttgtttttctcctttcaaagttgcgtccatgaccatgaatctagttatcttggatcgattagtatatatacatatggtccagaggtgtccttggctactccttgttgactaaactgctattagtagtaaattaaacaatatggcatcaagcaagtgagataatgcttgcatgtatgcatgcccctctgcagatgatgaatctaagtctctaaagtacaatcgcatgcacagtacaagaagattttgccttaccagaattaacgggatatggtcaccactcgcccaaagtgtagtatatatttttctctcggttccgagcctttaattaaagaaaggacatttctgtcacatgtgtttcaaagtaaaagctacaattgtttttagccagttcttatctagctagggaattagatactccaaaaatccttgggtttgagatcatgtacttgtgtaattaatctggctggacacagtacgtaattctgtaaccagttgaaatgtttgacttcttactcgtacaaaccaacttgataatcaaacatttcaaattggtttacacgtgtaaattaattgcgtgtgaatatatatatatatatatatatatatatatatatatatatatatatatatatatatatatatatatatatatatatatgtgtgccaatatccttatatgtagattaaatcagctggcacatataaggatgcaagactatatatctagtctcttccattaatttacacgtggctcacacgcaaatatatgtgccggttatcagcatgtactcctagctactagctagcagcctggcaccacatgttcatagcacatacatgaattgagcaaattataaatagaaagcatgaaaaatatatatatgattttccttgttgaaggcatatacaatatacgtatatatagttaataatattggggatagctagcttagcattggaaaggaaaaacaaaattaaaaaaaaggatgtccatttccactgaaatgtcatgtgtcatcatatctaactgacctactccatgcatgtacacccaaataaaacaaatactgtactacatcttttatatttcatgcagctggatgtgtatgaccagtctatacacacgctggccccttgatcgatctcgcatggaaccaaattctggaaattgtcaatcaggtagccgacgaaatagcaaaccagttagacacattaattgacttgcttttagatctactacctttgttagtacatgagtcacatcatcaatgcactgtaagaggcagaggggtccaaaacccctaacgcctcagcagccacgttttagagttagagattaggtgcatcgatcatctctttgccataattctgacaaacatgcatgactgcgacacccatgaatatatataatgcatgattatctctgatacttagaacccatatataaatgtaagcaaacatgcacaagctagctaatcaggccccaaagctcttaattccacatatcaatcacatacacgcacaatgacatgcacacagcgatgcacggtcgctagctaggcaggtttacatcactatgcatcagtcgtaatgctagtagtagtggtactagtactagccttggaacgacctgaccagtactcgcaaagaaacaagcagcaaaacaaccctcgctacttttcttccttaacaactcttcctaccaaccaaacgaaacaacgaacccccaattaatcatcatcccgtcatgacaagcgaaagccagtatcagagaaactaatcaacgccattcaaaattcaattcattcatgattgaccaccctgcaagaaaccttagctcgattggtctagctagctagagttaattaacaacatgccaattaaacatatgtgcatatatatgaagtactcgtactcttccattaatggagctatataggagaagatcaatgtaaagtttgcataaaattatcatggctcgtatggtcagtcctgcaacctgcagggtgcaatgctggagcctgggaattaattaggcgcttacatgtacaagaagtgcttagtactagagctaggtagagctagctagtaagagcatagaaatgatacgagacccagtagaaaaccctgtaccatctcgcagcacgaaagaaaaaaacaaaatcaagaaacgaaacagaaggtgatcatttggggggaaaaagatgtaacgagatgttaattaattaaacagcatgatcgatcgagagccaaatgacctcttgtctagctagtctgatgattaattcagcttcagattgatggtggtcgtcgcgtcaaggctggttggtgccgtggatgaaggacggcagcagcatgtcctgcaggaggcccaagtcttgcgccatgaagtgctgcatctggagcgccgccggtgacgacggctgagccgaggcggcgacggtgaccgcgctcgtcgtctcgctcgagacgccgcctccgccgctgattgcactgttaaggccatggctcgtcgtcgtcgtcgccgcggcgccgcccatcgtagtcatgccgtggtgggcggcggcggcgcgcggcaggaagctgctcagcacgtcgatgccggacgaccggccgaactgcgcggcggcgccggagcccagcggcaacggcggcgccatgccgtggtgtccgtggtggccgtggtggtggtgcagctggtgcgcggccgccgccgccgcggccgcctgcgcgtgcgcggcgagcaggtgcgtgctgccgcggagcgtggccgggatggggtgcgtgtgcttgccctcgtacgtggtgatcaccaccgccgggtcctggtacgaccgctccacccgcttcttcaccgggcacttctgcgtcgtgcacctgtagtagctcctgcaaaaaaatcaaccccgtatatatcagatcattgcaatcatcgcattctgccgcgcgcgcgcgcgtccggtgcaactactgcggccggtacacgtacacgcgcacagctacgagtcacgtactatacgtgtgtgtaactgtacatacgtacctggggtatgggctgttcttgacggccttctggccgtacttgcgccaccggtagccgtcctcgaggtggtcgacctcgctcttggtcatgaacgcgaaccgcggctgcctcgcccgcttctcccccttccccgccttccctcccttcgccgccgacctgcacccatccaatccataccatattaccaatcagctcgcgatcgatcggtacgtttctccgcgtcaaaagcggcggaatttcgtatgtcgtccggcaagcgacggccacggccgggatcgatcccgttcaaactggatagacacacgcgactacgcgagcgtgtgtgtacacaaggttagggggttcacaccctgtctggcacagtggcactggcctagctttctcgtgatggcgtccccttttcggctcacactggattctactgttggtagctggagattgcactgaaaaggaagctgctggcaagatccaagtagcagaatggggtggtggataacactggcatgcttattgtctagggatcaatctactttgcttttcttttattcctatctaccctttttgggcataatctttggtaaaaggggatcaaagacaaaagttacaaagatctttggtcatgttggaacttggaagaaggtgtgaagaatgaaggaactagcagtagcaggcaggtaatcaagaaaagcaaaacaaagatcagaggggctagctgatacattaaacgacttattttaataaaacattatggcaaggttttaaattttttggaagaaagtgtgtgaggcatgcaagctgagtgtgaaaccctagatatgttcacacgtttgccaaactaccttaaaaaggaataaaagaacaaaaagaggaggaatagaagaatgaatgaatgaatgaatgaatggaagaaagaaagaatgaccaccaagcaaagcaaggaagcaaaatctagcccacagaaaaccggccccaaatcttgataccggatcagcaaaaaaaagaagctctaaatgatctcatcctaatgaattattagcaactaagatcaagaacttggcaaaatgacccaagatttcaagggaaaaaaggagaaaaaaaggagagaatttaatggtgaagtgacctaactcaccctttcttgttcttgtgtccttcatcttcttctcccttgccttcctctttgttctcatcctcctccttcttgcaccttgccggcgactcctcctccccggcgccggcgccggcgccgcctccacctcctccaccaaccccctcgctcgacgacgtcgacatcgacgacgtcgtgttcggcgtcagcggcggcgccccgccgccgccggccgcgacgacgtccaccaccccgacctccctcttgacgtcctccccgaccggcagctccagcgcgcggcacatcaggtcgtagtccatctgcatcggcgtccccgcctgcaggtagtcggcgaaccacgacgacggcagcatctgcatctcccccgcgccgccccccggccgcgcgaacagcggcgccagctcgtcctggaactggtactcgcccgacatagccggatccaccgccgcctctcgccgacgctggccgtgctcgtggttcttggctctagcacgcacgcacgcacgcaccctctctctctcgcgcttccaggatcgagatggagatggacagaggaggaagcaagcgtgcaagagccaagggatttatggatgctactagtatggtagtggaggggtagtgagagagcgagaggtgtgagaggctattagcttagctataactagggtgatgaggcaagggagagagatggatatagatagatagagggatggaggagaggatggttgggtgagaggatttttttttctctcacacttttggtttgcttttcgattaaattgatttcagctttttttgagaggaacaagttgattatttatgccccaaatgagacgcccactccttggcttagcttgtttggtttttcttccttcttctaatctcaaaataatcccttgcttagatctcggcgagactgtcagaacagtgattagcccctgtaggtggccgtactgataattgcaaccgctacagtaaacggtgggggtgtgtgtgtgggaacacggtccacggtcacgggtgcgctgagtcagcggcgtgcaccggcggtagccggtcacgtgggtcaaaccgccgcgcaccggtcgaacattcagacgttgcggcgaccgacacgtgtccgtccccgcgccccctttgaccaccccacggcgcctgcctccatcgctggcacgtggggcccttagcggcgggggggcggcacacgccagcgtgacgcctgctgccatctgtcccgtgccgtccgatctcgagctgacggccgctgatgctggcggtggtggtacggacgcctcggcatcgcgtcgcgtcgcgtgcgtgcgtgacaccggaggcggagggggaataacatgtgcagtgcagcagcagcagcaggggtcaagctggcaggtggggccccgtggcgtttccattcggagacggtgcatcattctgcgcgtcagggggggcatcgggaaacgggaggtggtgttctcttcttcttcttcccctctccagtctcttcatcgttttccttttccctgcaacaggaggagaaagtacaggaaatctaatcatgaaaagggatcacaatgacaggagacctaagaccgtttggtctgctactattcctcgctctcagcaaaaaaatttagagctcgggtgggcaatcatgcaaaagtgcatcatacgcataccaccccaagcccaaaggccatttttgctgttgtgtttgaagtgcatggtggtacgtgctaccactgttttgggacagggatttcgcgtggagaaaaccctgaaattctatttaatgttcagcgaggggtcgtagcgtagtagcgctgtgtgtccagctcccgctccacaaacacccctaaaaaaacaacgaaacgaagcacgaacagtgagcgagtccgtacaaggaaactgatctctgctatttgtcaaaataggtgagctctgcgtgggtacaaggatagttatgcccgctttcgtcacggatttctgagcaggtcaaagccagcccggcctgaggtgtgtgaatataatgtatatccaatcgaacacgtcatcacacacaactcgtgcaccggtgccagcctcaagaaaaagcacccgcgggcacagtggccgtggcggtggcggtgcacccctaccgtgtgtatgtagccgtgtcgcgcaccagcgcaaccaacgcggcaggcaacgcagccgcccaggccgcctccgcgcgcgcgcgcggctcgccccccatgtgaagcgaatcgcccgccctccgccagtgcacggcaacgcccataacaccgcgtccgcgcctcgagctagctaaccacaacctctcacaataaactactcgtatcaacgaacgaaacgctgtaaccgcgcgcggcgtgtgcgcgggcgtctgaaaccgcggtggcgcgcgcgcgcgcggcgcgcgatgtgtacgtgaatccgcagccgcgcgcgtgttggatcgatcgatcgggaagcatgcggcttggggtcacgacgactcacgagtgtactacgtgcgtgccgaatcggggatctgggttagggagtagggacgtgtcccgcgcgcgggcggacggacggcggccggcgcggggctgggcgggggcgggggaagcatttaaggcgagagagagggggtagcgtgcgcggcagatgtgcgtgggaggttttggtgggtgcgcacctgctttttgtctcggaaaggccggtccagccgggggacggcgacgtcctgccgctggtcggtccctggtcggggtccaaccgcgacgtaccccttcctaactcgctcgcgactcgtacttctcgctcgatcttgccatgtttaatttcggtgtaacaccccgcacgcgctcgctccatccatcgatcgatcggtcgctggtctcgcgtaaactcatcgtgtcgcgtcgcgcattattgatcgatcgatcgatcgatcgatcgggccacgctaacgccggtaatttaattacatcacgtacgtagacatcagtcactacgtactagtttttctgtagaaaataaatggatgttttattgaccgaacaaatgtttactataactagaatcagaaatatctatgcgtgtagcatctactccaccttaggaattaaagggcgaaatatattaagtccaaaccaaaaaaaaagtccttgttcggtacggaagggagttgagatctactgtactactgtatcaacactttggactaaataaatagaggtgctcagagcaggcataatagtaggctataagccagctgcaaatatattttaagaagataaatgaggagagagaaggataacgggctatagatttgtagccagctgtagcacggactataagacatagtgtgtgaatgacagatgggaccaggtattaataatgtagtatgtaactattgtatgaataagctattagattaactatagatgaattggagctcatagttggctatactatttaacttgctcttaattatagtcgccacggcatctacagaatagatgacagtatgacatgacgtgtggtatatatctcctctccgatcgagctgcaaaaatgtgactcgttccacgtatgaaaagccacaccccatgagcatcaatcactgcctttcttattactcgcaaaaaggaaaggaaaaagaaaagaaagaaaagttgttgttgcaaaagagtgacattaatttgtctcatttgagatccatttattagaacgacgtttgaaattttccctggtgtgcgttcgcgaattttttttccctggtgtgaaatctctcctttttttttgttttgtttacgcaatatctagctgcatgtgcaatattaaagctgctaacaaagtaacattatctctccaaaaaacaataaccttagacttgtcgttaacaattgaaatcattaggtttatgaggataataatatatgtcatactcagttaattttaggcaaacaacttccaaaaggatgctacgctttcatagagacgtcataatgattactttgattgagccacatacgtccatactactatgaacgattacgatatgtaccgagaaaaacccaaaactggacgaaacacataagaatacagtgctctgtcctttgatatatactaatacagaccacactgttatcagccaataattttgatgttgagttcaaacaagcaatcaagctcaaataatactactccatgagagagatttttaacagttagcccgcgacgattgcaacatttttatctcagctagctaggtaaagatcgagatagaaaaggagagattagagctagtactgcatttatggtggtaggaagcatgtcactatattcggtagatgctttgacaactgaagctaaacttgcaggaaagtgccaagacgaaagtcaaaatcacaacgctgaagatgcacaaaggaacaaacgccacatgatacaggacactttcgccctaattaaaattttcagccgagatgcatgatggtcagataggaattggagcattaaacaattatgaaatctgccaaatctgggggaggcgattaaccaactagctaagccacgcatccaacgatcagagcagcagcaacttgcaaacgtagtccaagccttttataatcctccgtccacaacgccactgtgacctgtaagagactcatgttactgtctgtctctgcgtgcctgttggtttgacttgatgcaaaagtccttcaattctttaaaagatttatggaatctaatcgacgatttaaatagtactactctgatcgatccattcattaacttaaacgggagggttttagaatatgcgagtcatctcacctactccaatccgcatctcggtcgttgcaggaaacgagtacgtataccaacgaacgtaccgtcagtctctggcaagagaacaactagatgatggctttgaataaggctgtgtttagatttaggggtaaaaattaccgtattacatcaaatatacagacacatatttaaagtattaaacgtattctaataacaaaacaaattacagaatccgcatataaattgggagacaaatttaacgaatttattaagccaaattaattcatcattagcaacggtttattgtagcaccacattgtcaaatcatgtagcaattaggttcaaaagattcgtctcgcaaattagtcataatatatataattagttattttttagcctatatttaatactttatacagttgtttaaacgttcgatgtgatagatgtaaaattttttgtgtgggatataaacaggcctaggcaaagtatatgtgtcgcgtgggatgggagacatgaacgcaaagaacaatgacgataacagtattcgtacagatcttgtacagtgggggaaccaaatgttattttctcctcctttgtacgtttcacgtgttttagttgcaagaaacttgtgtagcagatgcaaagaatctttctcctaacacatggttacgtacgagtggatgagtaaaacgaagttgtagcatacgacctgacgggaactcatcactcatgcaagatatatttgcatggatagtcatagcatgtatatatagcaaacaa

SEQ ID NO: 65014 - DNA, 10112 bp, Oryza sativa
tcttgcttctagatcacaacatgaactagaagtttccacaaaacaagcaatatttgtgggttctagtgtcagcgatactatcaaaacatgtattgccatgggaaatgaacgagctgcactcaaagtgaagtcagagttcaaggtattgaaaatgccttcaaaaagaaaattgtggctgatgaataataatattgtaatctttctattgtcctatgctgcataggttcctgataagaggtggtactggctcaaatcatgtgctttagctacagttgggaactgggatgcgttggaaaagttttcgaaagagaggaggccaccaggaggtagatttacctattatgtatcatctattcatgagaatctgattggagaacaacattcatggttcttccgcagggataataaattcacaatattaattcatgtaaagaaatatcattaatatgttttagtatgctgatattcggtttccttacaggctataaaccttttgtggaagcatgtattgatgctggtcaaaaaactgaagctcttaagtacattccaaagttgacagatcctcgtgaacgatctgaggtatattttacacttagttcacatattacctaacaatctttggtatattttagttaacatattactccctcggtcacaaaatataaaggattttggttggatgggacatatcctagtacgacgaatctgggcaggctcattatccaaattcgttgtattaagatatgttccatcgaaccaaaatcgcttatagtttgggccggagggagtaccttctaagagttctagcagagattaagattgaagtgaaattagtttgatgcccctgagtatttaactcattaggaacgatcacacccagtgatgcaacgagaaatgcagggaatcatgaggtgtggttggattgagaaagtagtacactagtactctagaaatgcttactgcccaacgaaatatttgcaaacaaaaaaataatttgtgatagtacttttatatatgtgttcttagcgatataaaaacaaaggctgcaaaataaactttttcgatgaaaaaaccccaaagtcaactccagatgtaaggttgaaaattcaaattttgaacataagcgaaaagatgaggttaatatttgtggacagagagagtataacataacatttgctcaaaacaaattgaaaaagaaaaaagtcgaagaactcatcctagtattctttgtcttctctgaacatgtatttctctccgttgtttgtttcaatatacatatgattttaccttggcgttgttgttcaggcatatgcacggatcaagatggcaaaggaagctgcagaagcagcttcacaggtcaaagatagtgatgagctatttggtcgcctaaagcttacacttgcacagaacacagccgcggcttctattttcgatacattgcgggatcgactatccttccaagggacatactgacctatacgtgtttggccatgggatttgagttttgtgcacccttggtacgtgcaattgcgcaatcagatcgtatcaattcatcttgatgtttctaccattttcttccttgtgtaccgactccacagtgtgaatacccccgtccacactccagctatgtaaaatgtgtagacgattttgaagcgcgaatgtggatcagaggctttttttttttgtagatgcctctttgttgatatgccatgtttaaaaagaaagagagagcatgcattgtgacaaatcaatctgcacgtccatccgatttcggcttaaccattactttttcagccttcatgctcatttgcaagtattttgcaaccataattacaagtattttgcaaattaacacaaaccctgatgagacagttaaatcgttatgcactcaataattttgtgcgccaaagaaccgatctgcgtcagcctagtacacgaccaaaccaagcagattatatatatcaaacaccaagcaagatttaagtctgccaattactaataacgccatatgcataaggtttgccaagcatgttccaaacgataaataagtatcaaaatgctcaaagtcttttgcgcatcaaaactttcaacaaacgaaaaactttccaactcttgtactaccaaacaaagatccacatcacttcgtaaccaatcacatgaacaggtttggcctcgacgccttgaacgtggtcttgagcttcctggttggcggcctgaccttgcggtacacaagggggaacttgatgctcccgttgtggaactgcttggtgttgtccctcttgcagagcttgaagtggacagtggcggtcttgatgatctggatgcaagggaatctcacacggtggcgagaagccatctcggtgtacatctgttccacggcaccattcaatgtagtgtcacggtactccttgtacatgttgtggtaaccggttctgctctggtaacgcagccagatgccatagttcttgatcgtggttgggttgcgctcgaagatctgacatggcagaaattgtgaggggtagagaagaaagtattatatccatgcaaaaatgtgaaatcatactagaagtaaagtgtgatctagtgttcaaaaattaatgtctccatgttgggtaaaatttctggagaaagaagtcatcaatcagtgctagagtttcaaacatcattcaccataaacatcccaagtcccaacaagctacattagatcaaaacacagctataaggactaatacaagactgctacatgagtttaaatataattatatatataatgagggtcatatctgattaatgattttgcttttcaccatttactggcatctatccacagctgatgtgtgttctaaagatgtattatgttaaggccaattcttacaagtataaaatggtttaacccctacaaagccatgatgcagaaatatgaaaaactcgtttgcaaatgcagatggtccccctaccccaacacaagtgaaataactagtgaaacgaagatgacacacagcaagctcctaacaaaacaagggaacactagtgtgtggcaatttgaataattgacacaaagtgagtacatgcaaatcgcacgtattataacaccagtaaagagtgatcactaacagtgcagtaacaaggaaacaacatacgagctggagttaaaaaaaaatgccccacatttggaacaggtgtcagtgtcacttattagcggtcaatcagtatgattaatatctagaactaggttacaaatgtcagggagcaatcagggcgaaatacaatacgtttgaatttctagtacctcgttgatggcgagcatctggccgttgctcttcttcaccttcttcagcttcctcaggaagtacctgcacaccgggcaagcgccccaatcagcaaaccgcacgagataagatgaactaaaaaagaaaacccacaaaatcgcaagaaaatgacgagatgacggctcaccagaacttgctcttggcgcggacctcattggtggcccagagcttcatccggtagatcttggggtgctcatcgccgggggtcggcagcgcgcgccccaccacctggtactgatggaactgcacgcacacggagaggacagatcaatcaaacgcacggaggcggccacatccaccgaagcaacggctgcttaccctgaaggccaccatttccgcgagctcctcgaaaccctagcctagcctaacctacgggaggatgggggagagcgcggaggaggcggcgggcgaaggcggcgtcagtgggatggcgaggagcgtttataggtggcgagtttggtggtgaaccctagtgggcctagttggcgttgtaatgggcttttgttacaactagtacttgggctttgttttttattttcctcaaaaaacatggtgcatgtcagcaactcagcatttgtgatttcaattagagaaatcattagcagcctctttttgaaagagagagtttgggagttttttttttcggagattgatttttttttattacaccgaagagacacatgtccacacatgtgatgtaagtgcctttctaacacacaattaaagagacaaaagacttgcccaaaaaaaaatagagagacaaaagactagcgacaaatcactgatgacactaaattcgaaaattggtggataggtttacacccaagactccctaccgcactgtggaaatcatgtaaatgtcttgttttccaaattaagagtaatgcagaatataaaacatggatcaccaacggtgggaattaattgaacgaactaagcgttgtttgcttcaacgtctttcaaagactaattaagattgtgttaagcatctaacattataattcgtacagaaaaatcactgataacgttgcaggctcttgcagcaaccgtgtaaaacaacaattttgtacaccatccttcatcaggtaatcacactacaaactgaaatacaaagctacattcacatcaaaacaagagaccggctgtcaattacaactgcaggtagtgccgttcgaactgcagctggccgtccacccgatcgtaatgagctcgatcatcgccaacatcgtctctgcgctgctcatcgagctgctgctgatcatcgccgccggtcatcaccatggccggatgatcgcactcgtagcgcggaggtgcagggccaccgccgaggtacgacccgcgcatgatgaactccctgatctccggcatgtcgatcagcttccggcgagggctcgggcatggaggcggcggcgtcggcggcaagggaggcgggaacggcctcaggatgtccttcagccatgggttgagctcgatggactcctcctcggtaaaggtggcggtcaggccgaacaccctccgcagccaccacgaaatgctcccgcggtcggggtcgtcgtcgccgccttcctgctggtccggaggcgcagccgccggcgacggggacgtgttcggctcctccggtggagatgatggtactacacggtggcgtctctggcgccgcggcggtgaggcgatgtcggtggtggacagcttcctcttgtggcgggacatcgccgccgccgtcgtgggtttcctggcgccgggcgcgcgcgggctgaagtagaccttgctcaggaccagctgctcctcttcgtcgacgtcgaggctgagctccaccatcagccacccggagcggacgcgctggccgtcgtcgtccttggtgatgaaggagaagctctgccggtgccccaggcggcggccggaggaggcggcgagcacgggcttcgcgccggcctccgagtgccagcacccggcgccgtcgtccaccgtgcgcgccttgcggccgcccttgagccccctcacggcgctgaagaagtaccacgcctcgtcgccgctgctcctcgccaccgccggcgcgaaccccctcgtgaggtcggcggggtcggcggagtacacgtccgcctcgtggatgatgaacccgcacgacgacgacgacggcggcggcttgtcgccgggagacgacccgtgggcggagctacgtctcgatgagctcctgctcggaagggtggacgtccatctcgtcgtcgtccaggcggcgcggcgccgtgcagcggctgcgggggaggagctcggaagggtggacgtccatgctgccgcctccgccgccgtcgagacggcgcggcgccctgcattggcggcgggggcgggaggcggcacccatggcggcggattggcgcgagggtatcgaatgatgggtgggaagctatcagagtcgcaagcggatacgaatacgggatcgtacgggggatgaagtcttcccggtttatatcgagcccatcgcgttttctcctcgtgttgtgttcggactccgcatccgagtcggtgtaggagagatcaatagatgatggcgaggcgggtttccaaatttcttgtttcgccaggtgagtttgagattgtgttcctctgggtttccaaatttcttatttcgcgttccatattttgacggctaccctgggccgaatgatgggccagccatgttcgattttattgggcttgacttcagatttccagcaaaaaactatactaatacatactccttccatcaaaaaaatctaagacctatttctttttcattaagatctaggagcaattaattcattcatcatgttataaaaccaatggacatacaaccaataagtactaaaataatttcttgagtttcgatcaacaatttaattcagcacatagtaactacaaatagaacttagacttttggaaaaaccaaagaatggaatatgtcttaggccctttttagatcccaccccaaaatttttcaccccgtcacatcaaacgttggatgaagtattaaatataggcttaaaaataactaattgcacagattgtgactaatttgcaagacaaatcttttaagcctaattgctccatgatttgacaatgtggtgcaataataaacatttactaatgatggattaactaggcttaacaaattcgtctcgtagtttacaggcggattttgtaatttgttttgctattagactacgtttaatacttcaaatgtgtgtccgtatatctaatgtgacacggcaaaattttttaccctagatctaaacacagccttagacttttggatagagggagtagaatttaaggttaaaaattagtaagaacatgaataccatcatcagaatgattttttaaataaatacttcctccgctttgtattataagactttctagcattgcccacattcatatatatgttaatgaatctagacatatatgtgcctaaattatttaacatctatataaatgtaggcaatgatagaaagtcttataacctgaaatagaggtagtaataaatatgacgaatacatcaatacctacgagaatataatatgatctacgagaatacatcaatacactagaaatatatatcaaaaagcaaatatgagaatacaattccgccgtcccacactgtcatttctatgtatacatgtacaacccagaactccacaaagtaggggaagaataggcatttacattacggtaagccggttcaccaaatctcttctcctcttgtgacaccaagcaggatagcaatggcagcaagcgaagcctgttcgtggtaacaaaaaaaattcaaagcaaagttaggctttctgctttcaattataaagaacggaagaaacttacaatttcatgattagtagatatcaccgtgaaattttattttaccatttctacgccatgcttatcaaattttatgcacaagagtatgtataattattagtcgaacaatatggcaacacacggatatgcttccttactagtatcacttagtagcttctaaaatttaacggtaaaggagatttccttttcagctattcatctatttgcattcaattccacctatgcagttgtggcgtttatcagctttgtggcttgtgcttgcataaactgtcaaaataaatctgacacagtagctacagcctaagtctcagaacaattaacaatttaacatgtaaaggacttaaaatggcccgtaggccacagcaattttgaaattacagagcattgcagtggtgtaaaggacttaccgcaatagtgcaagcaacatatcctggtttctccctgtaatcatgtactcggacgcatatcaaaacaaaagctccaatataccatggaatggcagcgaggaagaagccaatgataaaccttttccaaacagtagaaacagcagtttctcagcgctcaagttcagaaaggtaacgcatgatgataatgttcagagaaacttacaggaaccagcccatgccaaggccgcaaaatggaaggcgtcgcattctcacaggccttccttcaacaacgggaatgtaacctaagaaacaataaacatgataaatccataaggcaggttaggacaatatttgattcatatcaatggaagtatcgaaccttcataaagcaaaaaatgctgaattcactcaagcagtacattgcattcttagataatatattcctgtgatgaattactcagaagaattatgtttcacacagagatcacatatagtactaaagagttccttcagaaactagaatttaatctctaattaatagttctgaagtatgtttgctctttgagcatttgtttacttgtttgttctagtgaactacagaaaattaccaacctcacaatggcatggccaaagaatgcaaatgaaaataccaaggaccaattaaagtttgatcataaaacagcaatgccatgtgtttcacacatggaaacaccagcaaaactacctgctcataagtgaatgttcggcatgagcaactgttgagcctaaaatcaactaaatttgaggtgccctcccttttggcttggcactaggaagtcgccaatccacaaatgaaacaaaacagcaaatgaaactacaagttcaacaacagagatggcggatatgggagatgcaagttagaaacacatatatcgccttctgatataacatgcatttcagaaatcaaaatggttcaggagatgttaacatgctctgttaccccaagtgaccacgtgagcacagatcacagattctaagagaataaggtacggtctatgtgaacgaaaagtataaaatttcaaggctcgatctggttcaatcatttttttagttcaacaagttactcatcatacaaacgaaaaaacccaacagggcttctctactagtactgatttcttcaaaacaggcagcttgcactaaatcaacagcactacacaaattcactaaaaatgcttccaggttctcatagacagtgcatccatcgtacgaaacggcgatccaagcgtatcacacataatcgaaattgcagggctagggtttcccgtaccttgcacggcctggtagcccagggcgtagtacggcgcggcggccgggtacgtctgcgggggaagcggagggtagaccgcgtaggacggcgggggcggctgcgggtagtgccggagccccggcggcggggccggctgggggaacccgaccgccggctgcgggacctcaccgggggcggaggacggggccccgaacgtgccgtactggtactgctgcgcctgcggctgcggcggcgccgacggctggaacccggaggaggccgagcggggcttgccgtcggcgtcaggcatctcgccggccatgccgcggtggtggggggaaggtttgctcgcgacgcgggagagacgagagagactttggaaatatgatttagccagctctctcatgacactgatctctacttatatttagcttaaattgaaaaaaaaacggcgtttgaaattgggaaaagaacgtggggctccagcctgtaactgtaagatctgcgaaatttaaaccaaaatttatacaggcaaaacgcgctaaatcaacagtaacagcatgtagttagaacggttctttgcagctgtttcacaaataaaccgtgctggttactgcctggcgaatggcgatagctaagcgacaaagcatttgggttttttccccttatttcaaccttctcagataaaattccatggcatgtggaataaatgattttttttctaagatgctgatcaaggtcacagaaaaatgacaaggaacaaaacgtgtttcgggcgttacatcaggctggcgtgttcagaaatcatttacttaggtgtgtttagttttacgctaaaattgaaagtttgactaaaattggaagtttgaagaaaaaagttaaaaatttatgtgtatagaaaagttttgatgtgataaaaaagttagaagtttaaagaaaaagttaggaattaaacaagggctcctataatctttatacaaactactatttctgtcgcatgaagaatcaacctagaaatgaatggaaccctaaacctagaaataaatggaacactaaatctgaactagtgtgtagtattctccaatgaagtcaaaaaagggaaaacgcatgattcgttcaagctgcaaaatctgtcatctttcgcgtgcacaaggtacatcagaatttgagaatgatgccacaattcaaccgactttcgctgagagctttgtatagcacaagacaagaggcaagctagcctctgtttattattattaccgttga

SEQ ID NO: 65015 - DNA, 10636 bp, Oryza sativa
ttcccaagtagtgccttacaaattaacaacagattatttaatgtacaacatagctgcgagcttctcgagttgaccgtgagttcacaacagcttgaaagcttcagccggaacagctcagaccttggatggtggaggatcctgaataccgcagagcaaattcgcgggcacggctacatcgatcatctttggataggccaagttcaagtctgcaagtggacagagtaaacgatccagatcttgtttagtgtattaaaaaagtggaggtaagatttgatctggtaagtgcctacgtgagcagaagtataatgaaaatggatattcataaattgatgcgagaagaaaaggcacatatccattgttaaagactctgaaacttactgtccataattttcttgaatgtttcctataaacataacaagtaaattaatatcagaaaaaatatagcttttattagttagatgggtgtaaagaattagccaaagtagcatgtaccttatcctttgttagtcgagcattatacgcaacctcctcttcaacagtacttacctgcaaaataaaatagtcaagtgcctggtaccttgattagtgagctttaagaaagtgagcacttactgtgaaacctttgtagtcatggccaggataaagcagggtatcctttggcaatgtgaaaatctgataaggataaaaaagtcagctacctacccttcatattatgtatgaagatgatgtgtgcctagtttcaaaatattatgtatgattgcctaaaaaaagtggtatgctattctataagctgatgtgtatttagtcttaaaaaaaggataatgcatacttgcctgcgaatgcaccgactcatacagctcatcagaacttcctccctgtaataccagaaaacaaaataaacaatctatgtttaaacagaatttctctagaacatgaattctgagcttccgtatgcaagcaaacttatgcttgactaacagacagaatacattcagtccctattaatttaattaaccacggtatctttagatttcaaacagaacagttcctgatcgctaagccattaagaagtggcagtggtaacaattacctgaaagtctgtccttccacatgcacgtataagcaaggcatcaccagtaaaagccattcttggtgaaggttgatcatcgccttcacctgttacataagtcacacagccagcagtatggccaggagtagatcgtacctaaaaagcaattttgccatttctgatatcagaaaatttcatcatatccaaaatattacatgacggatagaacaaagatgcataattttcaatgctgttttattcagcagcttggttgacagtatacgttttcttattcatattatatctgtcatggatatgctataaatacctaaagccaaactttcaataagaacacaaatttcaagaatcaacatatccacaaacaatggttgcacagctgagaaaatatttaatatcacccaaacaccatatctccataaacattcacattacctcattttgtatgaaccaagggaaaatacttttaaatttgttatacaagtctaacctacaaaagtgcacagtttttaagtcctgaattagctgtgtggacaactgtttatcgtcttactgacaaacaccgcaaagttaaaatgattaaggaaacaaaatatacatatatgaatagatcacataaattatgtctctgaccaccaccaccacaaacagaccactcagatgaccatatacagaaaaagcccttttataattagaagtagacaatccgttcatatttgcagcctgtatagagtgagattctaggggaactgctgcaattgccatactccataaaattcagaggggtgggggtggggtggttgagagttcaggattaatgtttattaagttcagccagagagctcaaaaggactagtttcaatagtccccataaattatgtcagtgcttactaaatgaaagaagaaacacatagccaaacagctaattaaaatgggattatacctcaaggaagaggttaccgaagtatattttgtccccatgctcaataaaatggtctgcttttgctttgcttacttttgcaatcacggactttactccaggtaacttagtctgcaagtacattccatcagatgaccatgttatgaccaaagagaacaaagtatcaagactatgaaaagaaaacatatcacaagatctcgagaagttcagaggttggaactatttacctttattaatcctgttccagtgacatgatcagcatgcacatgggtattcatagcatagactagcttcaagcccaactccttgataagattgagatctctatcaactgttctgtccacagggtcaatcaactgataacacaaaaccaaggacattagggaggtgatcaacaaaatggaagcaactatagctaaacatcaaatctacaaaaacagcatcaatatttttttctgatttagtttagtgcttattgcgctagtctagtctgtcacatatatagagaaaaaggttacattttttttcattttggctcaatcaatacgataattaagaaaacaaattatttgaaaatacttaagcaaaaccgtggagaaggttaagttttgggattcttgaacaaattagcgagattgcgcatttatgtaatgtagtgccaagtccaagataacatgaatatatgtaacccatcagaatgatatcaagtaatttgattatctttcatagtttataaatgcacctcctgaactggataattataatcaccgtcactgattgcaacattgccaatatcttgcgtactgtcagacattaaaaaaacgcaagatgatctttaaattagttagggataccacaattcacaggtaataatcaattattccagtcttatacctatttggagtatttagtttgctatttaatttatgttggtatctacatttctgcagtagccactgaaagagtaatcctgcttacggtatccataaaagaggcttccatttacccaactgatacccagaacaacgaacagatggtcaagagcatcaactactcaccacggcgggtttctcggggtccccgacgtcggcgaggaggtaggtgtaggtggagctctccttctcgaacagctgcctgaacagcagcctcctcccctccgcggcggagccgctgctgtaccccgccattgcgagcaccaccggcagcagccgcagtccccgcgagatcggcctagcccgaggagcgcacgacgatgacgacgacggcgcggcggcggcgcaggcggacaggtgcgggatcaggcggcggcacgagcgaagcagcgccaccatttggctcttccgccccgcccaggccagcgctatataataaggcggaggtacgcacgcgagtgggaggaggaggaggaggaggaaatcaagacgcggaagcgaccgcgcttggcttgggtgttatcggcggcggtggacctcgcggtgattagctcacgcgccggaataaacaaatggggagcggagcggatcgggtcggggtcggggaggggaggcgagtaggcgacggcagcgatgatgtggcgacaggcgaggtccacgaggtcgccggcggtgccgtggtttagctcgcggtcgcggcggcggcgggtgaggacggaggacgagatagctaccagatgggggcaggggatgttggcagttcgccggtttccgctaatgtatcagcggatacgctaatcaggcttcagaatttgttcagatacttttttttttttttgaagaagttgttcagacaccaatattacatgggacgactatttttttcttgctaaattcttactaacactgatatgtcattctataagtgcatctagattttatataactttcatctacttaaattaaacggttcagatgattgatagtaaaagtttagtaagaaaaaattagtacgtgtacaaatcacggatcgggctgttattataggttgaactaatcgtgtaccactaccactccagctaacaactactactacttactactaataacgagcaagtgatggatgacctcatggattacataatgcgaaaggaacgggggaataaaaagtgggggttctggaactccaaatatttaaaggcgtaaactgatgcagcgatgcgtgcgcgtgttttgttcgtagtacgcgcgtcgggaacaagttgatcgcttatcagttgcgggctgcactgcactagtctgacgcggacgttccgattgatagggcaaccaacaacaagctagccgcgtaatcaagcactgggctcaggtggacaccggcagtaaaaaggctctttggattgggatgtttggtccgacaatatcccgcggcaatataatatcctgttttggtttgttatagcactactaaaatattggttcgataaagttgatgggtatagaattggctgcacctgtggtacagctaacatgaacaataatctgtgttagcaatacagttctgcagtgctaatattgataatgtcaaatttatagcggaatgtttggtttgctaaacgcaacacaaatttgggtaggaaagagaattaaaacaacccttacctttttcctttaaaaatatataaatagtattattaaaattaaggggacgggacggctcgtagtatacaatcaagacgccgatattaggaaaagacttaatatgaaataattagaaggggtgaggttttaaacccatatcgtctagcccactaccttgtggagctagctagaaaacccctaagcatttatgattctccttatctcttcatcctcgtcccgctcctcatcccatagataccgcgtagtttcatctcgcgtgttccaccctgctcactccgtttgtgcgcgttgcgccatcccaccgtgtgctctagatcctcacgtttgcgttgcacaccccacgcgtcagggtggaaccagctcatagccaccttcaactaaccattgttgaacacatagtaaaaaaaaaatctaatctctatgatacatggtgttgttttaagaatgtttggtttgctaaacccaacacaaattatgggtaggaaagagaattaaaacaagccttacctttttcctttaaaaatatataaatagtagtatcaaaatttaggggacaggatggctcgcagtatacaatcaagaagctaatattagggaaagacctaatataaaataattagagggggtgaggctttaaatccatgtcgtctagcctattactttgtggagctagccgaaaaacccctagacatttatgattctccttatctcccgaggatgaagaaatcgggccagaacatcattagagttctgaattgctaaatttgcaaagaatgaagaatgtgcatcgaaaataataacatattaagactgtggtagtattactagcacggcaattgttcgatagttttcttctaaactgacacgatgatgcccaatcacaccggaccatctcgtgggctcgtggcaaatgttcaaaccggcccggttggatgcagcattaggccgacatgtaaaagctctgtatgcttgtagcccacaacaaaaactcctcgattacgagcttacggctaactccattcggccgtggacacaacggaggcctctacaagaatccaagacgcaaatgctcaaatggcctaatgaacaaagaaagggacaaatggcctggtgaccgagacaatcaggcagaacacaggagaaatacccaagaatcccttctctagaacagatcaacgccatcaaatatactccacacttccacagatcgacacgcatggatgccggattcgacactctttggccgatggtacgagctggatttgcacgcagcctcctgctacatttcgtctgtgtcgtctgtgcgctgcagtgcctgtgtgcccaccacgtactctccaactatacatgcaaaggcagccacacgtacatacactgtagtttcacccgctggctacgcccacagtttccaactcccattggacccatgggaaaagacaagcttttcatggtttctgctttgtactgatcatacagaccaacagtgctaccactgccacagtagaacaaatccgtttagccattgtaccgcaagcctaatgcggacaggatgagtacattataatctctgttagtatagaccaagcaacaattagccacgccgagtttactgtggcttagccattaaattactgtggcgttgcccatttgtagcctcatggctcggtcactccctccctctctctctctctctctcttcacgggagggcagtgtggttttggtcggattccgccaagttaggcagcacatgcgctcgccttcccctgtttgtccatagttccatacacctgcaaacaacgccctcctttccctcccttaattgtcggggcgctctcgccgcccgcgcgccactgcgctgctacacgctacgggataagccaagcttgcttgctttcgtagtcgctttgctcgatcgctcctctcgatcccatcctagattccactcggttctgcttctgctccttcgatgggttcccgcgacggatggcggctactcctcctcctgctcggcttcctgctcgtggcgccgacttgccgcgctcgggaggcgcagccgctgccggtactggaggaagaggaggtggtggcggacgcggcaggagggcgtggtggcgcgggcgctgctgccggcggaggaaacaggcgcgcgccggtgcggcacgagctgtcgctggacttctacgccaagacgtgcccggccgtcgaccagatcgtcggcaacgtcaccgcgccgcggttccgcgacaaccccgccgccggccccgccgtgctccgcctcttctaccacgactgcttcgtcgaagtacgtacgtgcacaatgcacagcccatgcacgctgcaatgcgcgcatacattgtgcgcaaattctctcgtgcaaaagcacctagatagcacaccttgaatattacactgttttgttaccgccacgtacattttttcttgccacgcatcggtgtccaattctgatcgatctttgtgcgttgtcatcttctcaggggtgcgacgcgtccatactgatcgcgccgacggccaacaacggcggcggggcgccgagggtggagagggacatggaggagaaccggaacctgccgcaggaggcgttcgacacggtggagatggccaaggccgccgtggagaaggcgtgccccggcgtcgtcacctgcgccgacgtcctcgcgctcgccgcccgggacttcgtccacctggtacgcacgcacgcatgatgcttcacatttctccaattctgtctttacaaaaaaaaatacacccaaaaggctcgttctttcacgagaaaatccgtgcattttgtggcgactgtgaactaaacaaccaaaacaactagtaactgtgcaagtacagtcctatacaaccgaaagcgccaacaaactgaaacgtaaggtacatttcagtgagaaaaaaaaatactagcaatgccagttactcttagtaattactgctgaaatgtacacttgtacagtacctggatgtacagtacagttgtacagtaatttgagagagacaaaagagagaaaaatgtgcgtggcaatacaactcccaactgtcaaagactcagagttagtgtacaagttaggagttaggaccatgtatgtatgcgagtccggggaaaagaactctgctttgctttcgcatgtggataaaggcgcattccccattccgccgatgggcggcatgtgatctgtgaagccgaagccaacgtcgtcgtcaggaacagggactcctgcctcctgcgcatgctcggctaattaactaactactagtagtagcttatagctttaaccaactcatgcatgcagctaataatcatgcatggtttttctcggcagcacgtacgtacgggcagccggtaaatttaatcaaaggtgatcagcttttctgttgcgccgaatcgatcataaaacggtagcaacagtgcggtcggtgatctattgctagctagttgatgcactggggcgcctaaagcaagcttaaatttgtggccgtgcatgtgttaatagcaggtcttggttttgttagcatcttgcctctgagacgagcgattgttaatgcaggtcactgacattgctagctgacaaaagcgatcgagtacgtagtttgtttccgtgactcgttgcctgatccatggtgacagagtcgatacctcaacgggtaattagctgctggggattcgatactcgcttggatcttagtaatggtcaccacgcagagacaaggcaccagcaggattaagttagtcaggatcgtgtcaagagcagcagcggattcggtggtgtattgggcacatggacatggttttgatcagcgtgtgtgtgcccgacgtctgtcacggcgctgcccgtgtatactctgcctctgcgtctttctgtagttaagctagctagctagatagccaactaacaagttggtctttggtttgttgtccgtttgctcgcctgtgaagcctacctctgagcaagtcaagtgtcgtgttcttcccatctctctgcctctatcgtttgatctccccagtgatgatgcctgtgggcaatagtcaagcctgcttctgcctggctggcgcctgctttgttgggtagcacggtctctcttctttgcagtgttggttgtgcgtctttctggaccatttacgcctaggtagggagggtttcacaactcacgaaaggctaaaatcagaaaagcgaggtctttggcaagtagtactgtactagcttttgttcagagtactggagtggtaatatggtgtggactgtggagtgatgagaagcatggaacaaaagcagttcatcccaacatgtcttttcctacggatctagcagcatacttaggaacttctgtttttttagagagaagcatatagacttactacatgtgacggagtattttactactcatttttcttcattcattcagagtcagttaatttgtgtgaaatctctaagaagtattacaaacaaacccttaaaaatacaataaaaacaacaattttaataacagcccaggagaattgggccggtgagactcatcatggccgagctgaattagaacagcccatctatgctaagaacttatttcagcctattacaaggcccaacagcccaaacctaaaatttcacctattttttctgtgaacaaaacttgattttctttctttgttctttgtacgcaggcaggtgggccctactacgcggtgaagaagggtcggaaggacagcagggtgtccctggcgggcaaggtgcggggcagcctcccgcgcgccaactccaccgtggacgagctcctccgcgtgttcgccgccaagggcctcggcgccggcgacctcgtggcgctctcgggcgcgcacaccgtcgggttcgcgcactgcgcccacttcctgggccgcctctacgacttcggcgggacgcggcagccggacccggtgatggacgcgcggctggtgaaggcgctgcgcatgtcgtgcccctacaccggcggcagcgcccgcgtggtggtgcccttcgacgtgagcaccccgttccagttcgaccacgcctactacgccaacctgcaggcgaggctgggactcctcggctccgaccaggcgctgttcctcgacgcgcgcaccaggccgctcgtcgaggggctcgccgccgacagggagcggttcttccaggcgttcgcggccagcatggacaggatgggctccgtccgggtcaagaagggcaggaagggggaggtcaggcgagtctgcagccagcacctgtcctgaacgtgtactggtccaaactcggacgatcacactgtctcgatcactcgatcacacttggcgttacaggagttatcttttgctgtaaactgccacatttcggaaagtattagtagttccgttcttttttttttcttttgttgggtgcactagtgctaggttgtgcagggattgttaattttgcatggtcactcgcatccgcagtgtgtgaggcttcctatttgtctgattggattggattggactggattgcagaagagagggtggtcagtgtcttttttctttttacttcaggttttatcggaagctagctcaacttaattttttaatttgtttgggacaaataagacattcatggcgtgctacggatgtactatgctgcacttcttttaatatatcgacgtgtaaagcatttacgtgttcgtttaagaaaagatgctcctatgtcatattcttgaaacatgccaacaacacaacatccatttaaattagttcttagtaattcaaaaacatgatcaaagcattaggttgtgtttagttccttccaaagttggaagtttaggtgaaaattgatacgatgtgactaaaaagttatgtgtatgacaggttgatgtgatggaaaaagttgaaagtttagggaagtttggatctaaacacagccttattgatatggccaggtcatggaggaactagggaagaagttgttctccaagactgtgtttagttcagcgtaaagtttgaattttggttgaaattg

SEQ ID NO: 65016 - DNA, 4834 bp, Oryza sativa
gtttcttccctggatttttcacattttggttcttttaaaaaacttatttcgcaagtagatccctagaaaacttaatccaaaaatggtgcgccagagtggctggcgccatcgttcaacaggacggcgccagcctctttggcgccgtcccaccgccgacgtggcggggcgatgctgaggtggctagggggagttttatttttgttttatttgtttgatatttttttcacgcttagggacacacaagaaccaaccatagaaaaattgaactcaaatggacgtaatatgtgacatgtagaatttttcctctcctttcctctctccgaactagtgcagaggagagagatgtgcaacttttttatttttattttattttttttgatatttttttcacacttaggaactcacaggaaccaaccacgtaaaaaataaactcaaacggacgaaatatgtggcatgtggaattttccaaaactccaccgaaaaacttctctcctcgaaaacacaatcttgcaagcggaatttggaggttttaatatcgccgaacccggcaaagcgggggagaatcggatgtaactttttctgtagatgtccgttcatatattatttgcctgattccgagtccgtatgagaaagttacgcctattttaatagatggcatattttgtccgtttcggtagagttttggaaaattctacatgtcacatattttgtccgtttgagtttattttttgtacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtagttggttgtatcgtgatcctgagtgtgaaaaaacatccgaaaaaataaaataaaaatgacaccgttgcaactccatacagagaaacaggaatagaggcggcggcgccagccatgctggcgccctcctccctagggcggtgccagcatgctggcgccctcctcctgtcacgtcggttcgtgtgcgccacggtggcaggaagaccggttggatgacggcgccagccactctggcgccccaaaaaggactatttctgggataagtttttttaggggtctatttgcgaaataagtttttttaaaaggatcaaaatgtgaaaaatccagggtttcttcctgccgcacgggagagggctgcctacacgtaacgtatgtcgaccctgccactgcagattccctgcgctcccccctgcccatgcttgcatgttgtcgtcgccggcgctagccacgagatgaaaaggcgatcgagcgagacgacggagatggaacgcgaggagaagggaagggaaggcgcgacattccacctgcagagagggtttgacgggccgcgggcggacggaccgagctagtgcggcaagctaggcgaccgggatgtcgtgggcagcctctcagatcgcgcgcgacttctctacgtccatgcgaccatgggagcgagatcgatcgtctgctagcctggttttgagagttcggtggccctgcacgaaactaaatttaaagatacgaacccttaattttacatctaaataatactccctcttaccttgtatataggggattatgctctctcagcttgtctagaaatataaaggattttttttatcccgagacaatataagtacaacaacaatcagaaattgagtacttccatccgtttacatcaggaaaaaaatatatagagagaaaaggtacatgtagtactactaatcaaaacaggaaactattttaatccctcgagaggatatccactcgttatttgcatgtcattcaaatgattacaaaaaaaaatttaaaaaaaattaagaagatgtattaacatatgatatatcactccacgaacatgcaagttcaaatttaatttctacatctcgtaacgaaaaaaacaaatttgactgtgaatatacattaactagttgtagtttaatttgttttttttcgttgcgagatatagaagttgaatttgaacttgcatatttgtgcagtgatatttcatatgttaatacatcttctcaaaattttttcataaccatttgagtgacatgcaagtaacgaggggacatcccctcgagggatcaaaatccactccctctgcaaactgcatctcccaatctgccaaacatatctagttttatttctaaactagctggatggcccgcgcaattgcgtagctagcacccatataaaattatattttttttaatatgattttacttaaaatttatcaaatatttatctcgttatcttaagaatttgaaagaccaaaccttatcatcatcctcgtgtttctaattttatagttttaaaagtcacaccagttgctatcccttacttctgtcatattcttctttatttgcttgctcgatttaccactatttctattcatttttcttggaactttaaaaaatggatcttatagtttttagaatttattgtcccgttgggttttgtttttataatttctataagtcctgtcaaacactgccattgtacttctctacggccgtccactgcctcttctatttatcatcattggtattttaataattaaacataattattgtttaatttcattttttactttctagaagttccgccaaaacgtcagcgactttgtcactgtactcctctacggctcgtccgctgcctcccttctttattgtcctcgagattttcaaaccaaacatgattattattgggttttttactttttagaagcccaagcctttaaaaaatggaccttatagtttttacagttttattgtcttgttggtttcatttttttataaattctaaaaatcctgtcaaatgctgccactatactcatatacaacccgtccgccgcctactctttattatcattgggattctaaaaattgaacataactatcattggaatttattttttttttactttctagaagtcccaccaaccatcagcggctctgccgctgtactcctgtacgacccgcccgctgcctctcatataaatatttacgatgcatctacgaattgagtgtctagtttttatgtagaaatcaagtgccaatcctctacttaggtaaggatgcacaggcctgcagtcacaacaactgtacagtaaggccctgtttagatcccacacaaaaattttacatccagtcacatcaaatgtttgaacatttgtatgaagtattaaatataggctaaaaaataactaattgtacagattgcgactaatttgcgagatgaatcttttgagcctaattgctccatgatttaacaacgtggtgctacagtaaacatttgctaattacggattaattcagcttaataaatttttttgaccgggaattcagcttaataaatttgtcttgtggtttactgacggattctctaattagtttttttattagtggccaaacacctcatgcgataccctatataatattcgatgtgacacgccaaaactttacacccctgaatctaaacaccccctaatctgcatacaactgagataacaagtctatatgcaaccacataggatgagaataaacaatagatagtacaaataggttcgtttaaaatttgtgtttcaatttatatttgacctcaaaatacgaagttaacctctctctttttttttcaccagatagcactagaaattatgcatgcactacatataaggccctgtttgacataggtccaacttccaacttcaacttatctgaagctggagctgtgccaaaaacagtccagactctctgtttttgggagtgaagttagcatagctactcctaaaaaataaaatgcgggggtggagcagggtttttctgctccacagctccactccaccccaccctacctcaaaagacccactaccctttaactttttaacatatttacacaaaaatgacacttaactactctaaactcacccttctctctccctctccctcccctactcacctctgtcatggctagcgcacaagcggcttgtggggggacggcgcgcgcggggggcgggaggggggggggtgcacgtacggcacgtgaggccggcggcgggcgacagcgcacggtcaacggcggccagcggcgcacgagctgtcagggtttggggattttttttcttttttttaaaatttcagatctagagttaaaatgctagccaaacacttttcatcttgttttcaactcccactagagtgggagtttagagctaggagttggagtttagagccctaccaaacggggcataaggatgtttcattgttttctaccttcaaatttgatttcaaccaaatttctttaaaccctaccgctttattcctactacctaaccctgcagtaagtctggttgccatggttaccactggtagagaattgaaacccttctcaaagcacccggccctagagagagaaatttcctttagaacgcaactcttccactgttgctttgttttttgctgtgatccaaacagggcctctccactgttttactgactggtggagaaatcatctttggtcggtcggccaaattccacaatagtcccggttctaataaaaaccaggactaaaaagctttagtccctgtttaacaagttgagggg

SEQ ID NO: 65017 - DNA, 8503 bp, Oryza sativa
accgggagtaaagagtaccccgaaccgcgcgctactcagttattatccgcgcactcctctcgatctcctcccctctcattactccttctccatcccttcctctcccctttgccctcccgttcctccccttcccctctttgagtggcggccgagcgggagcagcggcgcccggcgggagctgcggcggccggccgtctgggtgcatcaggcgggcgggcgggcgtggcgcgggctggcgcggcgggcgggcgggcgggcaggcgtggcgcttgggcgggctggcgcggcggccggccggccgagctcgtgcggaggccgcaaggatggtggccgggaggccggcggcgccctcctctctgctgccgattttttttgaatttttgattcattggatttgatttgtgatgtatgtgatattggatctgatctgggagttgtgatgtatttcttttaggatttgtgatgtattttttgtttgagattttgtgatgtgatgtattgtgatctgtgatgcatttctttctaatatgtaatatatttctttccagatttgtgatggtactttgatttggggatgatttgggaatatgatcggggatatttagggagcagatcgatttgagaaaaaaaaataaccgggactgctcctaccatctttagtcccggttggtggattttagtcccagttattttacccgggactaaagacgggtatctttagtcccggattcgtagtcccggttgtataaccgggactatagggggttcccaaccaggagtaaagcccctttctccaccagtgtaactaccaccggagaaacaactacttcggagtacttcctagcatgcatgcatgtttgcagcaggtcagcaatgctcttcagctgagtagtccttttatgtcacgttcctgtacaccatgatcgctagcgctatatatatgaatctgctagctttgctgtcccattcccatatactcatatttgccacatttaacacgaaacagtatgtgtgaatcttgtgacatctataaaaaccatacagaactgagggagagaacaatatacacaaattttgacaatttgaccctttgcaaaaactatttttactaccaaaatttattttaaatctgatcattttgctcaacgccaaatcatgtggcgctaaacttagacacctcagtgccacgtcagctggcgttgaatgccatgccacgacggatgggagactaagtcagcgtgtcaatgtacattcagcgccatgctattggcgctgaggtgtctaagttcagcgccacacgatttggcgttaagcaaaatgatcagatttgaaataagttttggcagcggttcatttgtaaaaatagtttttgcaaagagtcaaattgtcaaaatttgtgaacaatatacatgtacagcaaacaacacccgaaaactagagatttcaactggatcaacccatcgggattaaattacatgcagtaagatcagaaaatattaattgctaatactattcaccaacaaaagcttcatattcatacgacatgcacggtagactgcaggtagagtaaatctactgcagtgtttaagctgcatcacctagcatacaatcaaggtggatcccttgcaatgaacagagagcgagctctcccaatgctaatgcatacataaaaagggatcgatcgatcgatacacatacgtacgtacagtagaatgcaagatatattagaaccctagctagattgattaattattatctaaaaaaaaaagctagattgattaattgatcgacaagactggcaacacatatatatatatatatatgggccacttaactagtacagcaatgatacggattggagagataactaattaatctatagttacatgacaacaatgtagacggcgccctgctggagcggctcgacggtgacgcccgactcgtcgacgggcacaggctccgtgcggctgcctcctctgtagcggagcagctcggcctcgtcgccgtagtgcctcacgttgaagtgcgcggccgggtagaagagcggcggcgcggcgcccgcgacgctgacgcacacaaccgcggccacggaactgcccgcctcgggcgcggcggcggcggcggcggctccggcgccggagcaggcgccggcgacgagcccgaaatccgcgagacctgcaattggatcggtcgtggcagacacacatgcacagtcaaacaaacggcaaagctagtgatagtgatattaactgcacacgcatgcaatgcagaggaagaagttactgcggcgcggggattgagagagaaatcatcaaagaccacgaggaaatccaaggtgttgaactgtgacagtcactgagattgatcagagtttactcctactagtaccactcgatcgatgagatgataaaacttgaatgaaaagcgtcctggatcgttggccatgcatggcgcacggtgactctaggtagaaacgcccctgtaatgtgaaagaactttaagcttctttcatgcgtcgagcaggagaaatttgaccaccatcacctcagtcttttcaccaacgtacgtgtgtgctgctaccatactgtacgcgtgtagtactcccagttcccttctcctagctactcctaccatactgtacgcgtgtagaactactctcttgagagaaagaagccaccatttgacaagaccatacagcaagagtgttagagtggcacaatttatgagttgtgacctgtggccaaaaagccctaaattcgtagcggttactgctgttcatctaagggggtgtttgggagaaaggggctaaacttagcccttctctcaaaaagagacttatggttttaagagaggggcttctcccaaacaccccctaaaatgggtctcttttttttatccctcacctcctttaatctgtcaggtcaaaatcagttttcaagcctaaatctgtcagtgtaatctggttactagtactagtactcccagattaattattggatactgatagactagtgcatgtgttcgtgcaatgacaaatctaccagaataattttccccagagagatgatcaaaactactgcagttagcactatccgagcttccaaagtccagttttagaatcttatatggaatcttatgcttctattcctccaactcgagtcttttcatgaacatgtgaaatagccccatgcatgcccagatggattccattacggagtacttcctccatcccaaaaaaaaggcaaatcctagatttccgtgtctaactttaactgtccgttttatataaaaattttttataattcatatttttatttttgttagatgataaaatatgattaatattttatgcgtgacttgtctttttaatttttttcatatttttttttaaatacgacggacggtcaaacgttgcacatgcaaaccagggtttgtcttttttttggatggagggagcatgtgggagctgaatgcatctacatgcgatgacatgatgttccccatcaccatgaaatagcagtagtactagtagttcgcatatttgtaacatcccatcaagaaacctactcaatttgacctgatggagaacagctcacaaattttggtcttgtctaaatctacatgcttacaaaatgacaaatttcttcatctttactggaaagtctatctgcattgaagtgataagattgtacagacacacaaaagaaaaggattttacatggcctaaacttgtcttattatcattgccatgcctgggcacagggcccttgtttgagaacggctggtttggattgggccctaaaggaaactagtacagtacaatttcatgcatatacaattcttctttcagtaaaaaatttgtcattttgtagttaaatccaaacgaaactgaaattgaggacaacactacaagagaagttagactcccctgaagtgacacttctaattaatccatttaaacatgagcgtatgaatatgatgcatgcatgtgatactgaacaaaggggaaaaaatgccaacagataatctagctaaatggtggtgattcatgatttgaccagttaattaaattcttcatatcaaagaacaaaaagagtaccttgaaactgattgttagcgacggcgccagcagatatagcacttgcagcaaaatcagtcaggctagcggtggcggccacgctcgcgacggtgacggcggcgttcggcggcgacggcgaggacggaacaggaggcagaacgccagcagccgaggaggtaacgtccacgtgcacttgcggcgtggtgatgccaaagccgtactgtagcagaccgtgcttcgtggcgtcgacgtcgtgcgcctcctccggcctagacacggtggcgatcgacgccgcgctgctcttgccgaggccgagctgatcggcggagccgcaccagtgctggccgagcccggcgctccaggcgcagctcttgtggccggtgttgtttggcgcttgcacgtcgttgcagagcccccagaacatgcccgccgcgcccggcgacgacggtggctgcggagcgggcaccggcaggtgcatgtactggccgccaagaatggcggcgccgaggtcgacggccgacaggcaggggctctgcggccactgcaggaagaccggctcgtcgtgtggcacgatgccgtgcatcttgggagcaggcgccggcggcgactccagtggctggccttgatagagcatctgctggtggcacgccgcggcgagcggcgagagcaggtccatggccgtcgtcacggacatcgcctgcgtcgacgtagccctcgcaggcttgctggacccggacgaacggtcggaggaggaagacgacgacgaggtaggcgccgccacaggcgagacaagctgctgctgcggctgcaccggctggggcgccgggaggattggtggcggcggcgtgaacgacggcgccacggcctcccggtgcgccgccgccggcgcggaggcccggttgccgccgaggccgagccccgcgcggcctgtcccgccggagcgcagcttgttcttggagcgggacttgcggttctggaaccagtagaagacgttggcgtcgccgacctggccgtactcctgcagctgcatgcggatgcgcgggatctcgtcgcgcggcgggttgaccatgccggagttgaagatcgcctccaggatccggatctgctccggccgcgggttccaccgcggcttcgggtccggaaccctctcctcgcccactgcaagtacaaccacgaaatcccatatcaattccctcccgatcgatctcgatcccctgtaacctcgcaacacgaaaaccctacctaccatagtacaaagcgcgaacagtagcatgcacggatgcgcgcggcgagatcgatcgacctacctgacgagaagggcgacgacttgagggagtagccgccgccgccggcgctgccggcggaggagccggagaggagggagggcggcgacccggccatgtcaggctgcgtctgccacggctgcgtggcgtgcttcgacctgaacatgctcggccagtgcctgttcgacgacgccatgcccgcaaacctgccgatcgatcgattcaacccgatgaactctcagctcccctctgcaacaacacaagcctaattatactagcagctcgcgctcgtcgatgagagaaagatctatagctagccacagatgattctccttgaggcgacagggaccggccggattggacgagagagctaggagtagacgagctaggagtgttcctcttatctccctagctaggataggtggatggatggatggaatggtttcttgcacattgctgcctcttataatggcgagcacctacccttggtggtgcaaagtgtcgccgcccaataaatgccgactacttctacggagtagcgaccatctctttatctgcttggagatgcgtgcgagggagatgatgcagttgcaccgggagggaagcgatggggtggttgccttggccgtgtcgctgatgccggaagggtgcaaaggacactggagctgagcttcagtttcagcttcggctactaccctgcttggaagactgaacaaagtctgggccttccttccagcatttctgccatactacctcctgctggtaatggtgggtaatgcctttttgcatgagaggactcctgggacggtggtgatggtgacctagctagcttgggatgacatgtgtgtcgtcgccggttagcagcgtactttctgatcgatcgagtcatttccagaaacgaaagaatggaaattgcagttactgtgctaatcgtgcacggcaaatttacagggaaactgttcgtttcctccaaatacccactatgaaattcatccgtttcaaaggagctaggctcttcttttaaaaattgcaccaagaaggccctgttggtctagtagtatgtattgatcattggatgcatctctcattaaatctgcttcggattacaatttggaacgcaggattttacataaaggccgagtttagttccaaacttttttttaaacttgcaacttttccatcacatcaaactttcctacacacacaaacttccaacttttccgtcacatcgttccaatttcaaccaaacttccatttttagcatgaactaaacacacacccaaaaatcacatgcgcgaagaattagtttatattctatgaaatccctgcattaattataaaggagagaccttaaaatatgcttcaaatttaaaatttcaaaaaccgcttcaaattatgagcaggctctagtcatctcctaaaaacattgcacactttgcgcatggatgcctcaaataaacatgaagttagttggtggcgtgtcgagggcgcccgtttcttccaacattgtgggcttgcatgtgcctcttcacgtcaagaaaatgtgtacaaagtcacaaaaagaattttccatttggagatattcttttagtaacgaaaatgcatggtttatatttatggtctacagttggattttgtaactctaatgagacaatacaacacctatttttcgattgtactatggtctggtttatatagagtgcaattagcttcacctttggattccgtcaactttgtagtatatcgcatatgtttggaagttggttgaatggggttaaccgtaaagtaaaaaaaaatattgtttgttggcattgctgctatgttggtcggtttggctaagcagaaatgacttggcctttaatagttacatgctaattcttttgtgcaggcaattcttagggggcacacatcaaacgagactttggtcgatgttgcttaagaagagttcagagttctatttttcttatcgttggaactttataaggagaattaaagcgtaactttggttgtcctcttccttgctttttgtgcttttggtggtgtaatttcatcccatgtttcggaaggagtctatgtactcgtgttaggactttttggttgtgtaggttttttttatgtagaggccgggttgtttaatccattatccaacaacaaatggtctacagttggatagcaaaagttatatcttgttcacattgaaaagtcaaagacatacaccaagtacctccatatttaaatatatggtattgctaattttattgggtatttagtgatgacttttgactaataattttcaattagcgtagaaggacaaaatcattaatattccaaaagtatataaaggaaaatctacccataagttttttatatatgttcttagctaaattttttgtgctacctattgatggtgatagtttcacatttttaaccaattaaagttaataatatgatagtcctatatttaaacacaaggggagcactagttattactatccatttctactctagtaaagacaacatctttaaagccggtgtcgatatatctcttggttctaattgagctagtagttgttactgtatatgccactcacgaagtcacgagcggggtttacaaaaaccgtgcagttgtcacgcggttatcatgtatggtaaccttctcaaaaccacggcataccctgtgcacggtaaccacagtaagcgtcaaaccgtggggtggcggtaaccccatcctaaacggtttggtaaaccctgctcacgactcaatcaattagccaattgttagtactacgaatgttcagattcatagtttaaaagacactcttaatttagggacgaagctagtatagctcttactagtatatactactccctccgggttgataatacttgtcattttggacaagggtacggtctccaaaaaaacaactttgaccattatttttcattatattatgtataaaattgttaacaaatatatgatcatattaaagtactttttaagactaatctatatatgtagtcaccatatttaaaagacaaatattttaaaaatgatttataatcaaagattgtaaagtttgactttatccttgtctaaaacgataagtattattagccggagggagtactattatgcaatttt

SEQ ID NO: 65018 - DNA, 8129 bp, Oryza sativa
  unsure (1)..(8129): unsure at all n locations
gtgcacctgcgttggttggttgcagaagcgcggggggctgttcgtacgtgcgcgcgtgtgcatgctgcatggagtgcaggcctgcgcaggcagccccgtgtgtgtctcctcgtgggggttcggctggctctgcaagcccacctgcctacacaaacaccaacatgcattgatgcgtgggagtatacaggggggagagtgtgtgtactgtgcatgtgggtgtggtactcgtgcgcagcagaaagtgcggaagggaaatcccgtcgtcgtcgtcgacgcccgtgtgggtgtgtggcagatgtgagagagaaaccatttttttctcgacgggcgagacagagcagagcagagagaccaccacaggactgggagaccagaccaccgcaggactggagtgaatacgaccgagaaaaaagagggcggggcgtgtttacctgtttacccgttctctgctctcgccctggcctccagctccctccaatcggcaatcgctagggcgtttggtttgacaggatcttttttttttctttctaagaaacttattttataaataaaccctcgaaaaacttatcaaaggaatggattctcgtggcgctagcaacaatcagcattatttgcaccgcgctccaatataacggcgtcaatgatattggcatcattcctctcgccccctcgtgaaagctaaatcactcatgtaaatagattggtgccaattacgctaacatcgagagtctatatgtaaaaaaagttgaaaatggatatttttttcataacaaactatttagaaataggtccttagcgcttaggacctatttgtaagaaaaaatattttagtttttttagattcttttttataaataggttctcggttttagtgtcattagcgtcaatcaaaatatattcaagttaatttaataaaattaatttagtgttgtagatgttactaattttttctatgaacttggacaaacctaaagaattttgactaacaaatagtcaaacgactttacaaataaaatggagggagtagcttctttaccctaagattttctcctctccttttccccctaaaactttgcctaaggttttatcataaagttgttagccattcccggatttggctagatctagcaagaacatgtgccaaagttagaaaatgaaccaaacatgttctaaccacgtttcccttttttcagaccttgttcggttatcctcaagaggaagggattgagcaggattaattttataccgcaattggtatgaaataaattcttttcaattctctcttaattttcacgagggatattaactgaacgatgactaaatgagtcgatctcattcaggccgtctttagttccacgctaaaattggaagtttggctaaaattgaaagtttgaagaaaaaaagttaaaagcttatgtgtgtagaaaagttttgatgtgatggaaaagttgaaattttgaagaaaaagttgagaactaaacaagacctcggcttatttccctaccatgggacaatcgaaggaacaaacaggatcgtgattcatgagtagccgcgtgcgcctacaagagaccctttcagataaacgagccaatagccggattttataaattaacatacgagaaaacggccctttcaaacacaatagttaatcaatttgaatcacatatagaatttgttcaatataccatttgaataaaagattgcgcgtctatggaatacatgaatccatgagagtttggacggaatctaacatgagatctaaccttatatgaaattcccttttcaagtattcgtttactactttccttgacgggagtaagcctaattataagttactatttaacatccgacagaaattttgggagcaaatctgtcaaattttgagccatatagtatgggctttaaaatccatgcacgctggatgtgataaaaatcaaaacaaattacgtgcggtgagtgtcgaaccagtcacaagtagcttccgcgtgcacacgtcccccactaagtggcacaattttttcaacctacgtaccactcatattctacttaaatacataattatatgctacttacattataatttaactatataaataatcatgtcgtagtcatatttaaaagaatttttggggatttttttaatgatagatagaccctaataataaagccaataattggctctatcttgtgtatatcatctataacaaacttttaaaacacagacacatcatttaagcgagctaacgaaaaatagaaagttgaagtttggagttaaataacgtagccttatttccataaagtttgttttaatttgtgctataacgacatacaaatatgcagttagttttgcttctctcttttttcttcttcaaacttaacacaaataatctggttggtaactcttatatcctgcggcatcaccttattgcattcgcttctattaaaacatttgtttaaagatacggagacccagtaatactcctatttactttagtactacctctgtcacataatagatgtcgctttaactttttactagcaacgtttgaccattcgtcttatgtgaaaaattagtgcaaatataaaaaacgataagtcatccttaaagtacttttgataattaagcaagtcacaaataaaataaataataatttcctaatactttgaataagacgaatgatcaaacgttattaaaaaactcaaagcgacaaatattttaagacagagatagtaaattactactccatgttgtggtgataatttagtgggtacgcagatctgaatcttgtccgatgaagttatctacgatttcaccgttacatagtatatggtgtttccccgtgagctgcaccgcactgcattgttttaaaatggcgttcccacacttaagttcgtcgcgtgaatgatcgtgtgaacgtgtttgtttgtgtcccctttgatcgatccgcggcacggaaaactttgatttggcacgtagcggtacttaaaactgaggttgatttccggtctttaattggtgatcctgaccgattgatgaatagtttttgttcgattttattaaacaaaccacagcaggcagcctcaacttctgaccgatcggcactttgatattggtcacagttctggatggatgttccccgaaccatacaggcatacagccataagcgtgcccatccgtggcgagcaaaagtgttgatgggctcatggctcgatgaaatcttcggcccgtagtccataaatgggtttcagaattcgcaagtgttctccctctcggcatcttcggcccagagtccataagtagttcaggtccttttaatttatcgctgagtctaacattcatccctgaacagaaataataggtatggcacattccctaactcacatgtcacagccattttagtctcttggcagtatagtgaccggttttagctgacgtgtcgaagggaacgcatgtgttcccacatgtcaatgcccaactgttcttcctcctctccccacctctcttcctcactcttcccaccttcttttgcaaggcggtgcacaacaggtggtgtgtagagggcgcgcggacaatgaggagtgaggcggcggctgccggcgggaggccggacgaaggaggagcagcaagagagcggatgagaccaagaggagcgagggggggttgaggatgccgacagaggagtggaggtcgccaacatcttcaaggttgtttccctcgccgatgagccaccatttgttctcggtgaagatttgcaacaggatccccacgcacttctccgtctgccggaacctcgcgcgtgctcctgcttactagcatcactgccacatcgccctggaaacagcctcttcctcttcccaaccttgccccaccccatcattccattcgccaatcacgccagtgttgtcaaactcgagcttgatggtttcgtccactcgtggccgccatcttatcgcttcccccacggtcactgctattgaggtccatcaaggtaggaggttgaagaggatggcgccctgccctagcggtcaccgccaccactgccgacctgtgcggttgccttgctccaactgctcctcctccacccgacccccaccgctccttctttcccctctcagtatccttcgctcctccctcattcttctcagcctcatccgctctctcgccgctcctcctaagcccggcctcctgcttgtcaccgctcctctccgcgcctcccactgcgctctccatgctgcccaatgcgcatcgccctaaagatgggaagagtgtcagagtgaggaagcgaggtgggagacaggggcggagctagagcgaaatggatggtggtgccacttgcttaatttactctactttatatcgagtttaaactgatgcgggtacctaagtttgtattgagggggtgcatacattgagaaaataatgaagtatagctaaaatttttttttgaccgggttcctaaggcacccccctaatatatactagctccgcccctggtgggagaggagggagaagatgtggccgatgacatgtaggtcccacttaccacgttagtgaaaacagtccactatactaccgatgaactaaagttatattgtgagttgggggatgggcaatacccggtatttctatccagggacgaatttcagactcagtgacaactgaagggatctaaagtgaacttattgcttttgtgatggtttcagcccatcggtagcggcttcggttgagagacacggacgcagtaaccggcaagcacctcgctgaggcccagctcgctttccacaattactcgtacatcgacatcggtactccttgggaagagcagctacatgtcgaacccgttgttttatggacttgggagtgatgcctgatgcggcgtttgctcaaccttgtggaggatttacgtgatcctcttttcctcagaggctcagacgtcagtgttcacgctgttacgtacgcccgcggtcgtcacgaccgcagcgagcgcagccatctccccccctcaaaaatattcagaaatgtgtgcaccgatagacacaccggacccttgctcgtcattcgcttgcgaactgaaaaccaaacgaccggtccgggtgacacatgcgttttgccccggtcagcaagacgaaaccaagacccggacaacgccaccaaaaccgtctcacgtcaaaatcgccaccggctcacggctcgcccgctctcgttctccaccttatcacccaacccgtcgtgccaatccacacacacacatcgttgcagcctcgcaccgcccgataataatacgaccaaaccaaagacagagcagcgcgacgcggggggcaacaacccgcagctaaccgcggcgacctcgtccgcaccgcgccacgcgaccacactccacacgcctttcttttcctttttcccccaaaaatccaaagcaacctcgcccgaaaagaagagagaacgcgccgcgccgcgccgagccgcgtgggtataattgaagggaagcggtgcgctcgctcgctgcatccagctcaacgcgcgggggaggcggagcgaatcggcggatcggtgggttgcgggcttgcacgtagtcgaggctcgagaggagggggggatggcggcggcggcggcggcggcggggtacagggcggaggaggagtacgactacctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccattactttgctctgcttccatcgtctccaatctcatctgtagcttggctatattcaccatcttcccctgcttctgctctctcgatttcgctacttgtagattgattggtgaccatcatccctgcttctgttctctcgttttcgctactagtagattgattggtgatttctagtagcacaactccattttcaatcaacgactccatttagtccatcattggtagaacgattcatgtgctccagtgagcaaaatcacacgcatggcttctcttgcgcatttccacaaaaacctttacgtgttcaactcgctatgcttcacttttgcgcaatggattggattggatatccctttgatatttggattgacctcgttggcttccccccccccccccaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcagatctaccgcgtcgtcagccggaacgcgctcgacatcggcgacgaccccgccgcgccgccccgggggcggaccatcgacgtcagcgccaaggatgacgccgtcacccccgtgaacagctcagggtgctgctcgtcttgactttgactcgctcaaactcatcgtcgtcgagctatgcaaattgccaccgttcacagctttgtttataccgtgtgttttcgtcactgctgattgatactacaaacttgagaattgggatcaaaaggttgcattttgaagacgtgtatttgttgatcagagatagcgacatgcattttgggaccggagagaaatgagagactaattcaagctcgacagataatttgcccaaattttgatataagccgtggcgtttcgagaaatgccacccagatagacgtgcgacggatgataatttgtgacgaacgatgcataaacaatcaaaagacgaatcaaggcaatcaaatggacgtgcgacagataatttggggcgaacaatgcataaacaaacaaaaggcgaatcgatgcaatcacgctccgacgaccataagaatctttttggtcctcccgagttacggaattaggagaaaacaaaatgtacagaagagcacatgttctgttctgatttttaatctgatggtagatacaatgtttgcctagaaatgacattgtgagtttttttgtcggtccgccttatgatacagatgggggcgaactgagtaatttaaaatattctacaccgaagaaaatgatcaatgttatggctgtacagtttaggaagctgagttactcccggatcacaacaaagtgagcaacaaatacaggtagcagaatggtctaccgtttcttatatacaaaattgagctgaatatttgtcggaagtaaataactaataagattattcctgttcgttatccacttcttcttccggttgacaaagctgtcgtcttgcagatggggcataaattctttaccatcaaccattgttttatgcaatcttcgtggtacctgtggccacagtcaagggttccaatgcattctttaacctgatactcttcctgcaataccaagaaaagatttttagaacaaggatatgtcgatttgactagactaaatgttggtggatgagaaaactacataatctgataatgcagataaggaaccagtgcaatagtatttgtttttctaagcccaattggaacttatggcttgttttagcaacccacacttgtccctcttaacacccattcaaattccttaagcgcctgacaagaaatcatgaatgatatttaccaagacgtactctcaagtaactttatacaatttgagcaccgtggacctgtccacctttgcaaatactaatttacactgcacatacttagaaatcatagtacatcttacataaaccaattctcttgtaagttttcccacctgttggaaccatactttatgggtgataaaatggaacgttgcatattactatgatataacactagccaattccacacnnnnnnnnnnnnnnnnnnnnnnnnnnnnnnnnnnnnnnnnnnnnnnnnnnnnnnnnnnnnnnnnnnnnnnnnnn

SEQ ID NO: 65019 - DNA, 13362 bp, Oryza sativa
taatctaccatggtgtgtgaaatgcaataacagcagtaaggtatgaaactattttacaatttaataagacatgacatacactactagatcattagtgctggctacaaagggtatcacaggtggttgactaattcagaaagttaagaattttatcataaggatgtgtcatgctatcaataacatgcttcaattttgttatatatttgtcgacaaattttatcctaaaaatttgacagatgtaattacagtacaatcatagtgtaattacactgtaacttgcatgtaatttcactgcaacttacatgtatgtaacttgtatgtaactttcacatgatcttgaaccgttagatttgttttaagatttgtgcaagtgaggaaggaaaaaggtcacagcacacacacatgtgagaggattcattcccacgacctccgtttcaccgaaatagcatgttacatagagatttttgaaagacattttagttacatgcaagttacagtgtaattacatcacgatagtactataattacatttttcaaatttttaaaagaaaatttgtcgataaatgcgtaggtgatcccaacatgcttagcctgaattttcagctaccatattatggtgtgtttggtttgaagattggttccatccgtcatggtctactggtcttacataccaaggacagctgctgcctgatatattttgatgaataagtcagtcctggtgattggtttgtggggaatctaggcagaagtggctttggtgatggatgacacggacttgtgacgcagaccatacaattcgtattcggttatttagattaaacacaaatcaaacacactgttggttagagaatctggacaatctaagcaaggcttcaggtaagctcctacaagacctaaagcctcagtacagaggagatcaggagaagcttttattgtacttcctccgtttcacaatgtaagtcattctagcatttcccacattcatattgatgttaatgaatctagacatataaacggaggaagtagtaaacacagcaatagcttatcccagttcccaactagactgattctttttagcactgcacgagatttcaggaaataaacttttgttctgtatgcactatgcagttacttcagaagtcttgcgcatatttgtatgctgctacttctggagttttaatataatagtaagcctttgtacgcagttatttcaggtgtcctggcattatattatctacctaatgagcattaatagtcaaaactgtgttcattgcatcatatcttacaacaataactttctacagagcagaataaccaagaatgctctacagaaatgatctcctcaccaactgatagttcgagatgcattttaatggttctggtgcaagcaataacaaagagaacttagggaatgatccatgtaagcattccatattacagatcttccaaaaaatacacaagctatttatggacagacaggtgatggacctcactcgaacaaaataaaacacacttagatttagaaagtaccagccaaggctgtatattgcacataatttcagtttggtctaagtgatatgtatggattccaacaaaagcaagattacaaacgagaattaaacataaaggtatcaagcaaaaggcgatgagatataggcagaagaagttaacctgcagaaagccaggccataagtagcagctctcagtaacgcatgttggcgtgaaatatcaaactcatggccagcagcatctatacatgcttcaattgcctcaggcaaggaagaagaaatcaactgataattatcgtatgcctgcaagtgtgaattattgttaatgccacgtgtttgattttcagcaaaaaaaaaaaggtcatttgtgagatgtcaaaagagcaaattcccaaataagtttttttttacagcatatgaaatagcaaacaaccctgatataattcacaagttgcatactatgaatgccataaagtgcactaagctaacaccaagtccatgacaaatgtagaaggcaaacatgcactgcacaagacataggtatctacataagaaaaggaattaaacagtaccttggcactttgtttgtcataatgatctctagcatcatacagcaatgctgctggggacatgcttccaatgccaaaaattgatgtagtggaatcagggactcggtgtaggaattccatatttgagtttgagaggattcttacaccatcacactctggaatgagctttatgggttcatcgtaattatacagcaccggatctccatttggaccaaccatcaaaagagctgctgaccagtaaagaagcacgctgtccaatccacaccaagctatttgatctggtggcaatgcggactacaagattaaaaacaaataatgagtagctgtgcaaaagtgtacttatactatcagtaaaccatactaccgcaaaataaacacaaaaaaaagagcatatataacctagaattgctttgtttgcatgctatggcatctgcccatgattgtttaaagacctaggatcaacaataaatttaaaagaattatcacaactgctgcacaggttgcagttctcgttgaaaataaacagtgataacaataagattacaccaagaatgataaaaaaataatatgattgttaactcggtgagcgttgcatgtttgttgaacatatatgcatctttgattaaccagaacaggtaaggggggaaaactactactaccctaatgtatttgaggtgctatgttatcagacacaaaacagcaatgtaaactaggaaacaaattagcatattcaccgccacttcctcaaagtagtattaacctcattagatccattcagtatttcagttagctgtagtttgaatcaatctacatcgactgctgcacgcctagaacgaacagagtagacaacacaatgcattaaacaacttacatcacactcatactcgaagattatcttggagaaatccgtagggatgacgagcaggcgcccatcgtgcgcaaatgcggcaagcagcttcccattgggggaaactgccatcttctgcacaggtccaatctccagctccaacccgagtgtctgcacatcatcctcatcaaccgccagcactcgatcaccaaccgcaagcagtacctctgggctcccggacatgacaaactgcggctccaccacagccatgcacagcacctgctcgtcctggccaacgcaagggtcggcgaactcacgcgggtgagggtccgcggcgtcgatgtccgtggtcaccacgacgcggttgtcctccgtgaggacagctacgccgcctccccagaaggcagcgtcggcaacgccgccggaggacgtggggagcaggggcacgggggtggggctagggttgggcttcagatcagggaggcggaagcggaggagggacccatcggagagcagcgcgacgaggttgagggagctggagaacgcgagcgagtggaggcgggggagctggggcggccacggggaggacgcgatggggtggccggaggaggagtagaggaggaggcggcgccgcgacggctccgagtggagctgcacgatcttcgagtcgtcccggacggcggcgatcgggcccccgaacggcgccgcggcgacgatgtgcgtggagaggtcgaggcggccgagcacgccaccgctccccccgccgccgccgccgccaccggaggtggaggacgaggacgcggcggcggcggaagggggcgaccagggcagcggggagtagacggtgatgcggcggtagaaccggtcggagaggaggtcccactccgccgcgacggagacggaggaggacatcgccggcggcgaggcggcggcggcgtcgcgcgcgagatgggctgtgaggaaggaggtggactgtctcggggatcgagacgggacggttagtcccctgacatgtgggtccaatcggatgggaacgagctccacacggtagcccattgaaaagcccagatgagacgacaatgagcagcccacggatgcggggtgcgggagaaagcggcccaaacaaactaaccacacaagcaaaattataggagtagaagtaaaattgctaagatcctcgatctgcaagttgcacgggctgctattatagactacctagtgggggattaccacgtgaagtttataattcattgggagttagatttaatgcgcaactctgaaattttatatgtctatatgtaacattatatgtagaagtatatttatatttcatatacaactcttaagttctatttctataagatctggatttcatatacaacccttatattctagtattactatatgcttagattttatatacaactcttgacttctatttctctagacataattgaaatttgtatacaactatatcaattaatctatacttttaatttggacacaccatgatctaatgttaagatttttttctttgattaatgttgggtgagacgcgctgatgatggtgaatacgaattttcgtggcaggccgcattgcgcctttcgtggcagactaaatacgaatgataatagggtcaggaaatgctgggcatctgatccgcattgcgcagattgcccagctattgaatcagcagaccacatcgttctacgctgcaagttggcatctgagatttggaagaaaatcaacctatttgatcaggccgcccatcgttctacgctgcaagttggtatctgagatttggaagaaaatcaacctatttgattaggccacccagagtgcagatatactccagttcgttgaggagggactgttggttacaccggcgcatctaaaacctggatggcctatttgcttcgctgcttgttcacacaatttatggaaagcacgcaatcaaaaaacattcaaccaaagagagtatacagcggctgccgtgatgcaccaaatcagagaatgtctgcaaatgtgggagaaccgcgtcatgccacaatgccggactctaatgcgcagttgggctgccttgctagcatagcagctatatctccctactctttttatgttcttctttatattgttttctttttcgtttctctcttctttctcccttctttcttcttccttcctatatctccctactctttttatgttcttctttatgttgtttcttttcagtttcttttcgatctttgtacttctgttgtaacaccttgactaccattaataaaatggttataaggtagagcctctctacctttttcagtcaaaaaaaaacatatcgccgatgtctgatgagatgtggtggttgcgatggcgagcatccgtgagcagagcggcggtggcaacgagaagaccaggcacacacgagttacttagggtgacaagaagagtaggcaaatagtagttcttaatgcggggacaatggtggagctagtcatggtggtgacaacccccatagttgaggaagagaggcaagatgagagggaatggacgaaggaagaagattgggagaaaaaaaataaggacaattatattgaatcatggacaatgtggcaagtgagaggatacccacctcaactttgtggcaaatttactaagccacttaactatgtgaaaaactaattaagtatgctccaacttttgaggcaaactacataattttccctttaatgttaggccatgtttttttggaagctcaagatgtgacgagcaaaccggtgagaatatggataatttgggtctaatatttttactagcattttattcacagtatatgaaaaaaaattgggttgtttggaggagccagggattcttgaaggagaatctcaatttctatttcaagctatttctgtttatgcatgtttttttaagatagttctgtttatgtatgttggctggatgacttagcagttctcatgtctaccctaccccatgatgcataatctcttttgacgtaccacctttcctatcgtatcaagcttttgacgcgggtagcaatcaatttttatcatgggataaagcaattgaaaaggggaatggaaacagtattctgattttgtagagcatctctagttttgggtccatatgcaagcaaaggggagaacaactttcatggatactatactcgcttcatccttcactttttccccattcatgcctaaactataattgactgatcaatcttaaagaagtttaatgaacgtacggtatcatgatacgaccttaattacagatggcatcacattgttttttaactgcaaagtatgtctgaactatctcttttgataagttagaactagaagcatgttatgcgacattgatatcaaaactagaggtagctaaccgtgatagtgttatgatatactcatatatgtgtgagtttagtttttttgcgaaatgtacaaataaaatattctcccgagaagacgtagtatatgtgtatatgaaccatatacatatgtagcctagtgattacagtgacctgagtagcaccccaaggtcctgagtttaaatctccatagaagcgaatttcagattgggttatttgaggctaagtttctatttgataggctaagttcctaatttaaaaaggccgcatatatccagttggatgtaaatgctggttaaaaaaaatacccttctctaaaaaaaataaaccatatactactcgcatcaacataattaaatcctgagtggtaattcaatcatttaggtttagtctgcaagtagtgttttatttacagccatcattgggcataagaatgcccttttattttccttcacttggagaaaattaagttgcggttgttttttaataatggattttcattaattcagcctcaatatccacaaaggatatacacaaataaaaggatataaaagcacttagactcataccttaacaaagaaaacatacaaccataaaaagaaaaccctacgacctcggcacatccctcctttccaacacctctcctgaaaccgtcatattaggcgagtggaaatcgtctagtcgccaccgcccatagtgcgtcgttgctacaaacctccgctggtgccattttcatccgcttcaaattaagcagcggttgttaccatatcaaattgtttgaagacatgcagatcaaaaggccaactggtgcaattacaaaaataaagaagaaatacaccagcaactaaaatgtctttatctcaacctattggacttgcaaagcaagcatcttggctacctgaagaattgatttttttttttgcttcacttcaattctggcagcatgtacagttacaacttccaagttcagtgaacttcactgaccatttgtcttagaatgtagatatattcagattgggctcacaaacatgaaatttcagcagcaaatccgaaagataaccgaggttctagcgagcatagttggtatgatcgttttgcaaagcaactgcaatttgcaaacagatttataaagagccctctaacaattgtctctggtgttatttgcctccctttttctttgtgtacagataaagctaaactgatcattcttcttttaaaacggatctgttgtcacttagtggaaaagatacacttaacattgcatgttgtgcttatactattatctaaaaaaagaaacactgaaatgacagagtttgtgcaggggtcaggaaagcacttttttgtaacaaacttttgtaatcattctcttgaaacttattaggtgcaacatacatgaaaattcaccagctcatccgatattctgatcactgaaacaaggataaaagaggacaagcatgttgcatgtcttcagattaacataaatgcagaatgcagtgcctatggaagcacatcaattggacagaaactgtgggggacctgtatgggcactagcatatacaattatacatgtcatcgcaaaatcagcatcacagtttaacaaaaaaaaaagaaatatttcgaagcatcttacaaatctctattattcataagataaaaactgctaatccacaatcctaatcagagggcactaatgggtctcagcagtttattctaatcctggacccaacatgaaccgatttccagtggcgatcattggtgaattgcggttgttggaaagcggatggcgagcatcattacgcttcaaatgaaatgcattttcatgatctagctatatagctagctaccgactcccttatattctaagaaagtaagttggtgatcaagctgcagcaaccgtccgtgtatcagacattcagactatcagtgcttgcaacagcttgttgggctgaactgtatcagttttctgcaacaacatgttggtctcaattgtcctagtttgtgtgtaccacaatgcaagattggaaaatacgttgcatatcgtattcttggagcgatatgttggtctcaaatccaactgtatgtaagttgtagtgttctctggtactaacaagattcagagttgtggcattagggctctgtatgtagtgctaactttttaaaaaatgttcaagctttttgggatttagtgttgctcactgctaaagtgaaagaaatgtgcagaccaagatcaaatgctctgcctacacatctgcataacttgtgaaatgagcttttaccattgacttgtgaaaaagccagttttatcactgcatgcagagatgaaatggaacatacaaacaatataggactcattatcttaggtgtgtttagttcacgccaaaattgaaagtttggttgaaattggaatgatgtgatggaaaagttggaagtttgtgtgtgtaggaaagttttgatgtgatggaaaagctggaagtttgtgtgtgtaggaaagttttgatgtgatgaaaaagttggaagttttaaaaaaaaagtttgaaactaaacaagggctaaagcatcatgggattgactgaactttacaccttacagaggagaagaaccatataatggtggcatggagaccaaaggctgcaatgcattgaactgctcaacctttttcactggtctttcactggccatgcatggatccatggacaaactgagcattagaccaggatctaatgagtgagactgctgccttccaaactcccaagtatacaactcatagcatgtatgccatttgggaggccggcgtttcagtatgcatgctttgcgagtatataattttgccagcgtgtgacgtttgagttggagatttgtacaacattatcttgtcaattatcggtagtctcccatgtctgattctgccttggctacttaacgttaggcaaagctgggagaaatgattgtatttgggagtataaaaatggccagtcattataagccttgtcgcctaattgctgttcttaagcactttatctagctctttctataaacccatcatagcaaactttaactttttttagagtaaaagcgcggcatagacagtttgatgtaaacattaactaacaacttaacgttatctctgatcttgtggattccttcattattcagaaagtaatggttctgaaaaaaaaaaaaaggaagtgcaaatctttcactcgcggaattgcaggcaccagcatacaccaactaatttcacactccatccgcaattgatctgcctacgatgagtaaccgttacggacaatcagctcatttggtcacaaaacggttagttctgttaaggcatgattacatttacacgcatcactttttttgatgcatcactatcacatatgcacaccatcttgacatacatatataccgtcaccacttcacacagtaaaactccactcgtcataatactcactcgaccactgcagcgtcaagaaacgtaaccaatgatcatatggttttacaagtaaaaacattgagctccaaaaatgaacaactgcgagcgatagttagatgcaaaaatcctccaggaagagaagaacgaagttctcaaaaaagaaagaaagagaagaatgagacagtcagagtagggctcttgacatggactcgttaactgaacttccattagcaacgacttgctagtagctttgcggcttcatacgccatgcaaatctcccagccctatcaatcttttcatctttccctttgcagccaaaaatcacacggatcaaaatgaaagctactccgtagctagccaggaggtatcttggcaaaagccatacatggatttattgaagcatcaaacatgcagacagagagttggtgagaaggcaacaccaaatacattgtgaaatgtgttctatttatgtgaaagggcatgtagcggtgtagcctagtggttgcagtggcctgagtagcacacaaggttccgagtttaaattttcataggagtgaatttcagattgagttatttgagggctaagttccctatttgataggctaagttcctaattttttttaaaaaaactttatatatctggttggatatagaggctgggtaaaaataccattctctaaaaaaaaggtgttctatttcccattttatactgcttggggagtaaaaaagtgttccattaaatttgaaaagatgagttctatcatttctacaacgagatgatttacaatgatatttattgctatagaaatcacatctaaattgtagaaatccaatggatcgtatatatttatgatatcactccaattactagtagtagaatgttgaggtcacttttactagtgataatgttggtaatagaataccatgaaaaatgttaaaaagcgaatttctgctaccccagacacctggccggcactccagaaccaaacgtttgatgactctctgcttttgcgtttcagctggaagcacaacttcgcgcgtagctagcttagagcagcaaaccgttgctcaccgcaccgcaccgcaccgaaccaccacagcaaaagcctctctctctctctctctctttatttttttttaatacgcaagaagcgcatctttgtattaagaagaaataaatgtacgtacaaaacaggccaaaaagacgaagcaaggggatagagtacagaggagaaccaaaagactaatctccaactaaattttacgacccttctccactaacatgagctcctctctctctctctcaccttcccggcgcggccggcctaccacagccatcatcacgccatccacggagcggcaaaagctcggcgaaatgcgcccaaaagcgcctctcatttcatcagtatgatcaccacccccggttcccacacgcagcagcgcaaagtccacccccgtagtatatttgcaggagctttcgctgctgtgctcatatcaaaatctcccccacgggccacacgcggcgacaccggcacaccaactgagccctcgttgcttgatatagatcattagatcgttcccattggttggctacaaaggttgttcgccatcttcgtctctcctgggactggtagccaccgcattgtgaggagagatttcagaaggcgatttttggttctttagttcagagttcaggcaggtttctctttcatgttcttgggattctgtggcagtgagaatcttggcagagaggaagaaaggatgcctttgaggtagcatgaggtgaggtgagtgagtgaaggagaggggattcatacggatttgcagcctctcttctcctgccattgttcagtccgaggactgcattgtgtgtggttgcccttcttcagtttagcagttaatttcactgccaaggcttgatttgagggttcgtttttgaggaactcttggtgacttttatgttctaggagtggctgaattgactagcaaaatgtttgtatctgcaagaaagagactgttctttctgttcataagttctctacttctgtcgcttcttgcgccgtctgatggctcatcaaactccacagcgaatctcaatcaaagccacaacaagaccggacgtactttggaggtatcaatatttttcttgcatccaagatttctcaatcacattctaatttgtactagttctcaattatattcagggaataagtcttaagtgtttcttttaattgttttggtaaaaaatttgttagcttgctgattgcaacaattacgtttcttgcagatgacacccaaagtattatttcaactcaagatgcatgcattgttccactggtcttcttttggtttcttgatgcctgtagggataatactagccagaatgtcaagcaaatctaaaagcggcaggagcatcagagtccttttctattgccatgtcatttctcaggtctgcaccttctacaggacataacagctttgctttaaagtttaaaatgttcccttttcttgttattttatagaacaccagataatattgtgtctgattgagtgttgcagattgcagctgtccttcttgctaccggcggtgcggctctttcactaatgaactttgagaattcattcagtaacagtcaccagagagtaggattagcattgtatggattcatgtggctccagccgcttatcggtttcttcagaccagaaaggtagaagaaaactactttctcatgattcttacaaagttttgtctctaggatttatcctttttgtgtttctgcagaggtgttaaggtaaggagcttgtggtacttcctccactggcttcttggcatcgcaatttgcgcaactggcattacaaatgtctacattggccttcacacataccatgagagaaccacaaagagtgtgaagctttggaccggcctccttactttcgagctctccttactgcttttcttctacctcttgatagacagatggagctacatgatgaagcaaggaaatgcccctatcgagcagctaagacctaccgacaatcgcaaaacctatccgacaactcttcggaaggaattgggtatggtgcaagagtgagatgcccaaatgaaaagacaacttaggagggcaggtgctgtaaagtttgctgagaaagatggtaatgctgctcaatggtttggtaatttgttggtttgagaggtgtgccttgaacactgtacagttctatactttattgagattgaagaggattatggagccctctggtgctgtatcttgtgctgtgcatttaagattttgttacaaaccaccgtttgtactgtttgtgaaaaagtacagatatgcaacatttatatttctcaggcaagaaattattgtctactactatttacgttctttttgcagacgttttttttttcaagtttgcagggtcagtagaagcaacagtgcaacactttcccatgccaattctaaaatgattacaaatatgaaattatagcacatatattattttgtaaatctatatgcaagtatgcaagttgaatctctgtataacatcatacgattgtttcagtttcagaacatcattatcgtcgtgtttagatccattctatcgatgctccctt

SEQ ID NO: 65020 - DNA, 12848 bp, Oryza sativa
tatacaaatctgaccatatatatatacagtttctcttgcagagcaaaagtatgttcctatatattaaaggtctgaagatgagtactaaaaaacacacaccttcatatatattcacggcaagagctgcacataaccagtcaggactgcaatagctaagatggccaatggcggcactaggacaaatgcgccaacggtggcgaagaacactgagtcattccgtccactgaccttggtgagcagggcctgcctcttgatgttcctcctctgggagacggtcagggagttgagtttcttcagaccttccttgagcttcttgcccaacgggagggtgtactcaccgtccctgtcaccgataaccgctgaaagttgctcacgaatagtagtttgcacacggggttctgtaggagcaccgttctccacgcctgatgagccattgtgattagttgccacatatgctaattttgggacatgaatgagaaagaacaacgcagaattgcaggttttgtgtggcacataccaatgccatcagatgtaggggttgtcagctgctccaggagatccaactgggtgcgcgccgaagaaacttcagaacaaaatgtgtcaatgttaagccatttggcaacaaaagtagcttcatgggaacaagtaggctatatgttcaatacttcaatgcaacaaaatgaactaataatatattgtagtacccatacttcaaatccctggactatgtagctacatttatgctaatagaaatggggggcctgggcattgctctaaaaaaattaaagacaaaaaatacttcaaatccctgacagactttcttcgaaaataaaaacctctgacagcttaacacaactcaatgatactacagtacttctgaaatttatggtcgagagattagaatcgtttcgcaattgaattcacaccatgtctgtctatgtaccgaattgcacaagctagagtggtatgactacacgaacacgacaaaattttcttaattctaattgtccaggtgtattgtgacgattcttttgagtactatatctagaaatccctgccgactcctcattggcgtcttttcgaacacaatttacacgttgcaaaataactctgattgagcatacaagtgcagactgcagagacactgaagcagttcgtggactactaattattagtagttaggctagcttacatgccagatcttcacatcttctctggacattttcctagaggacatttcaatcctacacatatgagaatccagaggtaactatcgaagtcgaggaggtgtacggtgtacctgagatggcggggtcctgcgtcgcgccttcctgccgggcggcagccgcggccttgcagccggcgcccagcgatctctgcaccggggatacggtcgccgccctaggcggcaccctgctgctcctcacggccgccgcgtccacggcctggagcctcgtggcggacgaaggcgggaagctgcacgccatggctcaccctctcctcctcctcttcctcgacttcgctggaaagtcggtcgtggcaaaaacaaaaattcgatttcaattcccttttcccgtttttttcgtggcgagcgagcttgcgtcaccggccttcacggttccaaccacaagaggagaggagagggaagccgcgctgcgcgcaccacatgtttgagctccgtccactgagaggccgggcccactgagccagcgacttgggccgcatctcgtggaagaggcccatcaaaacgagtacaaactccagcccagcccacttcgccgagtcgccgacctcccctctcctttcctcttcttccccaccggcgagtcggcggcgaccgatccctccccgagccgccgccgccgccgcgatgtcgtcgccgggagagagcgggccttcggcttcggcaaaggacacggatgccgcgcagagggcgcaggagcaggagcccgggaagcaggggggcgcgacgagggagcggcggatggagtcgctggggtggctgacggagtcggcggtgatgccgaagaagcacaaggccatcgagggggtcggcgccgcgtccatcctcgacctcaaggcgcagctctaccgcacccaggaggaggcccgcaagcccaccgcccacgacgccgccgcggcggctgctgcctcgggcgagttccgccgggccaagaagcgcgccgctcctggtgaccccctcggcgcgaagaattccggcgtcgatgcccgcgcccacaagtacgtctccttactacttctcatcgacctgattatccggggaattgacgaatcagtcccaattgctgccctttgctaggtattagatgccttgaaatggttattgttcatatgatctagtagtaggaggatgaacggaatactttagttgcaatctgtagttaatcctcatcgttctttgctgaacaaaatgaataatcccctttgcaacatgactagatttggtttgggcttataaatctaggttatgtgacttgcctatcatacaaggcagcaagctggaattacttcagaacaatatcagtaactggttcatattggagatcaatgtttttatgcttctttgtattggatgtcatggaatttgattaggtaaaacaattttagatagtgtaccttttagcaattgtacagctggtaacaaatgtagggcccgttgcctgtacttctgctacattggtcatttctccataaagacacagcttttgttcactagtggaaattaacaatggatatgatcaaagaacaattacggctagatgttactatttgatgttccttccatcttgctcagaccaatcatctgatatcctgaccgcaatggctcttaagaagaatttccttttctcattcagcatttctacacatcgtcagctaactctcccctttgcatttgtctagtgtagcatttctaagaatgttgattacgtattttgcttattatgacgtccataatatgctacctgtgttttttcccctcttgctcatgctcttgaccagcactaatgcctaattcctactttgatatttgcttttgcaacagagataagttggagctaaaagctgtgaaggatggttcagtaagttatgctgccttagaaaagaaggcagaattgtatgaaaaattatcaagaggcgagatacctgatgaagaagacaaggaaaaatattgtgttgactttttccaaaagagtttcgatcatgtctatgagcctcggcaaccagagagccagagtgttattgacagggcagaaccagaaaatgacaatgatgattctatgtcaagtgccaaaccagtaggccttggtcgaactggcactactattgacagagatgagcacaagcgctttgtaaggtactgttttctctggacttggcacaagtgaatttatttgtgttttgagttgctatttatcgcccgtttatttccaaagcatgcgtataagtgtattgctctgatactgaagaagagcaaaaacataattggttgtccttgcattttagtcatttgatgcttacatagaccattcaacatgaatttacttcctaaaatgttggtattttgtgcatttctgtgtaccaacatttctttttagcatgcccatatagccataatcaattgtagtaatccttaacaacagtgttgtgccgccaaacagttcacatacttaagtccagatctcttcatgtgatcaggaccgtttgtaaatctttacaagctgtgttcatcggcacgatgtaaggccttccagtttcagtaaaaaggaataacatttcatcaagagcttaatgtgtaaaatacgaaggcaaataattctttcctgaacatttagatgtgcaactatgtcatcagctaccaagtgatactatcatttaacttccaacattgacacttatgtagttctgttaacattacgacaatactgtgtctcaggccttttattgacttgtgccatgatgttctgcagggaggttcatgaggaagtaagtgaggcaaggcagaaggcttcaacaatgaaatcccgacgacaagagcaggaggctgctcgtagagagaaactcaagcaggcttatttgaagaaacgcctggagaagttacttgctgagaaacgggccacttcagcaaccgacgaccaaccagctagctagtccaggttttgtatgtcctcacttatgtcctgtagcagccttagtagtttcatggcaattcatcatgagttttcctttgaaagtggttctttgatttagcagaaccaaattcagaaaacgttgtcatgtaaagttgtttctacagtttgattcaaacaatgttgtttctacagcatgtaattgtacaaatctacacaattgaaaggcatcttcatcttcatgtgatttaccaggtcttactgtgagtccctgggtgattcctctcttgtatgcaaccataatccctttaattagggggaagcatggtggtatggagccatggtggtgaagtagtgggtgcatgactttacccaccagagttcaaatcctagagcccacgaatattacaggcctgtttggcacaacttcagcttcagctctacctctcttggagctggagctcagcctaatattttcagctttatctataatgggagcggagctaggtggagcactctcacaaaatgaactagagatgtgaagctgagtttagactgttccacaactctactctagatgtaactcgtagagctaaatttaggagttagaactctaccaaatagaccttacacatatgcaggtttgctttcaacagaattttagtgaggttaggaatatgccactagtttgtttataggctagtcatttaaactgactcacagacaaactgtttgtttgtttgggcttcggtttcttagtcaggtgtaattctgccattgtaaccatttgagaagcttctcgtggggcatatatcccttctgcgctgtactgtaattcggtgcatgcatatgcatagctaactcaaaagctggccaacgtcacgaccaaaatctcgttggttgtaggtgccaactttaaaatggtaccagtgcacaaccgagaggagaaagaagcaggttccatattctatattccttttgtttggatgaaagagaaccgctggtgttaaagaaaaccaaggataaaaagttcgctggcgctttctgtgattctttccaaatcggcacataaatttcttgggccgaactgcatttcatcccgcctcctctcctgcgagttgtgcgtattgttccctgcgtcactgcgtgctcttgaggccgaaaggaacgggatggccaagacggcgccggagcagaaagcagtgacgccggcgacgccggcggcggctgcggcgagcccgttcgagttccatgtgtatgggccacgcaacctgtcgtcgacgacatggagagacctccttcgatcgagctggtaagttactctcgcgcaaaagaaagatacgatttcaagatcaaagaaggctgcttggttaagttcaacgatctttgtgtgtgtgtgtgtgttgtgtgtgtgttgttgggggatcttcttttcaatgagtttttataggtttagatcattttggttgtgctacggtgcttgcggagttagcattgtttgagttatttgtttgatcttcttcaattcctttactgggatatagttcatgtcctcaatgaagaactaggattatttttcaggttgtaaatagtccgatcaacaattttggctttagtcggtttatgtgcctaatacaggactggtggtgaaagttttaaaatcatgttctaaacaagttgagagtatatttaaaaaaccacaactctcttgtcagaactataagtttgctacaaactttagatagatatttcacaaaactacaataacaataaaattgttttattatcaaataaactacaaatttaagtatcacatgtgagcccaacttgcaacaaagcagtaatatatttgtgtctgatgaggggggcctaatcggtcaaacaaaagtttacaattctacgataaaatcattaactattattgtagttctatgaaatggcgcaactaataaatcgataatttgatagcacaatacttgcagtctactccgtttcaaattataagtcgttttaactttagtcaaaatttaactattttaagtctaactaagtttatagacaaatataaaaatatttatagtatcaaattagttttattaaactaataattaaatatattttcataacatatttgtcttgggttgaaaatgttaatttttctataaacttcatcaaatttaaagcagtttgaagtaaaaacgacttgcaatataaaatagagggagcggcgaaatttacttcgaaaaaaaaaaggagtcacacctgcacagttgcgcaaaagcattcccctcttgcagccagctacagcctacagcggcttctcacgttgttggcgttgcgcggcgcatgcaggaagaacgccaactaccggcgaatggtgatcgcgtgcttcatccagggcgtctacctgctggagctcgaccggcaggagaggcgcgacgagcgcaccggcgccctggcgccgcagtggtggcgccccttcaagtacaggctcgcccaggcgctcgtcgacgagcgcgacggctccgtctacggcgccgtgctcgagtgggaccgccaggccgcgctctgcgactacatccccttccgccccgccggcgcgcccgccgccgtcgtggcgctgcggggcacgctcctcagggcgcccacgttccgccgcgacgtcaccgacgacctccggttcctcgcgtgggacagcctcaagggctccgtccgcttcgccggcgcgctcgccgcgctgcgcgccgccacgggcaggctcggcgccgggagcgtgtgcgtcggcggccactcgctgggcgccgggttcgcgctgcaggtggggaaggcgctcgccaaggagggcgtcttcgtggagtgccacgtcttcaacccgccgtccgtgtcgctggccatgagcctcaggggtttcgccgagaccgccggcgagctgtgggggcgcgtgcggtcgtggatcccctactacggtggctcctcctcctcctcctcccaggccgcggacgccggcggcggcggcgagagcgaggaggcgaaggcgatgtgcaggtggctgccgcacctgtacatcaacaccaacgactacatctgctgctactacaacgacgcggcggccgggacggcgaccgtggcggccggaggaggaggaggcgggagcgcgagcggcaaggcggtggcggcggctgcggcggtgcgagggaccggcggcggcggcgcgcgcgtggcgaggatgctggtggcgtccaagggcccgaccaagttcttggaggcgcatgggctggagcagtggtgggccgacgacgtcgagctgcaggtggcgctcaaccacagcaagctcatcgaccggcagctcaggtcgctctacgccgccccgccggccgccgcaagctaggccgacgaaattgctctcaaccaatgacgttgattgtactgctttagtacccagattacattctacctggaggatttacttacgagtatctcaaaggtttatagaagagtggttaaaaaaattgcgtaaaaaaaattaagattaggatatctcaaaaacaaataaagcgagtttgattattcacatttcgagcaaacaaaagaaccattataactgaactggaaaaacttaaaatgagagagtgaaaaaaagagagacaaaagaacgactccgctggggatcgaacccagaatctctggttccgtagaccagcgccttatccattgggccacggagtcctggatgcttaatgtgacatactatttttctttagttaaaatgaatgaccaagagaattgtaatttcggtgcccaaagatttagttatttcaagcactggtggtgtaccagcgaatactcgatccaaagctatcactttatcacaagacgatagttcactctagaatgagcaggaaactgactatatatagattccattacaaagctcagtgcctcagttctgtaatatacaattgattcgtccatccaattacttgggtgaaccatcggaacaactacccgacgttcacctctagtcgtaatctgattcctcggacaattcaccgctttcctgcattgaaaataaggtaagtatgattttttgcatggaaaaattgaatagacacgaaaaaaacacgtgcaatatatatgcagaaaatacacctttttcttgtcaaattcagccaccgccttctcatactctgcacgcttctcggttgctatatcataatacttcactctttcctggtgtaatgaacaaaagtgaaattgttgacataagtatgatatgagtttatgtctaaaatgcaatgcgcaaaaatgtgaaatgaagctgtacatatctgatatgagatattgtattgcctagaccatttattttgacaatgagtcagaattcctacatagtccactgtgtactaaactgataatttgaaagcatagtattatttaagaacccaaaagaagagcctgaaaaaacaaaggaaatatatatttaccaatcaaaagttcaaaacaacacaaatagttcacccggccttttctggctttgattgcatgaatggtctttgagtgaacccaaactgctggagccaacaatttctatcttttcctggttcaactggcagtttggtccaaactatgatttctaaaaaggaaaattccaaactacatatctggtatttaaagctctaaggaatccacaggtgatcttgatatgcttcacagcagtagcaccttcttttgttttccctatgggttggtagcatgaaaaaaataggaaacatgggtatttggcagttggcaccaaatcctttgaaatgcgactatactaaacatacatggaatgaacctactgaacaaaagggggaaaaagtaaatatgcaatcatgtaccattatccaactgaacagtagatgtaacacctacaaagtacattcttgggcttctacagttacagtccatgtcaatgtattactttagctgtttgagcgtatcggctacaaagcttctacagttgcaatatatgtcaatccgatccttcagctatttcgttagaattactccctagaggcctagactcaatgatcactttttttgtaggctgtaccagttaattcaaggaagtttagaataaatagattagttatctagttttaacactaggcacataaacagtagacaaaaaagagcagatatggctcaaatatccctttttaaactttgaaattaaaccttactaatacaatacactgaagcaggaacttctgcttgatggtttaaaaaaaaagtgattttgaaacaaaagaataagtcaatatacatctcaactccgcatgtacagatttgtggtgccatcatgtttctatcaatcattttatgtgtttgttgggtttgctaccatgccaaaatgttggcaatgccaaaacataggcaagttttggcacttccagatttttggcaacttttgtgtggtgtaggtaaattttggtagcaaaccaaatggtgccaaattactatacaagaagccaacattttggtagggcaagttttggcttcaaaccaaaacagccatgcgttacaacttacagagaagcatggtttggtacttgagtgatagaaaatttacagcaactagagacctaattgaccacaaacatcactaaggtgaaatcacaaacctcaaatgtcattgtattccatttctcgccacatgccttccctacctgcagggtaagatatattactagatgactaagtagcttaaagcttcaacgttaactgatggaaacttacttcttgcattgattttacacttggattttcttccttgtaagttttccgaaaatcctcccttcagcagaccataacagtttttcagtaaaacttgactgagttgattcagtacaagatatgaaaataagaggcaaaaacaacagagtaacttttgtgttttggttacacctaaatggctaaatttatgtgaaacacctcaaggaagtaagcactatgtttaatgttgatgactggatgcggtataaagcatctagacaattatggtagcatgtaaatgttgccattactctctatcagtagctaaaacacttcgtaaccatcaaaagcatgaccaagtcaaaaacatatgcattcattttatatcagtaaccacacatctttcgatgcaattgtggacaaggagcatcagatatgcctgttcaattaggtaaaggctgtgcccttcgcatatgttgcaggggaagcacacactttggtactcaaaaaaaaagtggtgcatagtttcagttgccaactcccaagataggaccacaaaataacctgcctcactccgtctttaggaaaaacaatcaaattctaataaagaacagggcaatcctatataatatcgcaggataactcaaataggaatctaggatcccagccttccaaaatgagatgtaaacaatgccaatctacataaacttggggtgaaacctgattgcacaagctacaacaatgagtccatccatgactagggaacagatcgaaaaatgcacctcagattgagatgccctgtaaaacctagtaaattcagtccctaacatacccaaccattttcctaattgccacggaccggaggcagtatcgtaaatatttcgcatgcgaacttgctgcaccgtattaccaccaaggcaccactcaattcgaagttggtgagtaaaaaagctcctaaaacaaagttctaatctatgcaaggaaacaattcgattaataaaaagaaaaagaaataagcccccggtaacagcagcaccaatcacctcgtggcaagagccagccacggcacgcactgacagaccaggcaaatccacacaaagagaaagggaaccagataatacacgcacatgaagtagaagaaggcggtgggcggcttcttggggcggcgccggtcgacgaggggctgccccttcttccgggacggcggcggctgcggctgcggcggcggcggcttgggccgcggcttgacaggaggcagccgcaccgttttcagcggcttcggcgccgtctgcgacctcgtcttcatccctccgccgcctgggccgccggggtttttagtacacgcggcgagggtttaggccccgagcagccggagccggaggagacggaggtttgcagcggcgaaaggaaaagagacggcgaagcgaggcggagaggagagagtagactagatctctcgttgggccggccgtgcggcccagtggagctgggctttcggcccatgcagcctcggccgctgctggtacaagtggcgcggggcgttgtgcgtgctggttttgcgatggattagtaccacctcggtagatggaggagagggaggaggacgtgatgggtataagacgggggtggggggctagctagagaggcatctttgcgcttggggcaatgacgcagctagtgaggtaataccgaggcgcgtcaattgctggttgaaaactatttccaaaccccctctttggcccgtcagggccactgagaatttctggaagggctccttctcttcggggagggtaaagcccaacaaatcttgaatcccaaaatttttatacctcaaaacaattttacgtattttgctcggtagaagctgcaattcggagtctataaccacactaccagagttaagttattaataagttgtttattttttaattaaagtttttttaatccaatttatataaaaaaaataataagatttatgatacttttttcttttgattttatagtattatccacattaatatagatgactttatccaattaatatagatgactttatagcattgttgaaaatatagatgactttatagcattgtcgaaagtgttacattatgaaacagagggagtattaaattagttccattaaattataataaatatattttaataaaattttgtttttattgaaaatgctactatgtttcgctataattttagaaaaaaaaatcaaacaacttataatataaaatggaaggagaacaaatttaaaacttccgttttgaaaaacacacccttaaaccagtttagaaaatgttcttacgaagaaaaacgagaaagtagaataatttcttattattaattaactggaacttttatattttatatttagatcttaaacctaaaataacaatgtatccactgaaacttttatattttagaccctaaaccttacaataaccatgtatctattttagatcttacgtgcaattagtcttttatgtgaccttatctttacatgacccatccgagcctctcctactttatctatttcctctccctcccccaatgtcttcccaccatggccatttttcttcaaagacaccgacgactccaccaccttaatttttttcctctccctcactcctctctctctatattttcgtatagattctattttcttcgaagaggctgacgacttcgccactacaacgctacttcattgcccatctctgcctctctccctctccccatccaccatcatgcaaccctcccttcttcgttgacgtcagtgccgtctcttctcccttctcctccgttgaatcaaatagctcactggatccgaatgtgagcttatcagatctcgccgcgagctcgctggatttgctgtggagagtggtgatgaccatggtggcgagcggcgatgacttgcatgacagtccttggtgg

SEQ ID NO: 65021 - DNA, 8381 bp, Oryza sativa
ttttagataaatgattgctgatagaagttattttaagatgatgggagtatattttgtttaatatcccttccttatatatatatatatatatatatatatagagagagagagagagagagttactttgaccaataattagtctgttagatataattttaagtcaaaaaaataatgtattagattaatatttaaaagtacttgcttacaatatgattgtatttttctatcacataaataatattttaatagaaatgattattgatcaaaatattttttatgaaacaaaatacaccttatattttaaaatagagagtactacttttccaatctatgcaaccatattgcttaatactgccttcatccaaaagtctaagacctactccctccgttccaaaaaaaactcaactcccttataggacaacgaatttggatagattctagtcacatccagattcgttgtcctagaaggggtcacatcccttactaggttgagttttttttggatggagggagtatttctttgtcaccaaacttaagaaaaaattaactcattcactatgtgataaaagcaacaaactatacatatgcatttaaccagtaagtaataagatggtttattagattctggtcaacaatttaatttcacatatagagattataaatagatcttagacttacaaaagttttaaaaatataaaatagatcttagattttttatagggcgatagtagttatactgatagtgcttttatttctcatcgtactttccccatgcatctaaccactgctcttagaaccatcaaaataatttcagcttaatcttattttattttgttaaaccccttaaaaatgcttattcttgtgaaggagagagtatttaaccctctacttggttattatgccgttattaaaggtcaactatcttagggtaaaggtttactttagaaaaacggatctagcgtgggtgttgggggaagttggggggactcgagtctcctctaccacgctggatcaccattgagagaaggcgagagaggagaagggaaagggaagaagagggtgagaaagaagagtaggagctggaagagacaggacacatctctattaaaattccagatccgttcctgcacttgcaccacttgatgattgacttaccaatcgagagtcgttgttatatactatgttccatgatgagtggtactatatatgtcattgtcagcaatttattccactgaatgatctgatccctgtcccgcgtaggcgcgtggggtgtcacttacgcggtgcatccagacgcgcgcggtacgcgccccagacgcggcccggcgagtcaaccaaccggtgagcaactgctcttttctcaattgacacagatctgcacactccattccaaaatgattttattttttattatcttatttattctaaaataattttatttttatttattattatattagagtttataaaaaatgcatttaactagagtggaagaaagttacattatgatttgatagaatggagagtattttatttctttatgttggtctaggttggcatgtactccttctctaatttattttttacccatcccacacataccaatataaaacaaaaaaaatacaatacaaatatactttattagattccaatataattatttctcactctaactacttttaatataattattttccactttcacaaactccgatacaataattatatgaaaataaatttattttaggataaacgagaggagccagaaataagcttactatagaacagagagagtatagaatagctataaaataaagttattttaagtcggaggtatcactaattcgatgcgatatctaccgatctttatactccagttacagattctgagattccataactgcgggcgatcagcgcaaaatctaaaaaaagaacaacactaatggtaaaggtctaatttacctaaataataaggattggataacgcgtggtgatgtggtgatgcggtccgtaccccgtggtcgagccttattttacttctataaaatcaaacgactttaaaaaaaatgtggaataatttatgcagtgcaagcaacacctttccaggactgctaaagttattatttataaatttctacttttttctataaaaacaaatctattacataactgttcatatttgtaataatagcaatatcatattccattatatttattgtttatatgatggagggaataactaaaaaaatagtttcaggcttagaaaagttgcgacggcagtgaatggtgcctaaagccatcccaacccaaaaattatcaactactttccatacttgccatgtcatatagacactatgtatagaaattactccttccgtttcaagttataagacgttttgaactgctttaagcttgaccaagattatagaaaaaagtagtaacattttcaactcaagacaaatttattatgaaaatatattcaattattaatttgatgaaactaatttagtattataaatattgttatatttgtcaataacttagtcaaacttgaaacagtttgactttgaccacggttaaaacgtcttgtaacctgaaacggagggagtatatatccaatggatggtgttttcacattaaattcttatccaatcacctctcttttctctcctttcatgcatctatccccttgtttttatttttggtttttgtgtagagatggtttcttacatgagaaatggtgttttatctttttacctctctactcattaactctcttgcatattagatttttgcttctgtgacaatataattaatgatatggacactatacgacatgtagggctggggatggcctaagattagtctgtattgagtggatatcttaaagttttaaaagttcctctttaaagtttagtgcgtgcgcgcctatctgtttcgtctaatcgggaaaaagttactacctccgtcccaaaatataagcatttttaactatgaatctggacaatatttaactatgaatctggacattgtccagattcatagttaaaaatgcttatattttgggacggagggagtatatggttttggcctttttacagttccgtcagtaaatgaatctttttgtccctttcaaataaatgataaatcgggattattaaaggatttgagtcctatagtttttctttccctaaatgagcctttagaagaaagggattgggaactattaaatcccataaaactctaattgaatacctaaatccatagagttctctataagtttttatcttcccgtaaattcctgaatattaattttgtgctctatccaaagttttaaacaatcattattgtactttcttcctgtgtattataatcccacgtttatacttttgttctttctactcctgcattttcttgagcatgcgtttaaaatggggttacggattttggattatagattgttggcttcctaagcgactaaacggtatttaagaaacattttttcggtatttcttagaaactttttccattaacctttaccagtacattttttcctttattcaaacaatcattatcatatttttcaagtgttttgtaatctttttgtctatactcgtgtttctaacttgatgaaactccacgcgttgctttaaaagtttagtatgataatagtagaaacatgtaatatagctagacgtcttaagcttatagaatttgtatatttgatcgatccttgcaaaggccataacaattaagttgatgtggtttatgataatttaaatggtatatagattgataatttaaaagtaaaagtaaggtgatgtaactttataagagaagaaaatgaggaaaataatttgcactatagattaataatcaaaaggctaaaagcaattgagatgatatggtttaatgagagaatatagaaacattaactaaataagaatgaactatatatgggatattgtagaaaatgataaagagatatatgttgaaatattatgtaaattatgtgggatgatgatttaacatacttatatttttaaagttttaacgtataataaagtatagatgatatagtatgcttgtataatgtttaagatgtaacaatttctaatggatgattatatggtatttttgcatgttgagatttaagatgtagtgggttgtaactttatagatagtatagataaaatcttgtgtttttcctacttcaacgttttcttcagcatgcagtttaaaggcggttctgggttaagtattataaactatcacgtgcatgtttcacaagatactaaacggcgtagtttttatttaaagaaatcgttgtcaatatttcttagaaagctttaattcaacgtcctaatatttaatccgtttgtttaatatacccttaaataattatcataaactcattttcatccatcacccgtcatcccacagctaaaaaaccatgccttaagtttgctggaagtcccccaaacaaatgccatgaatagagaggtgaaaactggagagaaactcccaagcaactcccaaagtctcaatctgctcaacggacatgttccaatgattcacttgttcgttattaattgttacattttctttgtttatatatacgcacatgtaaggatgcaggaagacgatcgatcaaggttcacctcggaaaagaaaaaagaacagaaagaaagacgatctagagggagccaaagattgcaagatcgatcgcaaggtaacgtacacgtacaggtgagaggaatcgatgccggccgacgcgcgagctgctccgccgtcgtgcccgttcccgacgatacggtcgcatggcgccgccgtggcgaggtcgcacgcctacgactggctcgcgctgctcctcctcgtcgccgtcgacggcctcctcaacgccatcgagccgttccaccggttcgtcggcgccggcatgatgaccgatctcagataccccatgaagcgcaacaccgtccccatctgggccgtcccggtgcggcgcaattataattatctgcgatttttatgatccgtccctcgattaagtttcctctttaattacgtgatctaatcaggattatctctcgtcctaaatggcgcagatcgtcgctgtcattgggcccatgattgtcttcaccgtcgtctacttcaggaggaggaacgtgtacgatcttcaccatgctgtgctaggtacttaaatcttccaacgttgccctccattccattgcaacatctccttaatttctttgttgtgacgaacattttgatccatcgacgagcaggcattctgttttcggtgctgattaccggcgtgctcaccgacgcgatcaaggatgccgtcggccgcccgaggccgaacttcttctggcgctgcttccccgacggaatcgcggtataacagcaaatctcaacttaattagcccctcaaaacagtcaaacctctctggaatttacgccccaagaacgcctcgcttatcgagcgatacacacatgtgctgtgctgtgctgtgcctgtgcccaggtgttcgataacgtcaccacgggagtcatctgccacggcgacgcgagcgtgatcaaggagggacacaagagcttcccgagcggccacacttcatgtgagtcaagtctatatatctcactcccctcatcacataacaatagatcaagatcagccaactgaatgtctgatcattcttctatctagattgattgagtgaatgatataaacaagaacttactacagtgaaattccaatcactgaattcacggtatatatagtgagtttgtgacactgacagcagaaagccagaaatgatatgttctcgtgctctgtggctgcagggtctttcgccggtctggggttcctgtcgtggtaccttgccgggaagatcacggtgttcgaccggcgcgggcacgtcgccaagctgtgcgtcgtcctcgcgcctctgctcgttgcggcgatggtcgccatctcgagggtggacgactactggcaccattggcaagacgtctgcacgggaggcgtccttggtacgtactccactatataccactgacactgtacatgcttgatgaagttgcggttttatcagaatcgatattgtgagctatatatctcgttctctctgctgctaatggtcagtgctcgtctataggattggtggttgcctctgtctgctatcttcagttcttcccggctccttcagatgagaaaggtgtgttctgctttctcccttcgtttctctactttcttgagatggattacacagcataccgaccacggcgtccaacaaaggattaaaatcacggtggtgtaatcggattggttaccagttaccactcttgaaccaccaacggtatacgggggagccgtcaaagaagtttaaatttgaaattgaaatcatattaatggtatatccttagccacaattataataaagaaaaaaagtgcaaattgagaagtaggcaccttcaatagaaaaaccgaaaaggacagtccgctcgtcaccgtaattcaacacaagtcgagttatcgtgactagctgccacatgtggccgtccgcaccatagttcgagagaacatcaaggccaaatctgacttctcaaggcaaccggatctacatgagtctaagttgttagcctgctagatctgtctcagcccaaagggccacaatatttgagctaattctaaatattaaaaaaaaacttcaaagctagtaacttcttaaaggatcaaaaacagctaggtccaaacgggccaaaggtcaccagatccaacagcatcgagcttgagagctgttgcatccgagttcattagatgagaagtggaggaaagtaatggcagatgatatatgctaggaacgacatagtcatcctaaatctggtgacatttagttccgcctagcatgagaggaaggggagaatgtgccgcttaggaaaagtgtcacaaggaggtgtcagggagaggatggggcaaggaataggggctagcagcattggggaagcgaaggtagcatcgatgacagaaatagaaaggggagcatcacccaggagaggggtggagaagaagtgtgacaagtaaggaggatcaggaatctggcaacggcccgaatcaattggaaaagggattaaggacaattcactcatcgccacaattcaactcaagccaagttatagtgaccagttgcccgcactatagttcgagggagcaccaaggctagatctgatttctcaaggcaaccggatccacacaagcctagaccgctagattcgaccatctcaaaccggaggtctgctacatttgagcacattttaagcataaaaaatcaattccaaagctagtaacttcttgaaagaccaaagcagccagatccaaacatgcctgaagtcactagatctagctgcattgagctcgagagccattgcagaagagttcattggatgagaaaaggagtggaggcctaaactggcaggtgatgctaggagcatggtcctaaatttggtggcgtttagttcagcctgagtggaaggggagggggtgctacttaggaaaggtggcacatgaaggtaccagggagaggcctgggcaaggaagaagagcaatagtattgggggagtgaaggcaccggaaatagacagagaaaaaggagcatcaccaggagagaggtggagagagagtgtaactcgggggatcagaaagcaggtaacggccttaatcaagtgaaaaaggggattaaggtttcttggttatatagattttcgtaaaaatgagtagtctgttgacttagatacgacgtatgtctcgtggataattgtattttgatctacttatgaggtggtaatacttttcatatgcttaggcatatgaaaatgtatgcattagccatggaaaaatgtttgaagatttttaattaaaaaccgactactattggaaaataaacaacaagttaccactgataaccggtttttaaattaaaatgttggattcaagcttttatatggcaaccaaattgttattcgctacgtgagagaacgatattattttcttttctaggaataatatattcaaaaccttgcattaactagtggttgcaccacgccaatggcagggttctggcctcacgcgcactttaggtacatcaccgagaggggaagcgagaacccaacgcagcaagccaccgaaccactggacgccatggaaaccggtaggggaggccaatgaacaaggtgcaagcaagaccaatcttgtgtatataaggccataatgtacagctcctcctcaaggcacgggaggtaatcgtcgttagtttgtaaatactttggcgtgggccaatggtaccgactaacttgactactgacctgacgcaaataggtgttgt

SEQ ID NO: 65022 - DNA, 9810 bp, Oryza sativa
cttgaattcaagaaatcattgtgaaaagaaataagtctattttgtgtcccacatcttttgcttctaaattctggttgaatcacctctgccatcttctaaaactgttacaaatagacttcttctatgcttcggaaagtggtttttttaacgtggttgagtcgatcagaaacggacggaaattagctttagcatattcgttttcatattatcttttttggaatcgaaaacctggatacagaaataaaatcaaatattatcgaatacagataaggagcgaaaacgaaacggaaagaatatggcaacgaatatttgccggtatataaatatcccctcaaattgagtttccttaatcaaggaagagatatcgcttgttttttatcaacgcctccaacatttatattgtcaattttataggtggtcccacaaccgtatgtgaaaatcgattttcatggctattctcttaagagacccacatgtaaatatgattattcattttttaatcccaagatattttacaatatttatagcttacttaccatatcactaatcaagttcttgttgtataaattggaggtgttatttattttatttcgcatcttcaaaacttatagtgtttgttttatagtttaaaaagtttcaaatataaattttataaactataaagtggtagatcccattaagctctacaactttgatatggaacacatctccatcaaatgtcgtttgaattgcatatctgagattttgtaaaaaaacatatatggtattttataataaatatttagacccttaaataatctcaaataataacattatcaacaagaaagttgtagatctcatcgagctctacaattttgatataaagtttagggataagcccatcttacaccctttaactctttacttcgtctaaaatacaccctcgaactttaaaaccaagcatttaacaccccccaactattaatatcagacaagttacacccctgaacggtttgtaggctggttttggtacggtaggacgtcaccataggatgccatgtgtaaaaaaagcagtgggtctcacatgtcagggttagctttcttttcttctcttctctctccctctcacgggcatagcctcacagaccggtgttaaggagtagagaatcgaagctgctgccatgcgccccgtcttcttcaaccttgggcaagcggcgggctcatcatcgagctcgccatcggccccttcttctattgagctcacccaaggggacatcaccagcgccgcttcatccccttgtagccgtcatcataggcacacgccatagctgcacgtagctcctccgccttccctgtctcacactagcatgccccttcgcggctccgccgcctgtgccgattgcagctccactatcatgcttcgtctcccttagagcaccgcatccgctccctccaccaccaaaatcgagctagagcactgcatccgtcccctcagctgagcttcacgtgccctacagccaccgctccagcgagctgctggcggcgatagatgcagctagcttgggctgctccatcatcgatggagggaaggaggagaggtggcgtgacatgtgggaccctttttttttacacgtggcatattatttaccaaaaccaccctacaaactgccgggggtgtaatgtgtctagtatcggtagtttgaggatatggaatacccggttttaaagttcaagggtgtactttagacaaagcatagagttagggggtgtaaaatggacttttccctaaagtttatcttcatctaactctgtatgaaaaaagttatgtatatatacgtgttttttctaaaatttgatccatgtctgcggatatccaaacaaaatttctggatagtttccaatcatttcccttattgtatttgtttttgtttccgactaaaaaaatccgaattcatttccgaatccgagaatttccagataattccgacctatctgaatttgaaaaatggtccggacggacaaaaactatccagtttcaaccctacaagtagatgggacttgcagttgactcgctgagaacatgtccacgcttgaggcaaatgcctataaactaccggcaaattgggaaaaaaaaagaagaaaagaagaaaaattgaacttgcacactcacttgatgaagatacacgagttgttttctgaggcactgcatatcttttgacttaggagtagtaattaattatacttcaccaaatatgcatactgaaatcaattgggccatccaccatcaaggcatcaacattatctctgcagatgcatcagacggcaataaggcatactcctatgtactgctacgtgcgtcccccaatgtccctagtagcggttttcagtcagagcgctcttttcccggcatgtcgcacgctttgctgctctctcattctcctccccacagccactgcagataaggtggtatgttctgctacaaacaggccttgtatggtcgagctagcagcagattaaattctctctcttcttgcaagttcgactagattttcaggtggtttgatgtggactgtagaatggatagaatcttaaaacgtgcttgctttggaggatatttcgtgatgtcgtcaccacacgtcgcaaagaaagggacgtcgcttgcagagaccatagtaaaacacatcacctctacagtgatcttatttgtcgataatattttactatcagtattctcttcggtgaaaactatatcaaccattgtttttattataaatatgttactaataattaatgtggtagtataaatagatacgattcattaaattaaaaatacaatcaacctagattaattcttttataagtaaagatcatcataaagcaccacctttcgcatcgatttttaaccttaagcattgtaaaaggtcagttcggataaggtgctagttcctcaagttgagttgcggtacgtagaacccaacaagtcaaaaatatcgtcgttgagaaatgtcatgcgcttttgttgtttactggtactggcgctgccgatcgcgcgatgagccaaaccactaccgtcgctttagaaacatcaaacagcgaaactgatggtagaagacaagcgtgaggacagggaaaggaggataattcatcccaccaaacgtagaaaaagagacgggcagaaattaatggtgtgggcgttggtagttttctcggagggaatcagtagaaaatcagcactaggcttgttttatatatttaccctcggttataatgcccattcacatagttttgaaattttgtactagttctttttttccctttacaaaagactactgcatatattatctatcactccacatagtatgtaagataaatttcgattcgtaggtaacgaaacgaatataacatattcaattgtgaaagtgtctatatatttatcgtctgatttgggtgtatattataaattggtcttcacatgtttgttgagtaattgatgtgtgaaaccataatttatctagttcaatttctcaagttttttttcatcattatctaaattacatatgctccctccatttataaatataatgagtcttagattgtttatagtagagtttaagttgaggtgaaattgctctatccctaaaagttcaattacttgattggaacagatcacgtctagagatgtaaataaagtaatagaagtaatggttggaccgattgtgaaattagtaggtcagcgatgtaatcaaatctcttatatctgtggataaatggaaaagaccaaaatttatggatggccggagtatgtcacaaacaattttgctatatatttgtcgacaaattttcctccaaaaatttgacatatgtaattacagtataatcatagtgtaattacactggaacttgcatgggaggacactgtgacgacaatgtaacagctcttgtggttgcgtcctactcaggccgtccatacactatggacgtactataattacatttgtcaaattttcaagagaaaatttatcgacaaatgtataggtggtcccacaaacaattactcaagggtgagaataaccgtctcacccttgtaagaaaataattgtgtcttatcttttgaggatagtgctaatagtgaagtggggacaacaatgcctataatagtgggagtacaagatgctatatgtgaggcacaaattatattatacttgtaaagtgatgttgttccctaactcagcgaccttgttgtgttgtaaaatgtaactcttttcttaattttaatgaaatttggccaataaatttctgcatacccaatgatgaatgtattacaactacggaggggttgaatttcgtaaatattcggctaaaccaggctcctctaaaatatggagaaaagaagtcttatatatatatttttctaaaaaaacccaaattttgttatagaaatttttccctttcaatctaatttcactattgtatctacaaaatttctttgatccaacaaaaaaaggaaaccctaagggctcctgggtgaagaatgcacggggcacggcctcgatgtcttatgtctaccggtgcagacgcccatgggccatggctaatcgtgaacgtacagggaccacggtgcacgccacagccggcaaggtctagagcaatctagaggcatcaatctgttgagcagtcgcgtccaccgagaacacgtatggatgtacgcacgatcgacgaacaccaacccaattatctcagctgaagaggcgatcgatcggttaatgtaagatgatctccgttaaatcgtacggatttaattaagggcgcagatttacaacacgatcgaactaattaaccacaagcaaaaaaattacatacatgcatgatggttacgaacgcggccagctgcggcgagcagaattggtttaaatctggcagccgcagcagcagaagaagcaggagagcgcgaggccgagcacgacggcctccaccacgtacatcacgcggaacgccacggcgtcggccaccgccgtcgcccagccgccgctcccggccgtcttccaccgcgacagcgaccgcgtcagccccgccgccagcctcgacgacgacccgccgccgccgccgcccgcctgcagcttccaccaccgctgctgccgcccgtgcacgcactcccgcggcaccatcatccgccgcagccaccctccccgccgccgcggcggcttctcctcatcggcccccgccgccgccgagccgtgcagctcgacctcgacgcccactggcgtgtagtgcccccgcctcctcggcaccgccgtcgtcgtcgtcatcatcctcttcacccaccctcctcctcctcctcctccccgccgctgcttcactccccccatcgccgccgcctttccaccacactcatcagtcgccgccggcgccaccgccgccgcaatctcggcctcggcgcccatggccgccgccatgggagaggaagaagactcttggaggcggagacgtgcagcgcagggacgggacgagacgaggcgagatgaccggggattggttggacacggagcaatataaaggagacgaacccgtctcgtctcgtctcggctcgaggagatgtgatttggattcgagcctgcttggcgccgaaggctcgcgccagccaaccgcgagtttatgcttactacttacaactcaccgtcagctgtcagggtcgttgccggtttgatctgcaactgcaaaccgccataaatccgtgtaaacaaatgaaaagcacggagtactttattagagttcgtgttaagataaatctccaagattaatctaatcgcacgagctgtacaggttctagaagcatattggtattggcattgggcagcaatcgatcgatcggttgctggactctgtttctgttcggctggagcccggctggccgtgacagcagagcgtatatacgtgcaggcctgcattactacatacaacgctaccctgcaactttaggttctgtctctctaatccttctcgctgtatcataattcggtgcaattttgaatacgtcccggccggctttgttgggtccttctcttcggatggaacggtttggtcaaaatagacaaaggctgcgttaatttgggtgataggaagtgagaatgcacatcgtttttcgcgcgcacgcttcctaaactactaaacgatgtgtcttttgtaaaaattttctatataaaagttgctttaaaaatcatattaatctatttttaaaatttaaaatagttaatacttaattaatcatgagttaatggctcacatcgttttgcgtatcttcctaatctactcaatccccttcttctcagacacaccctttaagtggtttggtttggtagcctcgagccgcgccgatgataaccgctagtcaaaggctcaaagacaaattgggagcagttgcccctgaaattgtcagttacttccaaattcaaatgatttagtactatgagttcttttcttcacataattttcaaaaactggcgccccagacaaggccaaacggattaagacaaaataatacagtcacgcagtttcagcataaaagccagagacatgactacatgagaatcagaattagaggtgtatgacagccatcgacccattcggcgcgcgtaccaaactctcatctggccgcactagaagcacacaacagctgcacgcacgtctcgctatcagtcgctggactggccatttcccctccgttgataagggatgcattgctcccgctagctgtctcggcctctagaattcctgcagacacgacgatactgcccatgcgatgcgatgcaatatgtacatctgttgccacggccgctactgccgatcgttattcgttgttagcgactactaatgcttgagcagctggagcaaatgactcggtacgtaagtgcaggtgatacagctgaacgtgacagtgactggtgcgagtgcgatcggtctcttagacagttgggttaggcagattggcgtaaggggttgttccatctgggtggtggtactatgttatggatgtcaaatctttctgcgtctagggttgatgatcaggcgactcgtgtctgtatctatggtgcgtcacaactcacaacgcacatctacagtagaaaccgctcaatgacagcgatcgagttcattctaaatggcactgcaatagcctggcttaaattctaagctcccttgaaacgtattgaaatattaattacataatatttttcactataattaagtttaatttgtaaaatttctattaaaaaaaggagcacctactgtattggatttcgtgcaccagttagtttgaagatatgattagttaattactaagtactagaggagtagaacacatgtttgtatttttgtggtgataccgaataaaccacagtgcacaaaatcaagtcatgaaacagagcatgacagctgaaagcatacaactgaagcatataggggtgaaaacggatcgaaaacggacggaaactagttttatcatattcgttttcatattttttttcggaatcgaaaactcggatacgaaaatgaaatcgaatattatcgaatacagatacggagcgaatacgagacggaactaatacggtagcgaatatttaccggtatataaaaaacccctcaaattgagttttttgataaaggaagagatatcgcttattattttagttcaacatctccaatatttatattgtcaattttgtagacggtccaaatcgattttcatggttgttcctctaagagatccatatgcaaatatgattattattttctattcccaagaccttttactagatgtataacttacttaccattgtgtaaattggagatgttatttattttacttcacatcttcgaaacttgtaatgtttgtattatactttaaatgctttcaaatacaaatgttataaactacaaagtggtagatcccgttgagctctacaatttttttatggaacacatctccatcaaatgtcgtttgaattgtagatctgagattttgtaaaaattaatatggtatattataatgaatatttaaacccttaaatgacctcaaataataaaatagtcaataataaagttgtagatctcatcgagctctacaatgttgttataaagtttgtcttcatctgattccgtatgaaaaagttatgcatatatacgtgttttttttctaaaatttgctcaatgtctgcggatatccgaaaaaaattccggatagtttccgaccgttttccgattccgacggatagtaaccttactgtattcattttcgtttccaagaaaaaaatatccgaattcgttttcgaatccgagaatttccgaataattccgaccgtaactatccaaatctaaaaaatggtccggacggacggaaactatccgaaccagtttcatccctagaagcacatgtgaaaggtggagccctaaaatcccttcatatatagtactcctttcgtgctgttgtactactgtattacttctaagctggcgtctcttgattgcatttccaaccgaactcctgttaaatccatttcatatgctggcggctggtgagagacgtcaagttttctgaaacatgtccggtgtatacatgtcaatgatcggtaaaaagacgcaacaagatagcacctcttgtgttttttcgtaatttattgaaccgtttaatcttgttattgcttatttcacatttcgaaatttccatgccgaggagaggagaagaggcgtggagcgtgaggagaccgttagccgatagctgcagcagccggaaagcaacagcaaggtcggaaccaaaaattttcagaccaatgcgcgagaccaatgaatgcaagttgccatttcatttttttttctctggaaaccaaatctcaagtttctgtcacaaaaggaaaaaacagtttgaacgctagactcgaatcttgggcgaagaagtcgtgaaaattcggaatctccgaccaaccgggtcaaaccagacgtgctcttaacgttcgtttcgtccctcctttgctgctactcctggctagaaacatgccagctgctggtattggaaaccttcaacgcagatgagcatcgaatcagttgagctagtaagcacaacagctgctgcttccttcaggcttcagtgcaataatctcgagtgggactacatgtctctgaatgaatgtcggtggccggtgaagggaattctaaccgctggctgaacgacggagtcgaggagattcgtggccgtgtcatcgatctcaccggcgaacgcattgcaaccaagcgaaaccaacgggcagaatgcagtgggcagctgtgcacacgcatcaatctgaacagcaaaagcatgcaatccggccaatctgtcgaatatatgccctgcctgccttacagatcgataacacgtacgcacgatggtttcgatgattcctctgcaggagatctaagatgatatgatactggtattacctactttgttcgtcccgtctctttctaagatattgttattctccccgcaaaaataataataataagatattgttattctctcgccttggaggacgatttggatgctaattcctcccccattttccgttctcgtttccttgatgggccagctgatatgggcttgttatgttcagttcaatagaattagttgtccagcccactagtacagataggcagtagaattttagcccatcgccccatccagcaagcatctgcggcctggtcctataccctttctttcacttttgtccacgatctaggaacaaagaaggtaggatatggaaccaaagaagaatatccttttaaaaatgcagaatggctataatt

SEQ ID NO: 65023 - DNA, 11468 bp, Oryza sativa
  unsure (1)..(11468): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatcgaaagtttaccttttttattttatagcaccgaaatataccggttcattaatagtagcacctaaagttcaccctattctcatttttaacacttcatatcgtgtgtgtagttaggtcaataacgatcaaggcggacggaaaacgatcaagaattgacggaagtattaaaaataggaattgggtgaactttaagtgctattaaaatgaaccggtatctttcggtgctataaaatcaaaaacataaactttcaatgttatataaccaaattttcctattattatctttgtgtattgaatgaaaaaattatttagcagtttattggaccactgtttcccccccttttttttcaactcatgttttatgtgattaagcagtgggaaatagccattgcgcgtttccattttgacatctaccgttcaactttcaagaacaccacctttctgcatatgagccacgaattgaagcattagtaggttctggaaaaaaatatataaaaagatacgactactccttgagagccagtacaacagcatactacaagtcagctgtaaatacatatggagaaaaaaatagaagatagagaagaaaagcgggctacagatttatagccagctgcagcacggactccaatatatacattatgtgtgtgtgagaggtgggaccatatattaatgttgtagtatatatttataggtaactattgtattaatgaactattagattgtatatagatgtattagagctaatagtacattaaacttgctctgggtagtaacacaaaacacaaaagagcaacactgattaaacaaaacggagaaagtacgacgcaaacaccgattagtaataaatatatacaagagcatttgacttcactctcgcttcgatcaccatacccaatcccgttgcccataaccaccatcacaaaagtagagtaaacaacagaaactcccgaagcctcaccctcaccctcacccaacgacgcaaaccgtgaaatacgtgccgatctgacgcttcgaggagatattctccatgcatgccagacaccgacgaatgcagaactcagatgatggaagcgaacaaaatgatgaaggcgagaccacaaatcacgcgtagggcaccaactcagaggcggcacatgaagacgcagacacactcacacacatctttcctccaactcgctctttttgtaatcttcctggtgcaacttgaccatccagtcacaggaagaagtacttcctccggtacaaaatattataatttgaaacttatttgaactacctctatttatactatttgttattttacgatggatcaaattttatcttaggttgtgtttagttcagcacaaagtttagattttggttaaaattaaagataatatgactgaaaaattatatgtgtatgacatattgatgtgatgaaaaagtactgaagtttctaaactttgtatctaaacacagccttagattgtaatatttgtcgaccgagaaaatagtattactaccaagaatactgatcgtactgctgctccatccatcaatccccggccaaagaatccaatatcccgaaagctgaactaaagcgttgacgacaccacaccgtcgtcgttgtccccctcccctctgcatcgtcgtggttggcccgcaggccgcatcacatgcacccacgctgcgcacgctggctggagacacgttttcgcctaggtttcaaccccacgaatggatggacgagccccactgccgcttggtgaggcagccgctgcgtccttcgtgcatgtgaaacggaggtttgggcgtgagctcccccggcttgaccggcggcggcggcggcggttgctgagaccgacactgttgggttgggttggttggtttgttggtgcggaacaggtgggatcgctgtggttttttcacgtagtgccgagcccgaaccccgtcgtgccggcaacatactactactatgtgcagcccctgcttttgacccaagtgacccaactacggtttaattaccaggagacaccgatataaaagatgcaggttatgtgcccccatattcctttttttccgaacacaggtgtattgagaccatatggaccgagattacagtgttgcgacgcacatggagagacattcctaaatggaaacagttttgagtgacacataaatattaggatatcccaggatcttgtagtaccacagaatcaacagggtttgagaaagggaaataaacattgcaaaaaaagaaacgtttcagagatctctcgtccccaacagcgaaaaacattgatctctcactttcacgctctcattttttttcctgagctaagcacacaggtaatcattgggggaggaccccgcagtggagaagtgtgaacagggttgcgtgataacttttgtgggaagattctctctgcgaccccagaaaaagagaagggaataaaaatacatggtgcttttttacgtgtaaaatatttatcctcctcgatgcacccagcagatcaggaaggcgagtcaaaggggcccctcaacaaaccttattttggaataaacaccacgctcctgccacgcttatactaatactcttcacggtcagtgcttagtccactaccctttacgatctttgacaaatgttcctacttaattttcagtttttcacatgtattagtgcaaaacgaaaattataggggcaattacaaatttaccgttgctttgaattgttattacaagactaccactaaagaattattaaaataccactaaaattgtcattcgagagacatccttataaaattgaaaaaactggtggcagatttgcaaataccctaaaattatactgctgattgaatgcatgcatgcacaactcaatatgacggacacgtcatgaacagtgaattcagtgtctatacatgccatagtacacagtttggccgctagctggatggtctagagaaaggcagagtaataataaactttactgaaatgcttgtcgatcactgcatatcgccactgaagtgtgctctttttgcacccatgaatgttagtataacatcatctcacgtgaattgacttggagcgaaaacattcagcatggcacnnnnnnnnnnnnnnnnnnnnnnnnnnnnnnnnactcattatcacctcaaactagatgagatccaaacaagatcttgactgagaaaagccaggggctttgcagtaggacagggcagtggcccagcagttcttccaactcccaactcagatcgatcactttctggacaaaaagagagagagatagcatgcaggcctcagagtagaaaagctaggttttgatggaccaaagatcactttcagatcgataatcatgcatgttttctcggtgggggcaaaagactgtgggggcttgaaaatgggagttgtaacagccaatcagactccaccacttgcatacacacatgcatgcatggttggatatatttatactcctttggacaagggataggcagttcagggtcaggtttacgaccgagtcaaattggtggatcgatccagtcggaaaagcgaaaggcatgcacggtgaaaccgagacattttgacggtttggcatttgggtccttttgacgacgtacggagtatatcacaagtggtcgctggaaaaatggcgatgtgcatgtgccacagcgttgttgtcgttgaatactgtagtttttctcgcacggcacatgtggcagaggctggaaattaagtatattgtaagcctctcctagaatatggaatggactcgaggtgataatatataatttagcaacatattgagatgttttgtttgcatatgtagagagaggctacaagtttagcctctagcacagagatatacaaatgcctggcttgaagcaataaccctgcaccgtttcgcctctggatatgtccttatccattcgggcaaactaagtagtagtagtataatgtatattaatgtataaaagagtaatgtatttatacaggcagagagataagcataaaaatactgtttacagttgaaacaacgtacgtatgcatggcatcatgctcatggcagggcaggaggtcagtggtccaagagttggccagtttgacccggttaggtctgtctaaccacatcaagtcaagcccatatgcaataaactattcccctcttgttgattgtttcatgccgtgcaagcatcaagtaatataaagttcctatctatactagactagtgctacttggtaaagctaagcttccagagagcccaattgtatgcatgcctcccacaaccgaaacaatcgagaagagaagaagaatcaccgtaccgggtcaattaactaatcaacggggaacacacattggcgtaggattgaagctaggtgattatgccgcgcgtgacgaacagtagcgaaattttatccaagttgctagttgatctaaacatgatacacatacgcaccactttgacactttctcgtcgtcgcatttaattagcgccgaataagtacaaaggttggagttgattgcggaggcttaatccgctcaccccgagtgatcgaatcggcacgcaccggctggctatcttagctacgtactccactagctggtgaatggtgatacgtactactacgttggccaaacctatatatagctatcttagctagccgcttgcggtcgtcactacaccaccgtggctcgtcattcgttcgtggccccggtggtaaacatgtgttgcgtgcgcgtacatctctcttcacatgtgatgggggaatgaaaagaaaaggcatggaaatggtaggggcagtttgaacccaaattaaacggccggtctctgtggctggctagtcattccgatggagcctaacgtgagtaggcacaaacttaagtacaccaactgtcgcctagaatccgtttttacacgcatgcgtttggctatctgctccgtatctacgatgatgcggccactaagagcacccgcaatggtaaagtaaggtgttatctataaaacatgtactcccttcatcccaaaaaaaaaaagacagaccctggttccagtgtccaacgtttgaccgtccgtcttatttaaaaaaattatgaaaaaaaattaaaaaaataagtcacgcataaagtattaatcatgttttatcatctaacaacaataaaaatactaattataaaaaaaattcatataagacgggcggtcaaatgttggcacggaaatctagggtttgtcttttttttggaacggagagagtacatctcagcaatagactagattaatagtaaactacctcaatagtatgtctacatgggtatctatagctctctaatccattgcctcatttttctctatagactatcttcaagttagtagatagctttgctctctctcttcatttaatctcttccaagtagaaaaatatgctgacatggattttttagagagtctatagataaccattgcggatgccttcatagcctagtccttgtactagtagctacaactactcgtgtgatttcatcggctaggcgtggtaactctagtactactactctaggggtacggttcggcagatgtcacgttcatcgatggatatcggtgcgccgctagctggctagccgtgcaagactgttccggtgtggcggatttaccggtgcgcgcgcccgacgggccaggacgactcaatagatcgaatcgaccgatcgatccccccttatctactgcttgcatcaccgtgccatgccacacacccgtgcgcacgccgtacacatcacggccagcgccgatcgagaactcgctggcatgaggcgagcgctagctgcgcgcgcgcgcgatcgcggtcggcgtacgtccgtccgggcggggggagagagggagacagccggatcgcgacgtggatcgggctcgcgcgagaggggaggacgtgcatgcggtgtagcgggcgccgggcgggcggctcgatctgctgtgtcgcgcgcgggtgtgacgccgatcgatccggccgtcggtgtcgcggccgtggaacgcagccgcgcgatcgagctctcgtaccgtaacgtacgcgcaccggccgcgtcacggtcaaccttatcatgctggagcctgacaaagcgtacgtacgcttagataactgcgggaaagggaatggttgtatgtatcgatcgtgtggggtcgcggggtcgtggctctggcaaatacatacgtactactcgtgtagctataacacctgtgaacctgtcttccccggtggcgtacgtgctacacgtctccgtggctacttggttctctcctggatattttaagtctaccacgctctgctaataaatacatccgtcatacatgtagtacgtacggtttgttataagtagcttgtgactaagacttggaaaagtccctataagctaattaaagaacatactgtgtcatcaaaagatcgaccttagctaaagccgctagctaatactcctacttgtaactggagaaacctcatgtattgatgcgagattttagtatgatatcaaaaggtaaaaataatgtctaagatagctacaaaacgtacataaacttacataatttgatatggcttataataatgtactagcaaaatgcccatgcttcgctacggtgtattaaaattaaaaatatttgtttttaaccaaatttatttcaaagtgatttggtaattttgcttgctagaaatagtctcaaatgatagaaagaaatatagtaactcataataaattattatacaatagtgcgttgcaacgggaaaaactaatgttattaacttagtaaagtaatagaaaaatgagcatccacgttttctcttatgatctagaaattctcatattaattgattaaaatataaaaataagcagaactcattgtagataaggactctttcatttttctaaaaaaaatcacgttgtccaatcggattatctgcataaaacaaatcttttgccaaaaaacctaaactggatagattataaagtataaattataaaataaataatattggatgagaagtctagaatattctccaaaagagcctggagtacatataggaatacaattgagaaaaagaattaaaattcaaaataaaaaaatattgaaagaagagtttagagtccatatagaaaactaattagaacaataaaaaaaataggaatattggaagaagaatatagtccatatagaattaaaaaaattaatattatttaactttagtataaatttaaaatctatatcatgacaaataaataattatatttttagtaaaaaataaatccatatcatgagaaaaatctagacaaattttttgagaaaacattgattttagtcgcgacccatttggaggcccaatagtccggcggcccgatgcgggagaagccagagccatccgatcaaatggacggtccggagccctaaacacgagcagctgcggcggcgcccttcttccctccccgcgagcggtggcggcgacggagccgccggcttcctcctccccgtctcgcctccctcgccggcgaccactccctccgccttgtctcgcctccctcgccccctcctcctctccctctcgcctctctcccgcagtggatatagcagtggtggtggtggcggtaggggcggctccatctttccctctagcctccctttcaaggcagattcgccagcggtggtggcagcggcggccgcggccacgggcagatctagtggcggcggctccctccgccctctctcgccttcctcccgcggctgatccggcggcgtccgctggtggatctgtcagcagtggcggtgaccacatccaccaccacggcccctcctcctcgcgagagctcgtcggggcctgtcctctcctactcccctggccggtgccaccactctcgtccgacggcaagctcgatggcggcggtgcggatctgggtgagagttcatcgggggctctcctctccttctccctggccaacaccccagttgaagatgacaacaattttcccctccaccggatcgagtgtatatgtgattttctccttctccgactcgatttctctttttttttctccttggattcaatcggtcttataccataaagttgtctcttaagacccgattttttcacatgattgggtttaggaggaaatttgggttagatttgatacgaactctggatgatatttgtcgtgattgggtttttaatcgatctttgattttgtgatttgcccgtatcgatctctgatttttcttttttttttttgctttgactggcatacgcgatgaacgcagtgcgcatgcggggacagaaggtgctgcttagtcggattacggacaaaaatttattgggtgacgattggattttttagggacttttagatcttggatctaatgtgttcatgcttccgattcggttggcttcttgagtggaaacgaacattgagatggacaaaggatttgcaggggtgaagggcaacagaggggaggcttgcctggtaacggacaaaagcgggctgagatggacgaaggcgtaatgtgatgacaggaaaaatccaaatatttgtattaagttatagaaatagtatataggatgatagattatccaaatgtaaaagtaagatgatgatgtggttttatgatagaagaaaatgagaggtattttgatccatagattaatcatacaagggctaaaaaaatttgaagtgatatggcttaatgagagaagataatttggatcacaaattaatcacctaagggctaaaaacaattgtgatatggcttaatgaggtaagaaaaaaataacattagctaagtgaggatggactatataggtatataggatattataaaaacgatggagatacatattaaaatattctgtgaattttgtgtgataatatgacttaatatgcttgtattttaaagctctaaaattcaagaaattatagataatatagcatgtttaagatgtaaaatttattagtggacgatgatgtggtagttttgcatgttaaactttagaatttagtggattataactttataataaaataggattgatactaatctatctatctatctatctactattatattattattaaaatagtcttcaaagaatgcatcatattcgccctgaaagctacaaattctcacattaataaaaaataaaaaaaaatttaagtaggtatacaatctagaaataactaaaattcaaaatttaaaataagaaatatttaaaaagagctcatataaaacacactacaatattaattatattttaaatgaaaaataaaataaattacgaaattacaaaaggaaaaaaaagtcaaagtaagagtaatgaattcagaattaaaaataagaaatattacaatatcagccgatatagaagacaatgcgagattaactaaaatttttttaaaaaataaaataaacacaaaatagagagagacagagagagagtaaaagatagagttaagtgggaacaaaaatttaaaaataacataaattcggaagaaaacataagaaatactgaacaaaggtcaatctagaatacaatacaagattaattaaaagagtaaatttcacaaaacctgaggttttggggtatccgttacataaaaccctagttattgtgatttgtttcataaaacctcacattttgagtcaaaatgtttcgagaacatattcatgtaaaatactcatattttattattacaaaatattattttttacatcaattcacattagttggctaaaaggacatattcttctcgtctactttttttttctcaattttgcgctgaaaaagcttaacaaaatacctgctgattataatataataataggttaaatatagacataaatgaacaaaacatgattatcaacgcttgttaaaagcaactaacattatatatgtactaaaaagtatctcatacattctttttacaattattatagataaatatattagtcaaataaacgatgtaagtttgtacctggggttttatcaaacattttactctaaaacctggggtttcattatgttacagaagccccaaaacacggggttttgtgaaatttactcttaattaaaataaaaaaatctaaattataaaaataaaaataaaagttcaagtcgaataaaatatagaaataaccaaaatttgaaataaaaataaggaatattgaaagaggagctcatttcgaacacaagacaggattgattaaaattcggaatagaaaaatattattatgtcagactcagcgaggcccaccgtatatcaagtcttatgcataattaagcctcatgcatagaatgtgttccggctaagaaagaagaaacataatcctacttggtcactataatgactactcaaatcatattcatatatgtctctctagtcctacttagacaaggagacacccgagagtataaatacaagaccctctacaaggagggggacgtgtgaagacacgccgatacatatatagacaggacaagcccagacaaggcatatatgatccataggcgccacagaggccggtgaagtgggatctagggcaaattccaatctcgctgagctcctgttcgaggaagctgacaacagctatccatcgaccacctactcgagcttcatgtcatcaggctgacagagattagattaggttaccctcaatattgtactggtgagatattgatatacaaaggtaacaccgacttctgccaacagtatcagtatgctatatctgttagttatgggggtaatcagtataaaaatccatgtatcaagtctcttttaccgcaatcttgtatataccctggcaccaacgtttcccatactctataaataccgtagacgtatatagaccctcgacacaagtatttttgagggagcaaacaatatcaagatagtgacctttttaattagtttatagagtaaaaattcgatcggtccttgaattggaccaatgtcacttagatatgtaatcttgtaaattgctcatctagtttcctaatctaggtttaatatattacagttggtataaatcgcttttaactaggcacgactacatatgcggtgtccacggggctgaaactttacatttatgctctcctgtaga

SEQ ID NO: 65024 - DNA, 1663 bp, Oryza sativa
  unsure (1)..(1663): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggagaagtcgaggagggcggcagcgcagcattacctagaatccaagcccgccggcgccgccggtgttaggatcaattctggcggcgacgaccacacgcggcctattaggcctgcacatttatatattgtttcctgcagatgcagttggtagtaagacaagtgctagaaatttgtcaagttaggtgccaacacctgaacttgagttcccctgcaatgaacaaggtttggtcgttgaagaactgaaatgattgacagaacagatcatcaaagggaaactggagcatcatgccatgtttgtacatggctgcaaatatgttctgttggggataactaccctaacttgaatttattttcctttcttgatgaatcctactctctcatgtcccaaacacaactttgatgtcctaaattataatgctatcaggaaagcaagtgcttttcgagccaaacctactcatagaatttccatgtatcacccatttataaacaccaatcctaaaaagttttagatgcttggctagcacatctgtccaagacaacatgggtttatggctgtacaacaaagcaccagaaaaaaaaaatcaaccattgctggttggttggccgatacagatttcagtaggtagaatgctagaatataaaagaaagagccccaaattccatggcagagagccacacaaatcaacgcacgtgcaccacggaggagtggtccttctcctggagcttggagatgacgaacatgtacaggtcgcgcacgcggcgaggcgctggtagggcacgccggccgcggtcaccgcttctgcttccttcgcgtcgagggacgtccgatgtgtgcaagcagagcgaaacgattttccccttcaatcaacgctagcagcgccaccgccgcctgccgggagtagcgataacccttttttttaggagtagcgatcggacttgatgcgagcgatcgagacagagaaatatcccatgccaaaattacccctaatctgtattaagagattactaatctaccctttaaaataaagggtcgagattaattctacttgtagtagaatactttaagtagagagcaccggatagtggactattgagtgctctgttttagattaaactttacactaccagatgacaataattaagatgagaggttgattcgcatgtttttgttttgcagtacaagaacaccaccgaagcggccgtggacgcgacgcgcatcatcctgcagcaatgcgagcgatcaaagacggtgaagcggatcatccacacggcctccgtcaccgccgcctcgccgctccgggaggacggcggcggcggtggctacaaggacttcatcaatgactgctgctggactcctctcaacttctcccaccgttacagcaatgccctgctggatgtaatcatcta

SEQ ID NO: 65025 - DNA, 893 bp, Oryza sativa
ttcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaagatcactacaataaaatcctttattcgtgatggatgataacctacataatgtatgcctcgtcggtgatcactagtaataagaaaaatatcaactgttacaagtgcggacctgtcagagatgactatatctcaaaacagtccaaaagttgtgatccgttgatgatgactataacccaacatttcctcacatctcggatcgatctgcgtttacgaatattcgagcaagaacgaatttgtcgttcattcgtttcttaccgaacacacacacggtatacccatgtgtataaggtcaagcaattcacgaatttttgctacacatcatcacatcagagttctcccaacctcttcgcgcattccacactgcaatccagcgtctcctccaccccatacttatacttgaaccctaaatctacaagcttcttggtgtcagcttgcaccctcaccccctccccaatgaccctgagagaga

SEQ ID NO: 65026 - DNA, 4622 bp, Oryza sativa
tcttattacccaaaaaagagaatgccttccgtgtaggtgatttcagaccgataagcctaattcatttcttcgggaaactgctctccaaactactagctaacagattggccccgagactacaacagatggtatcagcaaaccaaagtgcgttcataaaaggcaagaacattcaagacaacttcctctttgtcaacaacatggtaaaagagcttcactcctcgaaaacgccggcgattttgctcaaactagatatagccaaggccttcgactcggtcagttgggcctacctcgtagatcgactaaaagcgctaggctttggtcatagatggattgactggatcatttctatcctggcgagctcttcctccaaggtgattttaaatggcagggcaggactcagcttcatgcatggtaggggccttcgacaaggcgaccccctatctccgatgcttttcattctggcaattgaccccctacaaaaactcctcgccgcggcacaggaagaagacctccttcaacctctacaccgacgaatagcaaggtttaatgtcgccttgtatgctgacgatgcagtggtcttcacacggccagacaaacaggaacttcacacggtgcacagcattctacaacatttcggccaagccacagggatgatcacaaatctaacaaaaagtgaagtctactccattagatgtgagaaccttgatctacaggacatcctagcccctttcccagcacaacaaaagaccttcccctgcacttaccttgggcttcctctgcacatcagaaaactccggaaaatggatgtacaacccttaatagacaggttctcagcgcgactaccaaaatggaaaggaaaattgctaaataagacaggtcgctcagtcctcatcaaatccactctgtcggctctaccaacctatcatctcacggttttccctcttaagaagtgggcagcgaagaaaatggacaagatccgcagaggatttctttggacaggcgccgatcaggctaatggtgggcactgcctagtgaactggaaaaaggtatgcaaaccaaaaaatttgggcggactaggtataactaacttggagttttttagccgatccttgcgtcttaggtggctctggtatgactggaaagcagatgggaaactgaaagttcaagtgccattgatttggttttgatgattaataacaaatccaattatgtgagactaatatttttataagcatttttttgcctagtctcatgtggatatgaaagtggagtgttggtggacctaaatcacaaggatgaaatgcatggagatcaagctatatgtatcactctttctcttcatatacatattgatatgtttgtatataatatttccacgtgattggcatatgcatgtgagactaatgttttgtttgagtattatctcttatttagtctatttacattgagaacgtggagatgatgaaggtatgtttttattttaatatctatatttgagaaatgtcttctattcttgtataggataagctctcaatgtttaatattttgttatgcatactcttgcttcacacaaatattttgtatgcatacatttagggggagcaaatcctatactttagttatgcatgtaattgattaaagttattcaccttcatttaattgggatctttacatttgaacatatatttgagtatatgacacttgtggtgttgattaatactcatcatttattcatatccttttatacatgcgatcggttggtcaacataaggaggttgacaaccggatcattgggactaataagtttattgagttgaatgaaagaaataggtcccaaggattacaaaagtgttgatgcttaagtgatatcattacacctaacaataccaagaatgacaaagtgaggatattgaagatgtgtgatacgaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccatgagggactatttgaagctacaagtaaccgcatcaatcatttgaagaatatatggtgaaacggtatcggcattggtctccctcaagacaatgaaagaaagataaaaaaaaaggcattcctaatagtataattatcttcttatgtacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttcgttgacttgggtagtcctctgagtgagctttccatagagtctaagttcataaaaaaacggactcccgagcgaaaagttatagtcgttttactctgtgcttttcggaaagtccgaaaaattaccggaaactccgataatttttcggacaacttcgaaaatttccggacattccgaaaatggctgcgaatctgagatttgcttctgtaagttttcgaacttgtccgaaaatgcttttcggaaactccgaaaattacagtcttggcctccaacggctagtttttgaggggctcgggtatataaactcctccacccctcctttgagttgctgctgctcttggggagtattagacacatccaaagccaaatagcatccccatttccctacctttgtggtgcctctttgtgagggggatttgagaaggggagagagttggattgagagagtgaggagttgagagctagtgagcttcactccatcctttgtggtgcctctttgtgagaaggatttgagaagggaaaagagttggattgagtgattgagaagttgagagctagtgagcttcactccatactttaagcactcgagttcatagcaagcaaatcttcgattgtgtttgttactcttggggactaaggtctcctagacggctaggcgttgccggtgagcacccaaggttgtggtgtgccacggaaagtttgtgaaggcttcgatttcgcctccgcaagggaagaaatcaagagtgaaaccgaggagtgcatttgtgcaacctcgtgagaaaagggttgaaataggcccggcccttgtggctcctcaacggagacgtaggatccgtggattcgaacttcgggaaacaaatcgcgcgtctcccctcttggtttgcccgttcttgcattctctcatattgtgcttgagcttgtttttacccgatctacttgcatgcttatttgatttagttggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctaatgtgctatgaagttgtgataatttttaggaacacctattcaccccccctctaggcgacattaaggtcctttcagaaaccatggcaaggctccaccctaccatgcgatgaaacggacaagcaactcttcagggcctctacaatcatcacactaggcaatgggggcaagacaaagttctggcacgacagatggcttgatggccaatcccccaaagatctatctccttccctatacaagcttgctatgtggaaaaacaaaacagtggcccaagaactagaaaaccacaagtggttacggccactccgaaggatgaactcgacgaccgaggttcgagaatttatcctgctctagcacttgatacaacaggtacaactggatgaagacagggaggacgatctaatgtggaaatggaatgcgaatggaatctactcagccaactcggcctacaaaattcaattcactggaagcattcaggacaatcgtgctaacttcatttggtgagcaaaaacagaaaataaatgcaagttctttggatggctcatggtccaaaagaaaattctgacgtctgacaaactccaaatccgaggttgggacaacagtccaacttgctccctctgtgggacagaaccagaaacagcgacacatctcttcatggattgccccttcgcgaaacaggtatagacaaacatttggttgaaactaggactcaacatgcctaggtcttcttccttcaatggaaacatgatggattggtgggaagcttgccggagagaaatgatcaaagagcagagaagaaattttgatggcctcttcatctacacgacatgggggatttggctacaaagaaatgctataatttttaacaatgactatggtacagtgtcacatgtggttgacttcatcatcaacatgtgcaaagccttcgatgaagcgcaaatcgcttagatgataaaacgccgacttttgctgttagtggctttgcactttctcaaagtgctgtaacctcctccagtgtaaaatctgaagacacctcttggaggtgtccatgtacgtgaaactatttctttctcctctaatgaataggtagagctcctgccattatcccctcaaa

SEQ ID NO: 65027 - DNA, 10148 bp, Oryza sativa
cagatagaaactcaaaaggtaagtagtatacggtagcaagcatatgtaagtactcccttcgtttcaggtatataacatgttttgattttggtcaaagttaaactggttcaagtttaactaagtttatagacaaatatagtaatatttacattatcaaattagttttattaaatcaataattaaataaatttttataataaatttatcttgagtcgaaaatattactatttatttctataaacgtggttaaatttgaatcagtttgactttgaccaaagtcagaacatcttataacctgtaacggagggagtagtgactaaaagaatatgacgtcatattattttagcaaaattgtttttcttcccttgaaccgcgtgacatgacgttttgagcccgtttggtagagcttcaactcttaaatttaactctaggagtttggtctgaagtaaagttgtggagctgcacaaacccaacttcacatctctagttcattttgtgatagagctccacccaactccactcctattttaggtggagctgaaactgtttggctgggctctaggagaggtggagctggagttgtgccaaacaaaccatttcttttcgttttaatttggtccattaatttgacttccttttgacatatcgaaatcccgatcgacccatccaaatttgtgggcttaaagaaagcctgctttgatggagttcttttttcctatcgataagattcagatatatatgatccgagaaaaaaataaaataaaaagattgagctagatactttccacgcgaggtaacaaaagtcgattaatcggatgtcatcgacggtgacattttaaaagatggactttttatcctaaagtgaacatgtcctgtatatcatttgaaatagttttgattttttttttataaaaatatagtttgataagatatatcaataatcatcatatccctacacacacaaattcattatacctcaacatgttgcttaaaagaataaattatactctaactacaatacgcacaccatttcatgatcgtatttttttttcaccaaatttaaacttgtatgccgtgaagtaataaatcgtatattaatctgccttgtccttgtccattttgtttaaaaaaattcataactgttttcactgacttgcaagaaatgagagatggtatatatccttaaagagagagaaaaaaaatgctttcactcttttttcttcaattataaaagaaactatttttttcttattattatattgaaagataccacgtgcgcacactagcgcaaccgaaaatagaatagtcccaattaattcccaaatcactagtagtggaaccattttaatactaatccagtacaaacagacgaaccattggaaatatttggaaaataataagatttaagtcaaagaccagtaacccctatcaggacacgacacgctaaaatgatctgatcgagggcttattttaagccagatagcggtggacgagccgacgaatcagctgacaaacacgtcctattcgagcccgatatctcttgatcgctttccctctagttgctgtcagccaaactcagactcaaccaactactgcactagacagtcaaatttaatttgaaataatgcacaaacttagcaagatttaaggagaaatttaacacaaactcacgaaggacaaagtggacgatatatatgataatggcaagtgtgtacagtaccttagaagtgacgattgacaacgctgtattttttttggacgggagagtaagccctgtttattttccaaacaaaatttttgactctatcccatcaaatatttagacacataaatagagtattaaatgtagaaaaaaaaccaattacatagttcgccagaaaattgcgagacgaatcttttaaccataattgtgcaatgatttgacaatatggtgctacaataaatatttgttaatgatggattaattaggcttaataaattcgtcttgtagtttcctggcggaatatgtaatttgttttgttattagactacgtttaataattcaaatgtgtgtccgtatatccgatgtgacatgtaggggtaaaattttttgccaactaaaccagctgttagtactactccctccgtcccataataatatagtgtatcacatccatctatccagattcaatgtgtcacgttcctctaaaatctcttacattttagagggggagggagtgctagtttgttctcatcgtattcatgactgttcatgtaagtacttcatgctagttacatgattactcgcatgaacagtaacaagttgtcctaggaatctaggacgcatgccgtcagttcctgcatactatgtatatacaacacagtgtactgacaaagcagtcacgaggttgcacgccgtcgtgagctgtaaactaatctgccgatcgaccaatcgacgaccaaactaattaaccaagggatcgatcgatcgatcgattcgaggcagcagcgcacatgttgatttatacgcaccttggtgctgctggggtcgtgctgcagcggggtggcgatgaggaagacgaactcgcagccggcgatggcgggctcgaaggtggcggcgtcgtacatgtccgcctcgaacagcaccagccgctccgccgcgccgggcatcctcctcagcagcgccgtcttcttctcatcccctgtacgtacgatttcttcagatcagcaattaatccacagattctgaatgatggatttggcgatcttagcagctgagatcgagatcgaggtcgatggaattaatcatggaaaagagagagagagagagagagagagttaccgagatctcgcagggttgcatggacgacgcagcctctgccgaggagcttcttgacgagccatgtcgcaatgtagccggcggctccggtgacgcacacccggctcatctctctctttctgaaatctgaggctcttgctggatctccagtagtcaagctagtgagaagtcaaagcttggaatgggggtcttcactatggctctctctctctcctctatctcttcccggccaatttaaatagtggcgcacctattgacttaggctgtgtttagatccaaaatttagatccaaatttcagtcattttctatcacatcaacatgtcatacacacacaacttttcagtcacatcatctctaattttaaccaaaatccaaactttgcgcagaactaaacacagccttacagcaacacatgcatgcacgttgcaatctcctagccgccgcacacgccattcgatttctcttttgcaatttttataagacaaatcacatgctcacgcagcctatctacaccctccgttccaaaatatagctacatgtatgtttatgccataaatctagatacgatatcttgggacggagagagtattcattagaattaaataggctaggtccaatttaattctagtaaatttcattggcacacaattaatattagaattaataagatatggattttcatcccttaaggggatatccactcattgtttgcatgtcatctaaaaaaagttatgaaaaaattgaaaaaaaattaacaacatagattaatatgaaatatatcacccataaacatgcaagaccaaattcaacttctacaagttgtaacaaaaagaacaaattaaactaaaaatagttatcgtacattcccatctatatttgttatttttgttacaacttatataagttgaattttaactatcatgtttatggagtgatatatttcatattaatctatcttgccaatttttttgatgactatttagataacatgcacgaaacaaggggatatcctcttgagggatgaaatcactttcccggattaataccgtcttggaaaccagtatggagggaactcgacttatatataatgctaattgagagcacttattgagcggttgatgaggtggtggtgggactgccacacgccctcgccgagccgagcccatgggcgtgagtgtggcattttttctattcatctccctggttcttcctctggaacacaccacccttctgatcctctgttcctgagcagcttacgcaatctccggttctgagcacatgcgggcataagtgttcgggacgcaggcctccggaactccgttcacatgagtacctgcacgggtaagcggacgattaagtttgtagtgagcatgaagaacgcgtgattgctcttggcacttcttcctctatatcatgttcttcttcctctatatcaataatcgggatcgtgtctaccaccaatggaggaggagacggtaacggtgatgacaacaccatcacgtcccccaatgcctctagatctgaagcgttctctgggtacgtcactttattcactttagtgttgaacatgttactagatgatgctatttatgatattaacatgttcatggttagcaatataacttgatgacactctttttcgtatgccatgtttgttatgttatatttttggattaaaatatgctaaattatgactagatttttctaacagtatcttctatgtatcatcatctgtatatttgtcatgtctgtatatatacatggattcatatttagatatagatacagatatggagatatctaaatctaaatctctatctatgtctacgtctacttcctgatggtatcctttgaagaagagtggcatgcctcatatagccagttaattataggaagaatctataaaatattcgtaagtttctttatgaaaaacttttaaatataattataatataattacgatgtaattacattataactagcatgtaactggatgtataactacattgtaagtagcataacataatcaagttatcgttacaattattagacgaattaaactaagacagcatatagttaattttgtaagaaccgtgattatataaagaagaaactgctctagcaatagagaatatcgaccgccgtgttcttaataaaataactgcgggaggtctagaatattgtaaaaatcagaacaagacatatgttctattaaaaaatatcagaagaagtaaagactatagtttaatctataatttataggtaaaaattgctgttggacattcaaactttatgggtttaggtacaggtataggacattgtagaaaaagatctctagaatatgacaaccttaaaactcgaatgggttatgcccataattatattttctcattgccggtcatcaacataagagactataagccaactataaacttatatgaagaagagagaagtataaaaatgaagagagttagctctcacgtaagagtgagctattcacacatttcaaaataaatgtatttataatacataggtgagagaaagatatagaagagaaaaaaaacttagacacaatcttatagtttgtctaccatacatattaactgtaatactataagatataaggttatagttagctttactatttaacttgctctgactgagagtttggttttacctgatcaactggtaaagcgttcagtatttttgtattgactccgtgactccatgcggcaaggttggtttggtctagtctggaggctggagctgcccggtctggtattggtggaggcagttggctgcggtctgtggccaacgttacgcttcgatggagacaccgtccactacgtcctgtccactggctaatggcgcctagacaggcagtgcacaggaaaggggaacgatggttttggacttctggctagggtcggagaagagggcaaactttgctacatgacactcaaattttatgtaatttgctagcagacatcgtaaaaacgtattacggctgaaagacactcgaaaaaactggtaatttgctggagaacactctcagctcatttggagagagaaattcttcaaaaagacaagagtacccctagggtcaaaatctttttgcgctgagactagaacaaagatggaatataatgtatgctagtgaagtacttggggagatgacaaatttagatttgcataatttctaaatttttactctaacatcatgtttgaagaatgtgatcataggggcattctcgtctttattaagaatttatcaattaaattcagccgaaagtgtcctccagcaaattaccagctttttagagtgtctttcagctagaacacgtttttacgatgtctaccagcaaattaaacaaaatttgagcgtcctgtagcaaatttgccaagaaaactccgagtctctaagttttcatgggcttttgtggcccactctatccacgggccgacttctgggccgcggagtgttctttattggtagtagtagctatttatggaataagttcacttgtggtcctttaactagtcaaccaatccgattttcgtccttcaaccagaaaaccagatataacgggtctctcaactatcaaaaccggtataaactaggtccctgaacggtttcgatggtggttttggcagacgtggctggtttgacttggtccttgccctacgtggcggtgatgtggcactggaaacaaaatttaaaatttaaaaagaaatgtggggcccacatgtcagtcagataaaaaaaagtgggacccacatgtcagtgagtccaaatcccctctctatgcacggacgacaacgcgtcagcacctccttctcctctcttcgtctcggcaatccttccttctcgagctcagctcgccggccggcgaggggagtggagagggagaagggcggcggccggtgagggtggcagcccgcctgctccctctccgcgcatcgcctccctctccccgctctcgccgtcctccctctccatgcgcgcttgccggcttcccccatatcctccctctccgctcctcgcgcctcctccacaaagcagcagcctcctcctcgccagccgccgacagcccaccgccaagtgcgggcaagagagagggagtgggcatccgccgccgaccgcatctagcgctgggctcgtcgtactccggcgggagcggctcggacgacgacgacagttgtagggatgactccaacgaatctcccggcctccctggcccctcaccggtagcgggggcggagaaggatgacgagagcatgagaggagggcggcgacgacagggtcctagatctgcgcaagatcgggactggacactgcggcatcgttgtcgtcatcctcaacttcggaaggggcaccgtgagcttctcttcgttgtccgcaatccttgccaatcaccacccttttcctgtctccttgctggccgccacccactgtgcatctctccctccatctgttaccgtcaagcccccacccacggcactcggccatcgccgacctccttacgtccttcctccccgaccgtctcgtcggttgccacacgctgctccctcatctaccgtcgggcgccgctggtgcctagagagaggagagggtgagaatgacatgtggggcccatgtgggatccaccaatttttaattaaatgtttttgtgtaactgacatgtgggctcggtggtttttattattttccaaattaaattgcttggtaagctccacgtcaatgccacgtgagatgaagaacgagtcaaattagccacgtaggcgccacgttagcgaaaaccgccatccaaaccaccttggacttgttttgcaccggtattgatagttaagggacatgtatcttgttttgcggttgaaggacgaaaattggattcgttgacaagttaagggacctcagatgaacttgttccactatttattggtttcacattacttactacctgatatgaagattaaaatattactccctccatctacttttgataggcatatttctaaatctgaaaattttattttggcaaaatttgctacaggacactcaaaaaatgtgtaactggctgagagacaccgcaaaaacatgacacggctgatgggcactacaaaaattatgtaattagctataggacaccggatacaatattttataatttatggctcaaatgaggtgagaaatttttcgaaatggcgaaattgcccctggcaccatcttccacacaagattttgaaaattttctcacctcttttgacctggaaattataaaatattgtctccggtgtgctatagctaattacaccatttttatagtgtccaccagccgtgtgacgtttttgcggtgtctctcagtcaatttcatattttttgagtgtactgtagcaaattttgccttttatttttgataggcatatttcaatccaacaacctatcctcttaataactttctcggattcaatgcgtcactctccattcttccacacaagattggctatatgggcatcgagaaatgtaataattaattaatcgtttgtttacgaggaataactagtagcatgtttagatggatgataagtataattacttatccttagtctgtgtgccaagatgaaatatgactattaaaattatataaagggagtacatattaccttagcacattatggatgccctaatgggtcttacctattttttagttgtgacatgactcatgtttatggattttttaggtggatcctatattattatccactctacacatctgacacgggctcaccttactatatacttttgcaacaaacattgtcacattgaggatgccttaagagattttgcttatttaaccatatgtaactgtatgggcaaaacatattatattttgggatggagctagtattaactataacgataagacaacgttagggtgactagatgcatgtttcctctgaaaacagctgactccctgtttctcactcttccccaatgatattactaggaaatctgtgataactactggttgctagaaatatgtggtttagaaggattcatgctgaagttgggagcttacttcgtccctgcatacttccacgaattcgaaatcgagagagacacgcatgggataggggttatcaagtcagtcgcctgaggtgtcgacgacagattgcgttgggccggccatcctcctcgagtgtacgagtgtatttgtgtatatatgacggaaaaagtacaccgaagtccctcaacttgtcatcgggatatagaaacatcctcaaaccacaaaaccagatatgcggggtcccctaactatataaaaccggtcatcggaggtccctcggtggttttgaccccggtgttggtctatgtggcggctgagtcagcgtggaacccacaggagacccacatatcaggtgtccacgtcaccctctctctttccctttcttttttctcttcttttttttacttctctttgccggcttgccacgggtgagtagcaaggaacgggcgagcgcgcgacctgttccttgctactcacctggccgcgtgctcgcccgcctgctgccacccgctccgcgcgcgcctccgcttcgccggccgccgcgcgctcgcacgccgcctccgccggttgccgcccgctcgctcgccgtgaacagcgcgaagctgatgtccatgccgcccgagttgttgtagatgatgaagtacgggtacaggttggccagcagcggcgcatgcgtccgttccaggaatgggatcacgtagcgctcatgaacgacttcgctggcggacggcgggatgtggatcccaatggtggcctgggagatcgacgtcgtcaccttgatgtgtcccaaactagccgccgcgagcgcggcgtggacgttctccatggccgggacgaggagctgcgtgtcggcgccggcgacctcattgcccacgacgacgaaccggaataacaccgtcgggtaggcctggatccaggcggccgcggcggctgtcccgccgtgcgccagggcggggaggtcgtagttgggcgcgcggccgacgacgcggatgcccgtgccgccgagcgccgagagcgcggcgctgtccggcgcgtagaggcgcacgacggtgaaaggtagaaatcaacagggctcgtttagccaacacattggctaactactccttgtgcatggcagtgtagcatggtgatgacgacgtgtcgtcctccggttggtcggccacgttgccacttgccacaacatgtatagaattagcttaattagcatgcatctgctagcttgttgccgtggtgctcaacagcatcggctcactgtcctagg

SEQ ID NO: 65028 - DNA, 3168 bp, Oryza sativa
tggggatgtcgacagtgtgctccggcgatcttcggcgcgctccagcagggtggcatcacgatggcgcagaggagatgggcaccggcaccggcaccggcaccggcaaagaggagatggtcgttgtcgccggaggaggggaaggggaagggtggcgacggcggcatggcgcgaggcggcgacggtggaggctggggcgctgggcagcggcagcggcacagccgccgcctccaccgaccgcacccgcacctccgtcgtcgaccggagcagccgccacaatgccgccgtgttccgtgcttggtcgcggaacggcaccgtctccctcctttgcgccctcggccggagcagccgccacagcgccggccgtcgccggcaaccggacctcctcctttcccgcctcgccccaccggcctccctgtcggtcggccgtcggcccgcgcagactccctgacaagaaagtgatggagaggagaaagggagagaagatgggaaagagagagatgacgtggactgacatgtggggcccacgtgggtcccacgctgactcagccgccacatgtactaaaaccggggtcaaaaccaccgaaggatctcgggtgacctgttttgtatagttaagagaccccgcatatctggttttacggttcgaggatgttttttaatcccgataacaagttgagagaccttcggtgtactttttcctatatatgacccactgcgagcgtcagtctaggactctgatgtgccgaagccacgaattttttttcattttaatttttttatttttttaatatatatataaatattgtaccggcgaaaatatttacagaagtagagggtaacgtgaggaacggacaagatgaaaataaaaactagaaaaatgtatttttggcatggcgaaaattgtatttacctccttgcagcccttgcagaaggcgataagagatctcagtgcaaaatgcgcacaccttgccgccctccacctaggtggcaggggccatttctataaatattttggatggtttaatatttctgtaaatattattagaaaataaaaatttaaaaatgaaaaaaaaaactccccaacccaccgtgcacggcccttcttctagccccattttacctgctgcctcttccatgtctcttctgtttctagatcgagtactgcagtgagcaggggcgccaggcctttatccggattggtcccagttgaaagtagcctttatccgaaaaaaaatagcatttcagcgggttggtctcagttgaaagtagtatttggacgcatcctaattatagcatgatattttagcgaagcctcgttttaactatggtataatatggtataatgcctattttctcgaaggccttagactcacaatgcggctgctaagcagatctgtacgacttgctaaattcataggccataggccacgtatccccaataataatcaactcgtactactatgactatgtactcagtgatggaccacaacaatgggtcagacacacaggacatcattttgtcgtatgaattaacgacaaatgaatataacatataacgtgcatggtgactttatcatcttaaaggcgtcgctctcccctggggcagctcgcaaggccacgacccgtccgccccctctctcccacccctctcctccgcctcgccgtcgcccgagcggccgccgccgtgccgcgcggctgcaaggacggcggcggcggggcttctcgcttcctgaagctcaggcggtcaggggatccgtccgggcggcggcgaccgccgatccgcgccgctcggccggatttgacgagatggcgacagcagctagcaacggggacggcgacgctggcggggtttgcgatgacgatgatcgaggtaagcggttccgggcggggatgtggccgatggtggtggggatggtgatggtggagtcaacggatccagtagtggcgtgcccggttccgacggcggcgtggcggctggcgacctgcaggcggcctgcctcacgtctggcgcttggccggcattggtggtgaggaggacagccggttcaggctaggtccagatccggcgcgtccttagtcgggtcgggggtggcatggaatccggtcgttgtgcaggtggtgtgcatagtgcagatatcttcggtgtgcaggtgatatttggtggcttccgctgtggatgctatgattgagggggactccgaggtgaaagccttgctctagcaacggcgacgccctcgggcgccgttcaccttgttgaaggcgttgctattggagccctcgttcaacgccacttcaaggggattctccgggtgaaaaccttagactcgttaggatcggacgatatcgttgttctgtcggtgtacactactacaaagatggtttttgcatacgggcgagaagggttttcacatgcggttgcgccaaccgcatgcgccaaattgtctgcgaagatcgcgatttttgcatgcggcccgtatcgaagattaaatttttcaaattttattttcgcatacggctccttaagacgcccgcatggaaaaatcgggcgcttaagtgagccgcatgtaaaaatgaggtcatctttacatgtggacctcttaagaggcccgtatgggaaaatcgatttttccatacgggcgtcttaaggagccatctgcgaaaatgccgctcgatctttgtagacgccactagttatggtccgtttgcaaaaattaaggggtcccgtacagaaaaatcacttttgtagcagtggtaaccttcttgaagacttcattttagaagctttctcccttgttgggtgtaacgctccgcttttcgtgagacgttaaaaactaattcggcaaaaatcctaattgcgaaaatttcgttccttgagtgttgagtctgagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttacccacatatctcgttgaatagtcaaactcaaactcccaagttacactctcttactctaaattatccatgcccttttgactcgtct

SEQ ID NO: 65029 - DNA, 30596 bp, Oryza sativa
agttcctccgtcttgaagaaaagatgaagtgaagcgaagattagggtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagagatggtatcagagcattagttggccctaggatcgaaaccccttattaggatggcattatttgagtaccaaaaaaaaaaaaactatttgtgaaagctaaggtgtcgttgtcccctttagctctagttttgcgaaaaatcttttcgtgtccaaaagtagaagctagtcgagtgttttgacctttatcctagagtaaacctgtcttcacgcccagttgaagaaaggtgagctcaagcctctaggagtcttagttaagccctcgttggtaggcagaccctagtaccgtcacccgctcggtgggagttgtggtgaactagtgcgtgcgtgagttttgtttggtagtccgtgttcaggtgttagaccagttgggataccgactggaatacaccacctatgtcttctgtgatttcgaaaaccgttttgatgtagtgtttttgttttccttcttttcttatcccatttctggttcagtcagatctcagtcgctctgaagccaatggcacattgttctatccgtcagatccgtgcccctaaccgccctggttctaaagaagggtcagctcagtcagaaattcccgatcagccaattagcctagcagatgagcaacagattgagaagtgatcatgcagttgtttctggatcaactaatgatgccgcagtacagaaatcagccccccaacagtggacttttgcccactcatggccatgcaaacccagatattacaaggaatgattcagaatatagttgttatgcaacgacaacacacgcaagagcatcaaccccatatggttcaagataattgtcggtcaagactgaacgaattcttaagatctcgcccaccggggttctcccaaacaactgagaccattgaagccaatgactggatcaaagatgtggaaaggaaattaaatttggtgcagtgcactccgtagaagaaaacccttttatgccgtacatcagttaagaagacataccacaaattggtggtataactactgtgctacccatacagatgctagtaccatcatctggacagagtttgcagaagcctttcgcttagcacacatccctgaaagcataattgatttgaagaaggaagaatttgcaaatatcaagcaaggatcctcttgcatcaacgagtatttgagtcgcttcaacggattggctcgatatgccccggaagatgtggacactgataagaagaagatcaaaaggtttctaaaaggaacggaagcgaaattgcgagtgaaacctttagctcacgactttccaacgtttcagcacatggtcaataaagccttgttactagaagatgcagaaaaagaaatgcaggactacaagaagcacaaggtaatgtccttagaggatcaagcaagagaaggtttgcgtcaagagatagacccgccagtgcagtactatcagggagaatctcagtattccaatggttctgattctacgtctcgttcgacaaagtcaaaatctagtcagcaaaccatagtgatcaacaataaaagccttgaaggaagcaattccgtaccatgccctccaccttgaaaaagacgtggttataaggcatgagtcgaatgtttcatctgccatgagatgagacactattcatggtactgtgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaatcctttttctttttctttttcttttttttctctttttcctcctttctttcggatgggccgccggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagagggcgggattcgattttgaatctccccccaccttctctctctcctcccccacgtcgccggcgaaatcggagcgcctcccggccacgtccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacccttcccggccgctgctctgcgtcgccggaataccaccgaaaccccatttccctcgcgtcgtcggtgagttctctctcccctccgactccggccggcgtggatggtcgccgtgggggttttcctccgccctaattcctctcctctctttccctaggtgtcgccgtcgctcgtccgcacctcggcatcaccggtcttcgccgcctccctcgtttttctccgccggccattgccgcccctccggtgaggtctccctccccttcctttccttcttttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccccttgagccgctgccgagtgggcccgtgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcagtgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagctgtacacctctgatcagagtaaaactattcgaatagccgtgcccgcggttatgggcggtcgaccagattcaccgtgattagtttcaccctagttagcttttggaactggttagttcaggtggtggtttgggcctgtggcaacgtggtgtaacgttggacagtgattggttaatatggattaattactacaactgttttactgctttcaactactgctttgaaatgccggctttatgcaaaagaacctttagcctcccttggatatatcgtgcatcatacctcctcttccggtatgacttgctgagtacagtgggtagtactcagtcttgctctcttttcccccacatcagagttgaagtccttctcagttgaagatgtctcggagaggttggtttcgtcgctgccgtcaaggtttgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacatactgccctcagaaagtcaagtcaaagcaagttcaaccaacaacaagccttcccaacgtatctggaccaaaaagttcaaagccaccaaacagtggttctgcctcgttgacctcaccgcctattggacaaagtcgtctgaaccatgtgcaagtagaaacaaagggaaaagttttgaatctcgagcaagttgaaagagcaggtgaagaacagattccacatgcaagatcagagccacagtaaaagggagactgctaagtgagtcagagtaccagaccgttttgtggcaagtatgcagtctcgagataaagaaagacccgcagagtatgaagctaagacgaagtttgaagttccccttttggtttcatgtgtgtggtccaccttcgaatctcggggtcgagattcttgtaaggggggtggatctgtaacgctccgcttttcgtgagacgttaaaaactaattcggcaaaaatcctaattgcgaaaatttcgttccttgagtgttgagtctgagttgtgccaaagatctcaatttaaatccctcccttgtctcgataccctgttatcaaagatcgtctcctcaaaattaccatcccaatgtagtcccgaagctcgattccttctattcggaatcccctcctggaaccccatccgtgaactttgtcgaatgtccgaacccttctattcagacttctctccaaaatccttacccacatatctcgttgaatagtcaaactcaaactcccaagttacactctctttctctaaattatccatccccttttgactcgtctccgaatattgttcccttccttgactccttcctattctcccgagaccgagtatcaacctcgaaattcgaatctagactccaactctaaaatctcccaattaaatctctctgtgaaagtctatttaacctccctcataggttggattccttctttctttttccgatccacctcttccttctcttccatcccatctctctcggagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaagaataccaaaattcccgcttttgaagcccttccttgacccctcccttggatccaccttgaaccctcgtgtacaaatacacaaattaaattcaaattcaatctccacatcaaacttctctccaaatcaaaccttccagtaaaagtctattttgcctccctccaactcgctcgggccgaaaccatcctcggcccatcctcttctttcgccagcctctccatcgcacgtgcgccgcacgtgactccctcagagagcgccccctctctctctctctctctctctctctctctctctcggcgtcgcttcccgccgacgccgcccaaaattccggctgcctccttcgattcccgcgcacccgtgcgagtggccgaccacctgggtgccgccatcgccaccctcggtcgtcgcctgccccgatgaccaccgtgtccgcgcttgccttcaaaccgtccccgtccttttgcagtcgtcgccggcgtcatcctcccgggcccggcgccccatgccgcatgcatccaaaaccgtgaggcgcggctcgctctcatccctttcctcccaaaccggaaggagcaaagctccctttcctcctcctcctcctttcgctttttcccctcccgggtagcgagctccctgcctccactccttggcttcttgttcaaaaggcagagccgctgacgccgctgcagcgcctcgccgcccccaccttgaccgcacccgctcgccccgcgccaatcctcccgtgctcgcggttcgatttccaccacacgatccaccgcctccaccaccctttgcatcctcgccgtagctcgttctcgcggcgcccatgaacaccagccgagcgccgagaaaaccgcggccacctcgaaccgaccttgccgctcccactccgtctctataaaacccaccccccgtgcttcctccctcccttgcttcgttccccccccccaatcggcggagccctgccgccatgggaactcctcgccgtcgcgtcgagctctatgtccggcgacatctcgccgtcgcacggtccgtcctctgccgcctcctccctcaacctcggtcgccgtcgcgcggccaaccccggagcgtcgccgccttcttggtcgccgcggccaagaatgccaccgccgcgaccaagggcgccaccgcacgcctccgttcccttccccggcacgcccgccgtgacgcgatgccgcctcggcgtcgcgttcgtcgccgtgcgccgctgctcgtccatgcgccgccatcggccttcccatcctcaactcgccgccgacgccatcacctcccgtcggtgagctccccacctcccttttccgctgtcccagcactcgcgtagctcgcgtcgcgcgtgctctgtttccgccgccgtgcgcaatcgagagccgccgttggcctccctctcggcgactcctctagccaccgccgttcttgagttccctcgctacctccccaagccgctgtttcagccgccggcctcccctctcgccctcgcgtcgcgtcgcccgatccgccgctgccgcgctcggccacttccgctgcgcctcccctgccgtcggcctccctcctatccttgattcccggcgctgccaccttcctcgggcccccctcgacctccccaacccctccccctggccgccgaccttcctcctcgctcccgcgccgtgccgcccctcccgccgccgcaaggcgccgccgcgagccacagcccggcgaccgtcgggtcccgcgtcaccgcatgtgcgccgcaaccccataccgcgtccactaaacccgagcgcgcgagccgcatcccttcccatcgcgcatccacgtcggcatcccggcgagcttcgccgccgccgccggccgtcgtcacgcgtcgtctccccaatccgagccgtggaatcggttcgccttgacctcctctagccaccggtgttcgtcgctcgcttcggctcgccgccgttcgccggattccgccgcgcgccgtgagccgtccgatgccattcccgcccccctttttctctccccatccgacgtggctgcccacgtggcattgaccgggcccgcccctgcccagtcagccggtcagtcgtccccctccccctctctcccctggctcgtgggcttggcccattggccagccttcctcctcggcctaacaaaacaaaggaagtttacctttactccctcttccgagtccggtgctcacacaccgaagagctaaaagtccgcaattgctccctccaattgctcctctctctctctcaccttcttattggccccactcgtcaatgagtcaaagataatcttgagaatgtctttccaatattccacaaataattctctcttctataaattcagtaaatcattttatcttatttcgtgggttaataaatctttttcccttgatcctataaaacaattctctattccaaaatttcatgaatcattttccttataaatcatttcctttggtcccgcacgtcagagacggtcaataatattcttgagaatattatttctataaatttcatgaatcaatccccccttgttccacaaatatcttccttcgccagaaattctaattaaacttccaaaattcgtatctctcgatccaatcgtccgattgaccccgttccacttccagtatttccataaaattgagatctatttaatggcactattatttagtctaaatagggtctttttcttggtctcttgtttaggtttttgtttgtttgagcatagttgcggttaccggattttcgtcgatcgtggatatcttgaagattcgtgaagcttcgtgaagaccctgagcaaggcaagccacccttgaacatactgagcctatatttgaacttaattatattgcttgcaaaatattatgcattgataggattacacttaatttgtttgccccgtctgaaaggcagaccggtgggcctacccaacttgttgcatctgatccttccattgttaattgttatatcatgttcccttgtaaccatctagttgcgcctcgatattcgtgcactctgtgcgagtatcaacggtcgccttcaaacttaaaatctgagtaacttcttgggtaaaacttggtttgcaaaagctttggaaaacccgacgcctgggtcggtgccttgtgaaagaaaatgagttttaaaaataaaactcgcgacacaaggccattcctgggcggaatacttgtgcggtcgcatctaaggaccgattcctttggaattacatcggagcatacaatagtgcgaccacacgggtggaatgggacgcccctggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcccttaggtcaccagacgtggccattctacacgggctgggtgattcgggttagtaatgtcgtgtgggtaaagtgtaccccctctgcagaggttaacaaactgttcgaacagccgtgcccacggtcacgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggaccactattatcgggaagtttggaaaattggtttggtttgggaaaaaccagatttgaagccaactctgggagttgtgcaaatcttgataaataaatttgttcttctcacctcccgaccaagctgagacttgtctcgctctggttgtggaaagcacacacttagattgttgaaaacttgaaaacaaaactgtttgcaaaataacagccttcccttgaagcctgcattaaccacctaagttcccctggcttgctgagtacgtaagtactcacccttgctctatataaatatatatatagttcctccgtcttgaagaaaagatgaagtgaagcgaagattagagtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacagagatggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatgtaagtgggcccggcgaaagctatcaaatgtaagtgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcctggagcaatttgggatgggtgaccgaccgggaaattcttcccgggtgcacatgagtgaggacaaagtgtgcagaaaagatatgtgttggtctgtgagggcagtctatgacctatgaaagctatcaaatataagtgggcccggcctaggggaaggcgggacggcccggcctaggggaaggcgggacgttacattgggcgggcagtctatgacctatgaaagctatcaaatgtaagtgggcccggcctgggggagggcgggacgttacattgggctgctgttcttaggatcagtatgttaaagtctaggttttcgccggtttttctttaattaaccgtattgttgtaaggtttttagatctggttttccttataaactagatcaactctcttattctatggtgaattgtacgaactccctgcctgtcccctcgaaaaaaaaactttatcatcttaatacttctatatgctatctcaatatctcatatgtgcttatataaatatggtgtacgtatatgcgagtgttttgcagttttactgtatttatatatagcaggcatctaattcatcatatagtattaaatttcaaaaatattatgagaacgcacgcggccgtaccaataccatattagcatattagatgagtccactagcactgtactccctgtgctggtggccttgctagttggtactacgttcctgtcctaaactcaattatcggtgccgttgccttgtcctgcttgcatttgcatgcatgctaattaaagtgttcgttgctgtttcgtcgcatgcacgtacatgatcaggctgtgtggtgaaatcaaaccagattagagagagatcaccgtgtccgtcgtcatcggcgcgcgatgccgccgatgagcatgagctggtggtgggcaggcgccatcggcgccgccaggaagcgccacgacggcggcggcggcgagcagcagccgccgttccggagcgtggcgctcgtggtcggctccaccggcatcgtcggcacctccctcgtcgacatcctcccgctcccggacacccccggcgggccatggaaggtgtacgcgctgtcgcgccgcccgccgccgccgtggtcgccgccgccgcccgccgcggtgacgcacctctgcgtcgacctcgccgacgccgccgccgtcgccgaggcgctggcgccgctaaccgacatcacccacgtcttctacgtcgcgttggcggctccccacctcgcggaggcgcggagccgcgaggcgaacgccggcatgctccggaacgtgctcgccgccgtcgtcccgacctgcccggcgctcgcccacgtcgccctccagaccgggagcaagcactacatcggcccgccggagtccatcggcaagctccccgtcgagacgcccttctccgaggacatgccccgccacgactaccccaacttctactacgaccaggaggacgtcctcttcgacgcggtgacctcctcctcctcctcctcctcctcccgccgcgccgccgccgtcacctggtcggtgcaccgcccgtcgctcatcttcgggttctcgccgcggagcgccatgaacgtcgtgtgcagcctctgcgtctacgccgccatctgccgcaaggagcgccgagagctgcggtggccgggctccctcggcgcgtgggaagggttcagcaacgcgtccgacgccgacctcgtcgcggagcagcagatctgggcggccgtcgccgacgcggcggcgaagaacgaggcgttcaactgcagcaacggcgacatctacaagtggaagcagctgtggccggtgctcgccgggaagttcggggtggagtgggcggggtacgagggggaggagaggagggtggggctgacggcggccatggccgggaaggaggcggtgtgggcggagatcgtcgcggaggagaagctggtggcgacggagctcggcgaggtggccaactggtggttcgtcgacgcgctgttcatggacaagtgggagttcgtcgacaccatgaacaagagcaaggagcacggattcctggggttccggaacacgctcaggtcgttcgaggcgtggatcgacaagatgaagctttacaggattgttccttgattaatttatctcaggtttctcctcaatctctcgtggattaataattataccattagatccgttaaaatataataatttttagctataaatctgaacaaataaaatatttatattttaggacgaaagtacatcggtctaatacggtggcctcgggcaaccaaagtagtttgtggtgttctctctggtcatgcatggtcaatgcttccaggcttccagcgtcaaatcattttgaccaaaaggggttaatggtttgtaaaacgttttgctgtacatttgtccattgaattttcctcgaaaaatatatactccttttaaaatatttcaatgatgatgatgagtggtgaatctgttaccctccactatagatggccaaacgggcggcacggctcaggcccggccgtgcctgggccgaggttagtcgggctggcacagctccagcccaggcatgaccgtgctcgggtcaaagatttattgggccggcacggtctgaccaacatactgggccgtgttgtgttgacccatgtgttgaagcatcggtcctggcacgacctaatacaactcgggccgtgtcgtgccggccggaaggcacgatagcccatcgcgcttcttcaaaaaaaagtctaattttcgtccctcagttctttaggccatgtctaaacgattatgataagtctattttgcatctcttcactcttgggccgtgaattatatggctgcattaagtataattttagtccctaaactacttttcttccctcctcattggattgggccgtgccaggctggcccaccgtgccaaggcatcggtccaggcagggcccagctatcgggtcaggccggtccggacacgtccctaatcgggccgtgtctgggtcgggccaaatggccaggccattgggcctcgggtgctatggtcatctatatctctagtcatgaatggtcaatgcttccagcatcaaataattttgaccaaaggggttagtgctttgtaaaacgatttgctgtacatttgtcgaatgaatttccctcgaaaaatctatactcctttcaaaagatttcgatgatgatgatgatttgttatctcccactaccgcttggtggcggatgagcggatccatggcccgataatcctaggcagctctttgggcttgccggcacgatcacaccattataataccattaattttcagtgattaacatgtataattgttcacactatatgtttgtagcatatataaatttaaccttgtatgtttctgatgtgatttaacacatactacctccgttttttaatagatgacgccgttaaccttttctcacatgtttgatcattcattttattcaaagaatttacgtaattataatttattttgtcatgagttgttttatcactcatagtactttaagtgtgatttatatcttatacatttgcataaaatcttttgaataagacgaatgatcaaacatgtgagtaaaagtcaacggcgttatctattaaaaaatagaggggagtattaatctatctcactatctcgttgaattctatcgtaattatttggatgataggcaaacgtcgagagtttgaaatagttttccattaatttgtgtggcagctcgcaagagaagaagagatagtaaaacgcaaccgtacgttcggccgcattcaagcgaccgtacgtgtgggcgacgaagtcggtcgctcctccgttttcttctcttctccgaagtgtttcgtgcgtgcacgtgacgtgttttctgtgccttcccacaatagtgttcaagcctccatctgattgctctgaagttttgggagccacaccaggatagtgtgaacatttgaatcaacgacacatgtttttgtttgtgccggctcgatcgcagccacatcacgaaacatatctaccccctccgtaacaaattaaataaatttataataaaatagaactttttatagtatgataaaagttttagatgtacatttgtttagatccgttatactagaaaatatcatattctattcagggttggtttatttttatacggagggaatacttaaacacggtattggtttgaccgattggatgcgcatggttaattaagtattaactaatataaacttggaaaaatgtttttttatatttgtaaacaacttttatatataaagcttttcaaaaaaaaatcatgtcattaagtgtcttgggaaatatgtccatagtaatctattacatccgttctaaaatataagaattaaggatcagataatatatatcatattattacaaatctagatatacttcttatcccatcggatcataggttcttatagtttggtatggaggaagtatattagctaatgagtgaaaaagagcatggcccttagactgcactactgcagtggtgatacggatccagctcctctgactttgggctcgtacgtcagaggagcccaatattttgagtcacatactacaatagaaaacagtgtcttgacttaatgctatagcaacagtgaaatgcactgtttgaggttactgtttagatattactatggcatagtgatcgttcacgttcactcgcgacggctgaaaatatccaagttagagtaccgtacgcctctgacttaaaacgccgaggatctcattccgtggtgatacgtggtgacatattgaaatctgtgaccctacctcttcccaccatagcttttattgttctatgatatatatcaaatataaatgtgttgtcacgtatacacatgatcaaagtgagcaatccttccagcaaagcaggaaataacacagctgaggcaaaactatattttatttatttttcctcattaaaacgtactatggtatatatattttgtaagcatgggtatttagtgattatagtagtaggtcggtgcgcagttcatccgtatcagagcaatcccaacctcttggcgcattcgacgctgcagatcaacgtctcctccaccccatacttgtacttgaaacctaaatccacaagcttatttgtatccgcttgcaccctcacgtccttgcctaccaccctaacaaagagaccacacatatatatgatatacatttatatagcacatcctatatcttcatcctaaaatataaaaaaaatttagctataaatataaaccatacatgtatccagatttatagtttaaaatgcttatattttataacgaagcgagtacaattttatctaaagaacgaaaaataacaaataaatcactggtcaaagacacgtactctttgagttttatcgtgatctctgggtatttggtgacgaagtgatcgacgtaatcctgcatattggggtacccaacggcgcagaggaagcggccggcgatggacggctgctccgcgcagaagatatgcgcctcgcagatgtcctcgatgtgtgccagtggcaccgaacctatcagggcctgcaagaacttgagggtgttgtggcatgactcgtcgccggtgagcggcgacacgatcaccggcacgctgagcgagtggtagagctgggtggtgtcggcgtcgccgccgacgagcgcgcacgccagggtgaccacctcgaacgccctgctctcggactcgttgtaccttagcagcagcttctctgtgagcgtcttggatgaagaataatcctataaagccatttgaagtatcaaaaaaaaaaacgtactgcatgtaccattgttaatttgctctatggtatctaataaatcaccaatcagaagtctgagaattactaacatatgttgaaatgccattttcactcggttaaacgaaagaaatattcctgacgatgattgcgaatttgggtgtactgtttaattgattgtactagtataatgatatattatgctgttgaattcttttaatatctatatagatgatatatatactccttccatcctaaaatatacatacttttagatctagtttctcaatgctatagatatgaaattaaaaggggtagttggtattgatttaattagatgagaaagtttgtagagaaatcaaatgagggattactgtgattagtttaaacatgaaaacagacagagaagctataatatatttaagataaattttaaactatataaattttatattgaaggagagataaatttttatatttgctcattactttgtcaacatgaaatgcgtagttgattaattacatactttctctgtttcacaatgtaagtcattctagtatttttcacatttatattgatgtatatatgtctagatttattaacattaacataaatatgggaaatgctaaaatggcttacactgtgaaacggagatagtacatccaccatggtgttgttgtagctgtgggagtgatcgagaggagtccagcatgactcgttgatgaagtccttgtacccctcgccgccgtcctcccggagcggcgacgcggcggtgacggaggccgtgtggatgacgcgccgcaccgtctttgaccgctcgcattgctgcaggatgatgcgcatcgcgtccaccgcggcttcagtggtgttcttgtactgcaaaacaaaacacatgcgaatcaacctctcatcttaattattgtcatctggtagtgtaaagtttaatctaaaacagagcactcaatagtccactatccctctattcacatttactaaagccatcgagacacttggtgcagagtctgaaagtcattaactttcattattacaaaagtaaatgatcgagattatcatttttaagtagctgtgtaatatttttcttcaccagaaagaccgaaagaccgaaggaggctatccgaatatattaagaagaataaagttacaacaaaaaaatccacggaagcagttgagatcggaagtacaccaaagtgcacgaccaagaaccacgtgctaaccacacaatcacaaactatttagatcgaggaacctagcaccaaaacgaccctccgctatgcgtgaccaatcaccgtcgtgcctacgacaacaccaccaagacgagactctggaaacgatactcccccatggaaggtcacggcatcaaagacgttgctatctcgcccatgtaaaaaagatccggtatgtgatgatttcatcttttccacgatagcattcgaggctagcagccgtgtgtaccttggtactgcgagggtcgtgctgcagcggggtggcgaggaggaagacgaactcgcagccggcgatggccggctcgaaggtgtcggcgtcgtacatgtccgcctcgaacagcaccagccgctccgccgcgccagggagctctctcaacggcgccgtcttcttctcatctcctatcaaatcacgtagccatgaaaatttgtattacctccatatttcatattttaatgtatgacgccgttgactttttatctaacgttcgaccattcgtcttattcaaaaaatttatgtaattatgatttattttattgtgacttgattcatcatcaaatgttctttaagcataacataaatatttttcatatttgcacaaaaatctattatattattaaaggaatagaaaaaggagcctccacgttcgctctcacggcctagaaattctcacattaatcggagaaaaagaaaaaacagagtctatatagaaatacaatttagaaatagctgaaattcggaatcaaaaaataaggaatattagaagaggagactagagtccatataaaaatacaatttataaataactgaaattcggaattaaaaaataaggaatattagaagatgagactagagtccatatagaaatataattaggaaataactgaaattcggaattaaaaaataaggaatattagaagtagagtatagagtccatgtagaaatacaattaggaaataactatataattagaaaataactgaaattcggaattaaaaataagaaatattagaagtagagtatagtccatatagaaatacaattaggaaataattgaaattcagaattaaaaataaggaatattagaagtaaagtatagagtccatatagaaatacaattaagaaaaaaataaattcgaaattaaaaaaataaggaatattagaagtagagtatagagtccatataggaatttaaaactaactaaaatttggaataaacataatgaaattaaaagtagagtttagagtccgtataaaaatacaatttacaaataactaaaattcgaaattaagaaaaatatgggaagaagagtttaaagtcaatataggaatacaatttagacgtaactgaaattcgaaattaaaaattaaagaatattgaaagatgagtttagagtccacatagaaatacaattagaaataataaaaatttagaaataaaaataaataatattggaagaagatcatagagtctatatagaaatacaatttacagaaaattcggaattaaaataatatattaaaagacgagtatagagtctatatatgaatatatataatttacaaataactaaaatttgatattaaaaataattaataactaacaagtatataaaatacaatatgaatattacacattagtagttttgtaaagttattgcaaaatttaaaattatgttgtcattttaatatatttaaataatataatgagaaaatatatatactattatatgatagaaaatataatgatgctagccgcgcaatctgcgcaggccaccatgttagtttattatactgtgatatattacatcatccaaaatcacttatattatgttgtacatatgttcttaatgacatagaaatcaatgttgaaaaataaaataccatgaaaaacttaaaaatcaattttaaaattcaaaatatgattggaatgacaagatgaagagcaaacgataaaataagcccttatcgcgctctttttatgcggaatggttaaatacatgaataatttgagataattgtttgaagattaaaaaaaacttaatgcattaactattataaaagttgaaagaaaagaatgtaaaacatttttttaaagaattcatatatagttttttttaaaaaataccatttagaagttcgataaagaatgtgtgtttgttgattattccactaggaaaaaaaggagacagtaaatcaacacgtgatttcttttttgttagccaaatgatttctacgttatagtattgcaaagacttctaaaagggttaaaaaaaggcctttgctagttttgtataaaacgaatgaacaaacgttgttcaaaaagtcaacggcgtcatacattaaaatacggagggagtaaattgtgttggttttatgcttgcagatggctacaagatttttggaaaatatagaggtgatctagctagagaatagtagagatcattggggagagtataccgagatttctcaaggtcgcatgcacgacgcagcctcgctgcagcagcttcttgatgaggcacgtcgcgatgtagccgctggctcctgtgacgcacaccctgctgctgctgctgctcgtcatcgcttctgcttctcgttctgttccttcagatcagatgcgtttggtttctatggccctctctcaacctgtttaaataatgcaaataacgtacaagactgaacttagtgtcagtgtcagttgtttgggaaacaaaatctacttcggctgcgttcttttcagcaaagtcctcctcgttttccgttagcacgcttttcaaactactaaacggtgcatttttctgtaaaaagtttctatacgaaagttacttaaaaaaatcatattagtccattttttttaaaaagaatagcagatacttaattaatcatgtgctaatggatcgctccgttttccgtaatcactgttcataagaagaaagaacgcagccttcctccatttcatattaaggtgtgtttagttcacactaaaattagaagtttggttgaaattgaaacgatgtgacggaaaagttggaagtttacgtgtgtaggaaagtttcgatgtgatggaaaagttgaaagtttgaagaaaatgtttggaactaaacaagggcttaatagtcattttaactttctttctagctataaacttctttagatttaactaagtttataaaaattttaatattcacaacattaaattagtttaattaaatattatgttgaatatatacattgataatatgtttgttttgtattaaaaatattattatattttctataaaaatagtcaattttttaattaaaaatattagttaggaaaaaaaaagtaaaaacagcttataatatggtaaaacagtgtaagggcatgtataaaggtagagtcaggcatgagctctgcattatctagagactaaaatcttacaatagttgatgacaatatggtctctaatcattaatgtatcaaaatatttttcttactattctttcatttctttcaccaccatgcaacgaaatttgctctaataaataaatgctaagagtcaactctgagccgctgtcatgcataacaatcatatttctctttcctcctttctctttcatccatgtcatcaaatttatttgcatagcaatatagagaccactgataaaaaccgttttacatgctctaaacaatgtgagtgttcggcggggacagcctttttttgtggccacatgtgccacgatttgcatttatacttaccaaactagttgtgcgatatctgatccgatctctgaccacaggtttgcattcataccatcgctacaccaaaccagaatttcttgaaaccatatttcagatttagaaaaaaaaaatcggatcaccgtgtctgtaccaattcattaaaagttaaattttttttgaacagattcgagaattccgtcccaggacaaacatgccgcagctagcatacatctatcatggcctggagaaacgaggttcatgtttgaaaaacaagatgtgtattcccgacacatttcgctgttacagaaaatttcaaaaaacatctctatcctggccatgctgatcattgaacaatatatcaagtgaacactgttgattgttagacctccaaattcattttcaaattgttgatcattaaccaatctttcaaaccgaaaacgtggatgacaacacgctacgtccggtccccgtcaggtgcagccgcggcggagccattgagccggccatttctccactcgcgcgggcaggcggaccaagcggcggacgacgacggtacaaggatgcaattttttttttactagcaaaatgcccatgcgttgcctgagtgaagaaaaaaaaagtaattagtgtgtgggagcataaagtcaccaggttaattgaggtctatatagtcaaatcatgcctttcctgtgcaaataagacgctaacatgatataattatttgccgctctaaatccactaacatggatactaaaatttggaaccacaaaaaatatttacttttttgtcatgtattattatgagtcagttgcaatacattattattttatggtactcggtattgataaacttttttcatattgtaaagagtagccatagtacaagatatattttttgctagttatcagatcaacctcactgcactccaattgcataatcactcactcaaaaaatcagaaggaaatggtacaatcaatggaaagaaaaagaagtggtgtatcgtagaataactttcactctaaacaatagaataaatcatacaatgaatggaaaaaaagtgatgtggttagatgtcctacggcgaatgagaaattgatgagggaaaaaaatccggatgtaaacacgagtcattttgttggtgattacatgttttttaaaaagaaagacacatatgattgttttttattttttaaaaataatttattttgttggtaaatagttcatttaaattttgtggtgattacatgtttttaagttataaaatcttttttttatccgatacctggtaggcatgagtccaaactttattcctgcttgtgctgggctgtagctcctctgctcggtgggctcgctggtggctacgactgcttttttctgggccggcctgctgttgcttttgatgggctgcaatatttctccactaatccacaaatccgatctgctttggatgggctttctccttttttttttctcttttatttgcgggcttaagagatcgctgtcagcttccgaatcgtgattagcgacgaaatatcatgtggacccacgcttaatgacgtacgaaaatatttacggaagccttacttattttttaagtagtttttttattttaaaaatctttttaattttgaaatcaaactcttgtgaaacttatttttaacatctgaaccttttgcacatgtcaagcaaattggcgtcacaacacaatactttcacactggtctcgttggcgtgaaaacaatctttggtcacgctgctcgataaaactgttacgcccattgcaagtggtgtgtaagtgtttttttatcacgccgggcgtctggcgtagacaaaaggtttgcatgttaaaaataagtttttaaaagagtttatttcaaaataaaaaaaataaaaagtacaaaaactataaaaaaaatccagagatggacaggactctggccaattcggctttgcggcgccggagcgcacggtgggagaagcatgcacggaacggagccatcgtttttacaaacgaaaagtattttgtgaataaaacttatatacgtgtgttcttagcacaaaatcagctccaaatttaaggttgaaaatttaaattttacctgataagtataagcataagaaaaagatgaggcctgaaaaaaaaaaaggagaaatagacagacggttggtggagtggaagggcctccaggctccagcaaatgacattgtcaaatgacaagatggcaaatgcgatggctctagctgtcgagcgcatatatggtagtccctccgtttcaggttgtaagacgttttgattttggttaaagtcaaactgatttaaatttgactaagtttatagaaaaatatagtaatatttgtaatactagtaccaaattagttttattaaatcaataattgaatatattttcataataaatttgtcttgggttaaaaatgttattattttttctacaaacttagttaaacttgaagcagtttgactttgactaaagtcaaaacgtcttgtaacctgaaacggaggtaatattatcgatgaacaatgttctgatagctttagggtacatttcttagatacggttggagtaaaagggccggaacaaatacagacattaggacagaaattatactgcttggcacgctcaaagtaatcccagcctcttggcacattccacgctgctgtccaacgtctcctccaccgtaaacttgtacttgaaccccaaatccccaagcttgtttgtatccgctttcaccctcacatccttcccaatcaccctaacacagaccacacaaacaaacagatataagatctaccccctccgtttcacaatgtaagtcattctaactttttccacattcatactaatattaatgagtctagattcatatatatgtctagattcattaaaatcaatataaatgtgaaaaaagctagaataacttacattgtgaaacggaggaagtacggtacatacatgacacattcatatatcctataaagaaaacataagatcgagagaacaaatcaacaatgcacttacccttgaagctttatcgcgatctccgggtacttgacagcgaaacggtcgacatagtcctgcatgttggggtacccaacggcgcagagaaatcggccggcgatggatggttgctgctccatgcagaagatgtgtgcctcgcatatgtcgtctatgtgcgccagtggcacagaacccagcagcgcttgcagggacttgaggccgccgtggtagagctcctggccggtgagcggcgacacgatcagcgggatgcttagcgagtgatagagctgcgtggtgtcggtgtcgccgccgatgagcgcgcatgtcagggtgaccacctcgaacgccctgctctcggactcgttgtacctcagcagtagcttctctgtgagtgtcttggatgaaacataagcctacaaaagcacaattcatgtgatgatctatcatttctcatatttgaaccgcatgtatgagagattcagtttgaaaatttacaactcaagctagtgtacaattgtcaataagatctatgttcataataacatgatctatctaagaaataaccagaacttttttagcgtgcaaaatctctcccagtatcaaattataattaagtatagatagatagatagataagacaatattcaaatatactccctgtatttcataccgtaagttgttttgatttttttttccattcaaacattttcaagtattttcgacacaaaagaactattctttcaaaatatattaaatgtcatacttattgaaactaatttagtgtgatagatgtagctatttttttataaacttaatcaaatcttaaataagtttgaccaaaagaaaaaagtcaaaataacttataatatgaaatggagggattacttatacttttaaaattactagaattctttttatttcttatcactaaaatataatggatttgaaaataatttacatatatgtgtagtactattaaaagtatgtgcaaacttttcaaagaaattgataacatttaatttgttatagctgttgtgcatgatgttcgtaatatactagttgcaggatggatacgctccttgatagatagatagatagatagatagatagatagatagatatgtgaacatatattttttgacggagaatgggtagctgattacatccatcatgacgttgctatagcggttggagagatcaagaggagtccagcatgactcgttgatgaagtccttgtacccctcgccgtcctccctgagcggtgacgcggcggtgacggaggccgtgtggatgacgcgccgcaccgtctttgaccgctcgcattgctgcaggatgatgtgcatcgcgtccacagccgcctcggtggtgttcttgtactgcaataatataaaaacataattaacaattaacaaacttacaaacacagcaacctctcatcctgctaattgttgttgcacaatgcacctagtgctgctactgactgcatgcctagaactagtagtagtgaattctaaaaaaaaacagaacactcaaataatccatgatatatccatcttaaactcaggccatcgttggagtttattaattccaggcttctgcatttaatttttttttttaaaaaggaaggatccattattatgaaataaaattacaccctgcctctgcatctgtatctaccagagtgctgcatgataaacttaactttcctttcctttccttttttttttctctttttcagttccagacagtgtgcactgcgtgcgtgggttaccttggtgctaagcggatcatgaattagcggggtggcgaggaggaagacgaactcgcagccggcgatggcgggctcgaaggtggcggcgtcgtacatgtccgcctcgaacagcaccagccgctccgccgcgccgggcatcctcctcagcagcgccgtcttcttctcatctcctgtcgtcagatatatgcatgatcaccaaccatgcatgcatccatgaatgaatcaacaagaatttggaaagaaagtgaggaagagatgggtaagatgtaccgagatttctcaaggtcgcatgcacgccgcagcctcgctgcagcagcttcttgatgaggcacgtcgcgatgtagccgctgccaccggtgacgcacaccggcctgctgctgctcatcgtgtcacacgacctctcctcgatcgattgttgttgttcgatctcttcttcctccagtccagtcaaatatggtggtgtctgtgactctctcggcccggtttaaatagagaaaaaactaagaccgggcttgatacagatgttaatggttttaataagaaaaaaaaaatacgttttgttcgtcctaggagtccgtatcttgaacgtggaagaaacaaaatgcatgtggcgtggaaacggccctcgcaggcgttgcaatgtgtgtttctcacggaaaagctaacgcgcacgcgttggtggcgaccgttttcggatagtttagcctaactaactaagttattagtaaataatgatagtaattaagatatgattttcttttttccggaagattttttctactaaccgattgaaactttcaagttagatttaaaaaaatatgaaaactttcgattgaaactttcaagttagatttaaaaaaatatgaaaactttcgattccgattaaaaactttcgactcgagatttgaaaatattcaactcaaattcgaaaactttcaactcgagatttgaaaatattcaactcaaattcgaaaactttcaactcgagatttgaatactttcaaatcagatttaaaaatttttcaagttaagatttaaaaactttcaactcaaaacattttaaaaaaataagtgcgctaaagattaaaagaaataatcagaaaaaagaaaaaaaatcacaaaataaaaagaaaaaacaaatcgcgaaaaaaaataggctggtgggcttttctgggccggagcagctggcgcgccaacaagcaacgccctgtttctcaagacatgcttcttgtatttatgcataatactgccaaactagcagcccaccgcctctggtcaacttgtgtccattgagaaaatcaccgcactccaaactaagctttttttattcttatctgtatctctatcgctatctctatctctatctttatactattataaaaattaaaaatgttttttccggtactttaatatgttatccgcatatgagtcagtttttaagttcgttcgcttttgaaaatacaaattcgtatttgagttgggttttaagtttattttggttttggaaatacaaaagaagttgtataagaaatttcttcaaaaaaaactcgcatgttaatttgaaatgatcgaactaccaattgtagctcatgattttctagaaaaatatatatccaaacgaatcctcacagtgaatttcaccttaactaaattatataacaataataaaattaaaataatcttcacccaaaaaagagatcattactctatattacagcaaactcagctgtttctttttttaaaaaaaatatgaataaattcgaaacaaattctgctgcatgtacgtatggctggatctgttctaggctaccggcatcggagtcaggcgctggggtcgtagtcgtagtacgtactcgggattttgagtttgtgcttacaacgtttgaccactcgtcttatttaaatttttttaaaattattatttattttatttatgatttactttattatctacagtattttaagcataacttttcgttttatatatttgcaaaaagaatttgaataagacgagtggtcaaacgtttcaagcgaaaactcaaaatctcttgtactgtgggacggagggagtagcagctagcgtggcgggggcgcgggtgttgtcgcggcagagactgtttggttgctaccgtgagctacttgcctgaggaaaagtggcgcctgagagttccctgaaattttggtgcttgttgcctgatggggcatccttgagttggttgtttggttgaagtcctgaactaaacgtgcctgaggaaaattagtaggcgcaaaacagtgtgctttgagtaaaaaagtgtttataacacttcccattagacagcattaatctatagatcattccttctgattggaaaccctaaaaaaaagtttcttctgattgcatcgcacggaccaaacacaatacgacgattgtggaatccagcaaggaggcggtggtggtttgcatcatcgcgtattctcgtcaggcattacgacggtgattatcaaccgatcgatgctgccgcctggagctcaggccacctattttggtcgcttggacgaggctaattgcacgcctaaggtggatcaggccaggcaggtggaaagggccctcagggcagcaaccaaacaggcctttaaccctgccattcgacgcgagcaacccgggcggccaggcccctgcacactgccgcttgcacgcacggcgttcacctgcggagttgtgggccgggggagtttatcctaggaaaaagtctaatatgggtccctaataatatagatctaattcgtatccctcagccgtaaaaaccggtataacgactccctcaactatcaatatcagttcaatttatcttcccaggtggtttgcatgatagttttatcttgcgtggcgcatgttaacgtggtatttatcctacatggcattataattagaaaaaaaagtaaaaataaaaaaattgtatgacccatatgtaagtcctcatctctctcctctttttatttcctccctttctctttctccccatcacgcttctagcggcagttttgtcttctaggagggcggtagcgagtcgggagctgggagggcaccagcggttcctccccctcttttgtccctccctctcctctctctgaggggattggggtgccatggccatcggacgcaaggaagggcgtcattctgttgctgcttattttctaacggtgactcaggacaggaagcgggccgacgacggtggccaccaggctcgagatcgtgtcaccccacgctgactccagcactagcgatcctcccttccctcccgccccccaggtgtaatctctaggaccactactaccaccaccggatcctcctcctatattatgccatctgcgccacgagaggtctcgaacccggtgtaatggagcttgagtgaccaggaggccccactgtcccctctccttgcggacgacgcaacaacgaaggagagtggccgctgctgaccctgagcactcccctcctcttcaactagggaggtgctcatctagtggctcctcttcggcacacaccatgacgtcaaggaagcaatgctgcatccacccagtcatcttcaactagggaggtgctcatctagtggctcctcttcggcacacaccatgacgtcaaggaagcaatgctgcatccacccagtcatcttcttggtgacttggtgtcggaggcaccgtgg

SEQ ID NO: 65030 - DNA, 2086 bp, Oryza sativa
accctacttgtatttcatttttctaataaccaagctacgacgtaaaatctatgtcagaaaaaaaaaaccaccatcataatagtcgacggaattgttttacatgattataatagttggaggaatcgttatacccaatgttatggttaagaaatatgaatcaaattgcgaccaagttgagcgagtcggactctttccttttccctcctctttgtggcacgtattccagccccggggagcaggagcccgttggtggagcagatgcgatccacggaccacggatggatgcatgggactccgggtaattcagctcgaggcggcggggatgatgtcatgatatatattaccagagatggatcaagatcattggatcggactgttcagcagacaaggacgtagtagcacattagttacgcacgacacacttgagcaataataatactccagttcattgcccatcggtgtttcgaatagacaactgaacagctgaacaatgaatcaagagcacaatcaatagggaaactgttttaacatctcgagtggatgtggacatccacccatttattacatgtcatctaaacgtttatgaaaaaaaataaaaaaatacaaacaagatagatcaatatgtaatatatcaatccacaaacatgcaaattaaaatttaacttctacaaattgtaacacaaataacaaacataactcaaattaatatatatatatatataattaaatttgttgtttttgttacaacttgtagaagttgaatttgaacttgcatgtttgtgaggtgatatattacatattgatctatcttgttaatttttttgaaaattttttgtaactatctagttggcgtacaataaacagaacgtccactagagctactaaaatacatctcccaatcaatagtccaaatgtccaatagtaccgttattgaaatagaacacagccctacacatttggtcctggccaacaacacgtggctggtaggtctcaaagcataagtgagtatgttgccaacttggcattagtcctcacatattttttcattcggtaacaacaaattcattggcatgcgtcttatacggcatagataaacaatgtaaacaatttctatttgaaaaaaaaaagataaggtgctatacattaaagcaagcggaagactgcacaacggtatatcgttccaacgaaatagctaatgtatactaacattagcaaaacatcagcacaatatcgtagatactagatagatatcggatctgatacctcctaccagacatgatgccatataagtaccagatttggtacttaggtaccacgatgacatcggctattcattataaaggtatataccgttatgtagaatttctttaaagtaatcccatcctcttagtgtattccacgctatgatccagtgtctcatccacttcatatttgtacttgaaccccaaatccacaagtttgtttgtatccactttcaccctcacgccttcccctaccaccctacgtaatcacacgagcaaacacaatacatgttatattacttaaaaaggatcaaggagatcaatttaataatcatcaatcgagattctaaatacatactctttgagcttcatctcgatctccgggtacttagcagcaaagtgatcgacgtagtcctgcatattggggtacccggcggcgaagaggaagcggccggcgatggacggctgctccatgcagaagatgtgcgcctcgcagacgtcgtcgacgtgcaccagcggcacggagcccagcgaggcctttttgaacttgaggacgccatgggagagctcacggccggtgagcggcgacacgatcaccgggatgcatgctcagcgtgtggtagggctggatgctatcgccgccgacgagcgcgcacgccaaggtcaccacctcgaatgccggcctctccgactcgttgtaacgcagcagctccttctcggagagggtcttggatgagagatacgcctacaaacgaatcaaagtagaattcgtcgccacacagtgtccaaagtcgttttagattttactagtagttcatagaaaaacataccagcattttttaaaa

SEQ ID NO: 65031 - DNA, 4547 bp, Oryza sativa
gccgcttctgtggttcgtgctccatacttcatactcacatagatgatagatcacatgccatagaccatattcatattttggttccatgttgcagcttgacaactaatattttccttctcagaacacgaaatgtgatgcgatcatttggccaagtgaccagtcccatcttttacatgattgttgttcatatctgtggttctgagagatatcttgaaacaatagcagagtcatcagttcacacgttgcataccataatggacttgagctcaccatcagctgctccactgattgctatgccgttgtccctgacatccatcaagtatgacagtgaatcctgcgttactatctcacctgggatcagcaccgggatacctggtggataagggcagataagctcaccacaaatctcaccaaggctatcctcgatggacactctcctcttctttaaaaagaaggcctcccttggtgtcaacttgatggagaacttgtccagtgggctactagcaggattctcttttctggaactggacccattttcagagaagtatttttctgacagatgctttacagaatgtacaagcctctgaacatcatgccttctggtccctaagttgactgcaaatgtcacggcctgtgtaccgaccagctcagatacaatttgatgctcctcagctaaaaaatcatctgcttcatatccagataattgcagatctgaagcacttaatgtgatacgcaagggatcaatagcaggaaaatcagaaagaaagcttgataagtccaaaacagatattcctgggataatcctcagctgatgttttgtttctaaagccatagatactggttcatcaaaagattctgcattctcactcagctgagcccttgcggcatccaaagaagagagtagaaggtaacttgggcttgagctctggagcaattggaggcattggcttactttatctgcatccacaagatctccagccatgtgaagcattgaggactgtgtaagcgagcacagaaccttgtgtgtggattgcacaaccaagtcggcaccttgctcagttgcgctgcttggaaaatttctgtgaaacctgaaatgggcaccatgcgcctcgtcaactataacaggaatgccttgcaggtggcaaacattgacaattccttgtatattgctgcatatgccatgataggttggtgatgtaacaagaacagcacctaccttctttctgtcctcctccagttccttaaccactttatccacctgcgatggggtaatacccccagcaatgtcccacccggaattgtactcaggtactatatatttgggcacagcaccagacaaaaccagtgcagagatcactgaaatatgacaatttcgaggtatgatgaggtagtcaccaggggaacaggtagccatcactgaggcctggattccacatgtacttccattgaccaggaaccatgttttaaatgatccaaatagttcagctgctcgcttctgagcatctaaaatcacacctttaggggagaagagatcatcaagctcaggtagctcaggtaagtcatgcaaaaatgtccttgagccaataagttctgacaatgaaggaggagaagctttccctctattatgtccaggaaagtgaaagcaagaaacatcttgatttgcagttgatttcagtgcctgaatcagaggggcagtaccagctttgacaactgctgaaggttcagcatgtgaaccattagtagtagacgttcttggagtgtcccatgaagtggcacattgtactacaacatgccgcatgattgattcctacgggataacagatgcgcgtcattgcatataatagaaggaccaagaatgccatgcacttcattaatcagtgatcaaaagctgcaaagtagatagtttaacttactaaccatggcctgtgttggtaaagcagacgaaaaaaaaacaaaggcagcagccttcagacaagttaaagcttatataaaacaatgtgtatggtacaaaggagcttggctgcattgtgtgagaaattcatggaaggaagacaacaaaatcttcacatgttgcacagctaagtaatgcacatgagcatatatacattaagtgtgcttggaagggagtggtaatagactcatagcttcagcagagaacctgattttattggaatgcttggggccattttataaagcacaggttactgccgactggatcctttctaattcataaatagccattctagcaataacgaaataaataataatagatctatgggttcatcgttattagagctccgagctcatgagcaattctacaaacagcttgtgagcactccactccactacgttacccaaatacggggatacgaatacggatacacgatatgaggatacaacacgttcttaaaaacaccgatatggggatacgtctatttatatttaaaataataaaaagatatagagcgaatacatgaattttaattattaattatgtacttaataactacaagactgtgaatagagatagatagtcatatggcatgatatcaattgatcaatacaccagtagtcaaaaaatgatcaatacaccaaaatcttttagtactatctcagatcagcctataatctgtctgctatctcaggagatgaggctaaccatgaagctcctatggatattgtgctcccatgcctggtcactagtgaatctacagactgcagccacatagccgcaagcagtatccagtagtatgtatgtgctagagatgcactgccacttaagcattcaatttcagaactaactcatcgcccatcggatctaggagaagagataacacttgtactaagatgagaagggaaaacccacaagaaaatcaatcaagacttaaatggggaagaaccagatatggcgtactaatggcgttgggcctcgcggccggtgattcctgaagacgttgcgcccggtggaggagatgaaacaaccggcgactggcggagtccctatgctcagcggcagcgacgctgcgacccttggttggcgatggtggcgccgccggcggctagcggaggccctgcgcctcggggagggatgcgacggtgggtaggatgctcgaactgcgtcgggatgggaacaatagcaggcggcgctccctctcccgtgcgtgggtttggattcgattgcagggaggagtaagaggattgagctgaccttgtgtgtgctggaggcggcgccgttgcccttgttcttgggcacgccagccacggtggagcaaggggagtaggcggccaagctcaccatcccggcaccacctcctcctctccggcgaccgccgccgccgccgccgagctgaacgggctgcaggctgcagaggaggagacgcgggagataagaagatgacaaggagattagatgggaggcgactaatcggcaattatgtttgggcctcaatagctaatgaagcccagcccaacaagctggcccgactaatggtccttctgcaactattttacatgccaaacctgtgtttgtcaggtatacattttattcagaaataacgtgttttcttctttgcggattttgcatgtccaggttcagcgaaattcaggtacatcttgttcaggcttaatctatttccacacacagattttgcagtaaaacctgcatccaatttgagacaccaccagacagtaaacttcagattctgctataaatctgagaatgaagaacaagcacagtcctattttgcaaggctttcttccatcttgtaataattccaaaatttctacaactaaattacaaagtacaatttaagcttcattcattcttcagatgtcttacaagaacacgtatacaacagcagagatgccggtcgctgcatggaatttacctgacaaatctgagtacaactagctagcaaagcactataaaatgtgcccgcgtaatttggctcttcttctgatagaaattaatcaatagtaagctattctatttctactggatttgatcaggcacttgtcaggctcccgaacaatgtaaatctcatccccgacactaccgtacagatcctggttcctgtgccatctccacaacgcatgcgtctcgttcttcacctgcaaaatccaaagatttttcatctcatctcatcaatggtgacatttctacttcatgaagcatctgaagagttttttttttttacctcaagaatgccatggccgaagctgctctcccggtaggcgctgtagtcgggctgccggtcccagcagaagctgccggcggcggggccggaggtgaagttgaagccgcagaagccgccgcccatgaaggggtccggcgtggacagcgggtcagggcagcgccccggctcgtcggcgtagctggtggccatcttctcgcggttgccgccgtcgccgacggagatgtgcacggggccgcacgggtccagcgtgtagttgaacacccggttcgaacgctcgtaagcatgcacctgagtgacacccacagttcatcagagaattcagagaagaagcaaaatgttcagaatatgttc

SEQ ID NO: 65032 - DNA, 744 bp, Oryza sativa
ctcctcaatctcatggttcccttccaccaccatcatcggaatcctcgacgtcactggctccatgtaccttcagttagacatcacaaatcaatttatgaacaatcgctaaatgttaagagtttcagaaaaaaaaggttcagtgctaaatgttaagagtttcagaacaaagatccagtgctaaatgttcagagtttcaggaaaaaaaaagattcagtgctaaatgtgcagagtttcagaaaaaaaagattcagtgcaaaatgtgcagagtttcagaaaaagattcagtggtaagtgttcagagttttaggaaaaagattcaatgctaaatgtaaaaaaaaaaagattcagtttttgggttagtgactgatcactaccttccccagtaatcccagcgcggctgatacgtctcatggatgggcgtggagttggcgaaggagcaggagtagcagtctgtgccggtgccattggtgaggtacaggttggcgtagctgacgtcgccgaggaggaggaccaggtcgggctggttgctcaccatgtgctcgacggtggaggtggtgttgtacgtcagtccaaggtccccgacgatggcgatcttccccgggtagctcctcggcccgacggccggcatcgtgcggaacgcgtggatgtcgctcatcgccgccgggatcgccgggtcgccgcactggtagaagtactctgtccctggctcaagccctgcagatcgcacacttgtttgagcaaaga

SEQ ID NO: 65033 - DNA, 751 bp, Oryza sativa
acgttgacacgggaagccacagtttgccctttttttttttgacggggacggagggagtagaagacagttgcaatttctttcatatctgaaatggataatgtcgccggtgccgttacggaagttgtgagcgcacgtcgccggacttgcgcttttggatggttgcgaggaatattccgtcgtcagcagagtagatgcctgagccgcgcggcgacggcggcgcgattggccggtcggccggtccaagtgcttgggccgtttcgggaatctcgtcatgccgacccatgggaaagcttttcttacttcgctgggcatgcgtatgcatatgcatgtgtcgctgccgccgcctaccgggatgctctagacggttgaagaatttcaacaaggatatgcagtcgtgatctctctctctgcttctttttctgcttgcgtttgcgtttgcatggctaaaaaattcagcaatggaggcgcagcgccacgttgattgtttcatcacgttgctctcctttacttcttgactagggagactgagaaatttgcagctagaatgggcagatttgaaaacttatctgaaaatttcataaaattccgtccaaaattgctcccgtcggccgatccacgagacccatgggctggatcacaagccacgttgggccgggccgtatttttatctaccaagaaaagcaccaagttgcgggcaattttttttaacgactctgaaaaatttttggatctcgtggtcgtaacaagaaaa

SEQ ID NO: 65034 - DNA, 2387 bp, Oryza sativa
taacgccgtgagctcgtgacgttaatctccgtataaccaagccatgttgtcaccatactcagtcacgtattgagttgttttaccgtttgatcgtacgctggtcggacatacaagtcatacgtatagcattgttcgttgtataatttgattacagactacagtcatatgagatgatagaacactgggtgtactgtaccttatttcaggattgcactgtatccctttgtcatcctccctcttctctttaggctcttctgtactttcaatttttcgtcacatcaaatctttcatacacataatttttcaatcacatggttttaatttcaaacaaactttcagaattaagtgtgaactaaacacacagtcttgtttgtttcgagtacaattactgtacatcgacagacctgcatcttcatccgatctacgtgtcgcagaacacaaactgacgacaacgatgggattttttttttttaaaaaaaaagttcaaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcaaggaggagttgaggtccaaagcgatcaaggatgccgggtgacaagattggacacaaggttgcacacggtggacgaacaccgtgtgaggaggtctttgcaacaggcttcacaaggtcaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcgggaaaaccgtacgcggcaacctccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcgggtcgatgaggtggcaatcatctggagcttttcctttgagtagaaggaacaatggatggaccagatctgttctaagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctctcttctagtttcgggaattccttttctcttcctcctctagtttcgggaattccttctctcttctttttctctcttcttttctagatccggcttctaatagccgcgattctagtaaggattttgagaaatccggcttgatgagtattttcgggggcaagatttgaattgctatattcaccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttacactgtgcccgatgatgctgacatcacgcctgcaaatatggctcaggttgattttaattatcgtgcaagaaatgcaatcattggtggaatttcttctgg

SEQ ID NO: 65035 - DNA, 913 bp, Oryza sativa
ttctctgaaagttgatcttgagtctgctaagaaagagaattcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatggttcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccggtgatgagaccatcacttttggggatgcgagcagtggacgcgtgatg

SEQ ID NO: 65036 - DNA, 791 bp, Oryza sativa
agagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcattagcaaactttactgaaaacaacctttctttcttccatttagataagtatatgtgtttgtgttaaagtaggtggttttttaacaacagctcacacctttgtagaatgtaaatttcatgctaggttcctctggcaaaacggcggtgggatacgaaactatgaacccataaaaacacttcgaaaatcgaaagaaatttgtgtatacaaagaaattcgtgcaagtctttctgcactagtagaagtagaactgtacaagtactgccctggctattcttttttattctttcatctgctgtatttttggacgattctgtaacgtgccagtacggggacttgcaccgtgctctgccaatttgaccaagtgtgattcctgcattgtcggcagatttctggtttacaccctgcatttctctcctctctgtaaaacgacggcttatctcatcgtcgtcatttgtgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaagg

SEQ ID NO: 65037 - DNA, 906 bp, Oryza sativa
tagaccatcatctagtgccccgggcccatatggtttcacaggtggtttcttcaaaaaatgttgggaaatcattcaacaggatctagtccaggctgtcaacagggccttctcctccccgctagaccgtcttagactaataaactcagcatacatcatcttattatgcctgtgaaatacttgcataattcatgaccttgtactagtcccgaagtgaaatacttgcataaacaattccgaagtttgtgcacatgctccggccggatcatagcatcaaaacatactcaatccatcttttaatacagggtatcgttaactttttaaatataacttaaatttatctttacacgtgatttaaattttctttatatttataaaaattttaaataggacgaaagatcaaacgttttaaaagaaaacaacgacgttatatataaaagacgtagataataataggtgtcgccttttgcatgcagtacaagaacaacacggaagcggccgtggacgcgatgcgcgtcatcctgcagcagtgcgagcgatccaggacagtgcgccgtgtcatccacacggcctccgtcaccgccgcctcgccgctccgggaggacggcagcggcggctacaaggacttcatcaacgagtccttctggtctccactcaacctcacctacgacttcaccaatgctcatctggacgtaatgttaaattaatcaccaactaattaacaaactatttcagggaagaggatcctccgacgtgaactaccctcttacgtgatcactgactggtgggcccgtgagcggcggggtccatatctcagtcaccacgttcctctgacttcacgttagaggatcccaatccctatttcagtctccgcatcaactggtactagagcttgacattttctctgat

SEQ ID NO: 65038 - DNA, 6676 bp, Oryza sativa
tattgaacgacgtgagtataacgaatctataaagagatatatatatgtctttgttgcaccactatggctgtgttcgctggagcatgtttccaacctggaacagtatgcacggaaaacggaacagtccattagcacatgactaattaagtactccctccatctacttttgatagtcatatttcatcttaacacacagaccaaggataagtaattctacttatcatccatttaaacatgctactagtcattcatcgtaaacaagcgattcattaatatttacatttctcaaagcccatgtagccaatcatatgtggaaaaatggagagtcatgcattaaattcgagaaaatcattaagatgataggttgttggattgaaatatgcctatcaaaaataaaattttcagatttggaaatatgactatcaaaagtagatggagggagcattagctaattttttaaaaaaatggaccaatatcatttttataagcaacttttatatagaaacttttttaaaaaatcacaccgtttaatagtttgaaaagcgtgcgcgcagaaaacgagggaaacgagttggaaaacttgggggtaagaacacaacctatgttggtttttcaagggacaaagggagtatactattgaacccaaaaggccatataattaacccataacttgtcgttgctaattttcatatgtatcatcagtaacttaatttgttaattccatctctcgcagtacaagaacaccgccgaagcgaccacggacgcgatgcgcatcatcctggaccagtgcgagcgatcgaggacggtgcgtcgcgtcatccacacgggctccgtcaccgccgcctcgccgctccgggaggacggcagcggcggcggctacaaggacttcatcaacgagtcctgctggtctcctcccaacctcacctgcgacttcaccaacgattacctgaacgtccgtaatcgatcgatcaacataattaaccaactcgatcactctcacggtgacactaattttctgatggattttgcataatgcagggctatgtgtcatccaagacgctctccgagaaggagctcctgagctacaacggctcctcgccgtcgccggcgttcgaggtggtcaccctgacgtgcgcggtcgtcggcggcgacacgctccagccatgcccgtggagcagcagcatcccggtgatcctggcgccgctcaccggcgacgagccctcccacaactccctcaagttcctgcaggcgctgctggggtccgtgccgctggtgcacgtcgaggacgcctgcgacgcgcacgtcttctgtatggatcagccgtccatcgccggacgattcctctgcgccgccgggtaccccaatatgaaggactgcgtcgaccacttcgccgccaagttccccgacatcgagatcaggctcaaagagtatgtgtcaccaatccaactcttgatatgctacctccttcctttaatgtatatatgaggtagtattcattacgtatttatcttgattagttagttgttgttgaatacagtatgtagtaactgaatttgtgagattcttttttttttttttttttgaaatcagatcaactttcattgacccggctttgatctgatttgtgttgtgaatttgtgagattggttttgtgttcgtctttcgcagggtcattggggagggggtgagagtgcaagctgacaccaacaagcttgtggatttagggttcaagtacaggtatggagtggaggagacgctggacagcagcgtggactgtgccaagaggctgggagagctctgatagtctgatgtgatgtgttgtgtagcaaaatcccttgcttcgcttgacctgtacatgtataccgtgtgcgtacattctgtgagaacggattgatgaatgataaattcgttcctgctcaattatccgttggtaaattcgttcctgctcaattatccgtctttaactgagcaataaactaaactatagcgacgtttttgccgctccatctcggtagtataatttgttggagcgattcaccccgctccgctccattatttggtgaatctagaccgtttggcacagccccagccaaacggggcctatctagcgagcaaatgcaggtcgattttgctatacatttgtcgacaaatttttccccaaaaatttgacagatgtaattacagtacaattgtagtgtaattacactgtaacttgtatgtaattacactgtaactatagtgtaacttgtatgtaactttcaaaaatctctccgtaacatgttatttcggtaaaatggaggtcgtgggaacaaattctttcacatatgtgtgtgctatgatttgttttcttcctcacttaaacaaatcgtgtaatagatctaacgattcaaaattatgtgacacttaaatataagttacactgtagttacatgcaagttacagtgtaattacatataagttacagtgtaattacactacgattgtactataattacatctgtcaaatttttggggaaaaatttgtcgacaaatgtataggtagtcccaatgcaggtttatcagatcgtgaggggaatctgctgaagtccacagagtgtcgcccgtcgaatcgagtgggccgccatcgaatctagtgggccggaaggcccaaaagcaaaatggctagggcccagcaatttggagcagtaggggtcggagttttcttctccgacgaccccaaccaaaaccatcgtttcctgacgagccacggtgcctgtgcctccctgaacgtttagcatcgtcgagagctacgagcctcaaagagagtggtgaggctggcatatgaattcacaaacaagttgggaagttattgtcaatggccatcgtcaaatcccacagcaaaacagaagtaaataacagtcgaaacagtattcttatccacaccagaaatcacgttaaggagcacctcccactaattataattactgaacctcatcaggcccaaattaaaatttgttctgaaatccaaataaagatcttccctgtatgtatgttgaagcaagcgcagattgatcgatggacgtgatcagagaacgcgcccgtatacgtacgtatacgtatgctagttaatttctctcctaaaaacgagtaagaaatatcctataaaaaagtttctagaaacaaaagaagatatatactcctatatccgtacgaaatctcggttgttacttgttactgcagttccgtttcgttgctgtgttgtggtgcgaaacggtgacgtggatcacccgacttagcgcccacgcatcataccgactcaatcctgtgtatttcacggtctactactagatatcttcagtgctgccgtcacccacaacacaatcctccttcctccctgtctctctctctctctctccactgcagcaaaaccctaggaaaaatctcgcttagcgatcgatcaagcaaattaagccctagtgattacttactccctacttgcttgtgctgcccgatctccatcagatagatcgatcggagcaagaacaaggggcatcggagcgatcatggagggcaagtccagcagccgccatgccgatccactggaagaggtcgagatgaattcggcttctgcgaccgaggacgacgacggctgccggtatgtgttccaatcccgccgcgacagcgacaacgacaatgacgacgaggagggcgtgctgccggcgacggcctgcaagcggcgccgccgcctcgacgacatcctcgcgctgcttccttcgccgcccacgccgtctacctcttccggttcggaggggacgatcagcgaccgcgaccacggcggcgacgtgatcggcgccggcgacgacgacgctgcccccgtggcggcgcgacgagaggcgtcgttcccgtgccacttgtgcaacaaggagttcggcagcaggaaggcggtgcacgggcacatgagggtccatcacgccgagaacgagaaggagccgatgtcgctgccgccgcaggtggcggcgcccgttcatccccaggctcggctacccacacgcggagcatcacgatcaggtggaccgtacaagtgcaagtacgagggttgcatcatggagtacgagtcgcaccaggggctaggtggccatgtcgctggccacatcaacagggacaagatggccaccgccagcggcagtggcggcgccggcaagccaaagggcaagcacccgtgcaacgtatgcggcaaagagtacccgacaggagtggcgctcggtggccacaagaggaagcactacaggaaggaccttgatcttaccctctccctcgcaccgcccggacaactcgccgcgccgcctacacctacacctgctcctgctccagcggccatcgccgcggtggaggcagaagcggaggtggctgaagatggagatggaggagagctagtgccgacaactccgccaaccggagctaggagaaatgtggtcgtgcggatttggggcgttgatttggagaagccggtagatgatgtagaggagcaagatagtggcagcaactaaagaagatcaaaaggatagcaactaaatatagaagattaagaggatagtagtcagcagtgcagtgtttatttagatacttattcacgtgtttgatgcaaagcaattgccgctttgttagtttagatagtgaggattctgttcaattgaaacaaccaattctacagagatattatttacaaagaaaaaaaatatatctttcatttaaaagttcttagagattatgtttttttaagagagagagtgcatgcagccatgcacgcactgccttgcgaaatccctaatccgcacctaggcgcgcgtggcgcccaccgtgtgacgcgccacgtgccgcgtgggaaagacggaagagggccggacaacacgcacgtggaagtgcggagaagagtgcggacggaacggcatagtttttgtatatagacgtatatggactttgtatatatacatataatgggaaactattctaatctctcgaggggatgttccctcgtttgctcaaaaaccatctaaacggttatgaaaaattctggaaaaatttgacaacattcatacaacacatatatacaactccacaaaatcttaagtccaaactcaactcacacgttgagatataaaaaagacaaattcagcgtatgaatagtagcgtactgtttatatctaaatttgtcttttttgtttctcgatgtgtagatcaaatttgaacatgaattttggtggactagtaggtaccattatactctacattgtcaatttttttcagaatttttcacaactatttgcatcgaatttagaagaaaaaggtatacgaggggatatctcctcgagggattagaatccactccccatataatgtttgtgtatatataaaaagttcatataagtattatattttttatacatctctatctctactattataaaaatggggaagatgtttttaccgtggcttggtacgtcagtcgcatgtgtccgattcgcacacggacgaagcagcgagatccatcgtcgttcgacactacgtgcacgatgttggtccatggccaccatgcatggcacaacaaaaagtagcagaaccgaacacggattgacacgcctgactgtagaatccaaaacccagctcgttacaaccgaaggccacccaaagcaatcgtttttattgtgaactcactgaacagagagattggtaatagaattacaacgtgtacatacagacttcgttttgtttttattcgtacccttaagcttcgatcatggcacaaggagccccattgattgccttagttagaaaattttgtatttttaaatttaatttgaagttgtttttaatattttttcaacgttgtttgttaaatctatatctaataaaagaaatacataaagcttccggtttattttttttgttccatccgtttttttatcgtcgccggttttttggatgtgactcccgctcgggcgtccgatgggaggaggttaaaatcgggcgttaacgtcagcgtccgatttacgtgcaaaactactttaaactgatttttcttctaaattatttatccaaatcatgatccgattacaccattaaattcattgtaattaaatcttcaaaacaagaccacacatagatatattccgacgaaaaaattatcttattattgaattatttttaaatattgcacgatattccaccaggtatatcggaattgtttcactaagtagatcgaaaatgtttcactcgtttaaatcgagtgttgtttcaccttatataaaaacaatgtttcagcaaatagcgaaagaatgtttcagttcactgcaacattagatctatacatagtgaaacattgtgagtacattaggtaaaacatttttcggtggaacaaaaaaataaaccaaattcccttaatagggggtttccaaaatatgtgggttttttgttgcaatggaatgtttcgttcactgcaacattagatctatatatagtgaaacactgtgagtacactaggtgaaacaaaaaataaaccaaattctcttaatagagagcttccaaaatatgtgggtttttgttacaaaagaatattttaattcaccgcaacattagatctataaatagtgaaacattataagtacactaggtgaaacatcttttgtggaaaaggggggga

SEQ ID NO: 65039 - DNA, 6463 bp, Oryza sativa
  unsure (1)..(6463): unsure at all n locations
ttgtactcgatgacagttgaggaccttcggtgtactttttccatccaatctgttctgtccaacgtgggcccgaaggttaactgggccgtgtcaccccccgaaccccccctgattcctctcgcctgatgcgccgcgcgcgctagacagccatgattccagtcgagccccacccctctcgctgccgcctgcctgcatcatccaccctgcttctgcgcggccattactgcctccattaaactcggcttgcctgcgccgatcaccaggcccgcgtgagtgacagtggtgacaccatcatcattcatcaagttcctcacttgctcttgctcttgctccatcatcattggcagctttggctttgggctgtgtttagatttaaagtttggattcaaacttcagtgcttttccatcacatcaacctgtcatacatatataaattttcagtcacatcatctctaattttaattaaaatccaaactttacgctgaactaaacacagccttggcttagcttagctgtatgcatgcctgtgtcctgtactagcttcgtaccaacacactgattggtcatcagagagctgcaggtgcatgtttcacaatatttttttcaagtatcaaccgagaatctgtctcgatgcgctacgcaacaacaagacgcccgacgccgcgatggaacccccacatgggcgcaagaaacggacgacggtttcagcgatgcagagtagcagcactgatgcgccacgttacctaacagctaaagggctaaaatgtcactctgcaggagccacatctgcacaatctgagggccccttcgaatcgtaggaatggaaaaacggaggaataggaaaaaatatagaattctggcagaaatgcaagtgcaaacgagagtattgcaaaacacaggaatagccgtttgattggaccgcaggaaaaacgcaggaattaaaggagagatgaagactcgtaggaaagtttccatgaggtaaaacctcatgctagatttcctacaaaacttgcatggcattaggcattccataggaatttcacatgattctataggattcattcctttgattcaaagggctatatagaaaaaattcctataggaataaaatcctttagaattcctatgaatttcctttgaatcaaagggggcttattcctactatactagtaccacatgttcaattctgcctctcacattttcactctcattttttgcggttttcagagatactgaagggcaaaaggatgtgagccacaaccatcttcagggatgagcaacttgatgataagttgataacagccttaagatggcattgtcccaacaacaaccttctcattccaaccaaccttgagcctacctactggttttccctagatttacaagataataaagatgggaaaaagaaaaagaaatagtgggagtccttgcatgaaagagacagacatcctactaccaaattacagagtacacgacataagaaaagggagtacagaaactcaccccacacaaacacccatcgacaccaaacaagaattggcaggcaatagtgggttttcggatgggatgacatcttcagaaaggatcagggtttctgttcatttttttttcttttcacagatcacattgctcctgcaaccaccgaaatcgggttctttcaatcagcgaaaatgagtgttgcttcaagggtgcaaccctcatgcgatcgcaacgaacgagaggagcacggtgcagaaggtggctagcccggctcttaggtgcaatcccgctgccgcggtgtccatgctgcttgtgcctgttggccctagcccgcccagcccggtgccggtagtagtccctgttcccatgccggtgccggtggttgtgcccataccagttccaggtgtgaaggttcctggggtcattgttccagttgtgcctcccatggtcggagtggttgatgttccagcaccactgcacatgagtatggaaatgttgttaggatattacaatcaacgaaatccagaagagtcttgcgtgtttcaacttgcaaagcatctcagttgccttcagatatatggcacaccatactataggaatccttcaatgatacttgcatcaactatagatcattcaggagtcatgtgtacatcacaaatgcaggccggaaaggcataggtgtgcattttggtatggatgagtagttgaggatgaggtacaagactagctttaaataacagatggacttggttcttaatggtgatgtatacttacttattgactctttggtatttttcaataacaaagcatatacgactttgacaagcaaacaaaagagataaggaagttgtaacacattcagttcattgaacagatggctacattcagttcataggtcttagtattgcagttcagagtgaacatgtactatataatggaggcagatagtgtgttcaaaagaaccttctgctcaaacacaatgcaaaagtttcattggtggttaccactttgaaacgtcaatcatccttagtgatacttaataaaactcagtcagttaaagtgaagttaataatgtaccttgcactagcagggaaggagcagccagaaacacctgcaaccaaagataatatgagattgtgtgaggaatagatatgtctctaaccaatgaagaaaataacaaaaatacatagaatggatatcatcccacactcagatgaacttccatgccagctatcaaaaagatgtcaccgacatctccttttccttttcgtttgtcctaactgaccacaagctcaaatgctagccaacatatcagactgagagaccttataattgagataaggtgacacaagcaaacaagctaaaaaaaacttcaacatactttacggttgaattaaagcacgtcccattacgccatgcttgcattgccccaacgcacgacaaatcttaattccatcatctgtacagctcgtccttcacattgctagtcaccactcccactcatcaccatccaaacatttctaatcgtgcaaggcagaaacacttgccgcaaaaacttgcaagcgctcaatgacattatgacagccagtactcaaacgcgttcttgaacccgaaacgcgagcgcaaatttaatcaagcagtagacagtggacagaaatgctgggaaggaattgaagtgactactactccctctgtttcacaatgtaagtcattctagcattttccatattcatattgatgctaatgaatctagacatatatatctatctagattcattaacatcaatatgaatatgggaaataatagaatgacttatattgtgaaacggaggaagtaatatattgacgtgcaatccttttgcgcattcgtgaaaaaaaaaaaacaagaattgaagtgacttgggtggtgaatcattttttacttgggtcgctggtggtgagggtggcggtgccggtgaagtcgcaggtggcgcccatggccctgttcctctggaagtagctgttggcggcccaggagcagtgcgccaccacggtgttggggttgaagcactgcccctgctcgtggatggagttgcagtccgcgcccgcgccgcacgcgtagtcgatggtcttctgcagcgccgcctgtggctgatccgacctgcacacgcaccaatctgcattcgccaagaaacaccacacacacaaaaaaaaagaagagattcaatgagagagattaattaactcgtgcgtttcattaaaaggcggcagtttttatgccagtttcttgatgaagagatgggatgcggaatgtgacgaaagcaatcaagaagagagagtagcgtctgcgcagaaagagcagaaaactaggagaaaatcggcgtagtaacggttttgcttgttttagaaagtaaaaatgtaaaaaaaataaatcaacttgagaagaacacatctccaactgtctcagaggggagaacaagagatttcttgtccttggtccttgttgagttattttcttcagcaatagatgaacagcaagagctaagcagtacatggctagtactgtttgacatagcaaggtaggaaaggggaatctgaaaaaaaaaaagtagttcacaaaccataacaaaagtagcgtgtactcctacatgcaatgctgatctttcctagaaaatggaagaaccaaacagaaagatctcttcttccaagttccaaacataccaatggatgaaccaagcagaaactgagaaacatcaaagaacaaaaaaagaaaaagaaccaccgacaagtagaagtgtagaatagaacaacacctgaacaaatccccccaaaactccaacaaaatcaaccttcagaaacaaaaagcagcagcctttgcagttcccagccattatttaagaggcacaaactcactcaggacagaaatctaaacgagacggaaagagaaaggttagaaaaagaccctcccccggggagagctgagcttaagctcgctcacctgaagcgacgagactggacgacatgagaagcaccagcgccgccaccaccaccgcctccattatgaaagctaccaccaccaccaagcaagcagcaagaacagagagattcttggaggcctggacgagtagaagagatggagacgagctagtagaggagagtgagtgagtgagagagagagagagtgtgtggtggcctctggacaagagtggcagtggcagcagcagcagcagatgcagagtgagtgagagagacagtgtgtgtgtatgatgcgtcgggtgcgcgtgcgagtttgatctgcgccacgggcgcctacggaatttttaaccttttttttcttcttcttcttctttgcgcatctacggttgcgacccctgggagactgagccgcacccaccgctacctttttgctttgctgcaatttgcagttttggcctcctgtgtttctctgttcgttctcctgcccaccgcgaaacgccagcctattttcgtgaggttaatgcttggcttttttttttttttttgcggggaatgcttggcttttgggactaataaaaaactgttgcaatgatttttttttagtgcaaaaccattcaaacgtagctatagtttcatgtgcagctacggacaaaataacaccttgtgatcctttgatctgcaggataggaaaaatatagaaatagagaaaaagcagaaattgaagtagtagtatgtttcttatgctatgggaaaaataaaagaaagttcacaaaaaggttacacgtcttactatttttcctatgaaatgtgaagcatagaaatataatcctatagaaaatttctcacaaagaggtcacacatcttactatttttcctataaaatgtgaagcatagaaatacaatcctatgaaaaatttcctttctttcatatgaatcaaaagaacatataggaaaaaaaccataggaatttaaatcctatgaaaatcatttgccaatcctataaatcaaaggagccctgattgtttgtttgttcttggtaatgtcgcggtcaaaatttaaattttaaactctctatgtgtttttatattttttttacttctatttttaattttggcttttaaatcgctaagaaacatattcataccttaaaattttttctcatttcactgcttatttttccactactaattaacagtcgaagccaaccaatatagcactaagggcctgtttggtacagctccaactcctaaatttagctctaggagttgggtctggagtggagttgtggagttgcctaaacccaactccacaactctagctcattttgtgagagagctccacccagctctactcccagttttggtggagctgaaactatttggctgagctccagctctatgaggggtggagctagagttgtgccaaacaggccataagctaacttcacaaatttctagtagcacctgtttttttctgtatatttcacaatttttgtacatagtgtctactagcattctctgtaataattttgtttagcagatttctgttgaaaaatctgctagtatcaaatttcagcatggttttctattgacaacgatgcaaaaacaattccaaaacagttccatttcaagacgatgctgcaagccgggttacattattttcggttggtgtgatggtagggcccacgacgccagagccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65040 - DNA, 1082 bp, Oryza sativa
catgaatttacagacatttattttctccatgttttttccccatgtatctatattcacactgctgaactttgcattctattttgcagttgcaagatcttggcagcacacttattgagttgtggaacctaatggacacaccaactgctgaacagaaatgctttgaccatgttacgtctttgatttcagtctcaccaaatacaaaaatgccccaaggatgccttgcacgtgaacttattgagaagtttacaattgatcgaccattttatgttcttttgctttatttggattgtcattgaagctaacttaatttttctgtaaaatccggttgaggttaagaggttgaattcttctgatcattgtcaatacaactatagcgattcattgagggtaagagctcacataacttttatgtgctttactaatctttttcgttataccttccatatttgattactatgcagtagtaattatttttctgatcattgtcaacacgactacaaatatattttatagtagaacctctcatgaattacactgaaaaacaaaggccgaatcatcgcctgcacaattgatctttaataaattgaacctgcccacactacctgtatgtgccacagttctatatagaaatttcgtgattagctacgttatgtaatacctacaccaaccatcctataatactatcactataatttcattgtaccaatatctactattaacaccactattcgcttttatcaccggcaccttccacacataaaaatacttatagacaaattttcatacaggtggacattcaacgaattatgtttctgcgcaaaaaatgtacaagccacacctgatctaaaaaattacatcaatgttattaagcgtttcctacagcattcgagcaaattctatgctgagactgttaacaggacattccttatgcagaatagagttgtaagttcgtacacctcctgttcattccttcaaatttataatacatactgctcgttttttctgcgcaccacagaaaactaacataacatcccagttgcagtactttgctaaagaattttcagaggtacatcgaaccactg

SEQ ID NO: 65041 - DNA, 1314 bp, Oryza sativa
tgccttaattactttatttgtgactagatgatttattggttaatagcacttagggtaggaactctagttgtgagtacagtgtgtgtacatgagtccttgtatgaacaggctgacaaagtgacagtccacctttattagttgcctgggtatagtactctgtagatccaacaaatcctccaatgcataaatccatatcaattccaaatgggtacatcatactgaccctaaggcataaacatgaaacgtgtaataggtttgtcatctcttattattctacattgacagtttgcatattagtatcatgattcctaacttgtactagtaaataaaattactaacctaagaatgatactatgtaccaaaatgaccaaataaaagcaaaaggtactacagttactgaaaatgtgattttctttcttaagctgttgcttgatataacctccatgtgacttctgaaatatgcttgcagtacaatactcactcaacttactagttcgtacaatgtgatcacatactgacatagtgacacttgccattctagttcttgaatacttccttcgcgtttgccacaatgtggtttatcagattaatagagcaaaaaagcatggaaacagaagtgatgagactgatattctaaatggccaccaaacagtagactatagttaaagaacaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacct

SEQ ID NO: 65042 - DNA, 975 bp, Oryza sativa
ctatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgcttttggttgaggaatcctggctctaattcggtgccattatgtgggtttgtgtttaatttggggatgt

SEQ ID NO: 65043 - DNA, 1283 bp, Oryza sativa
actgatagatgtgcacttcctcagatatgtgggctgttggtgcaattttggctgagcttttcacactgtctccacttttccctggtggaaggtatgtatgatactgttgtttgggtaccatgattatgttgcctctgtagttggtaatatccataatttactgtattcatgtattgatgcatatatgctgtctgcttacgcatgttttgatttgagcagtcaacagatcacccttttgatttctgttgaagtgaactcttgtttcttcttttggtgattagttgtgttctttttattttgtggatagttggcctgggaattttggggatttcatgccactatctctgagttgcatttattaattccaaggctgtaaaattattgttgttctgaatactgtaacaacaatattttttccctcatgttagtatttttagctcttatgatgcctatgttgttttcttatacgattaagcctatacttctccatactttttcttaagcccagttcatcttgcacagagtagacctagaccatttgtacttatatttccttgtttatggtgattctgctttgcttttaattattttatttgcttacagcgagactgatcagctatacaaaatatgtgctgtgcttgggacaccggatcatactgtctggccagagggaatgaacctgcctcgttcaagcagctttaattttttccaggtgaaattacttctgtctacaaccattaggataagttgcctttgacactgatttccttttcttttgcttgttcaaaagatcccaccaagaaatctatgggagcttattcctaatgctactttggaagctatcgacttgattcaggttagttatgacacatgagtcttgtttcttacatgtttgatttatatattgttatatgaaccccatgtttttttgtccagttgcttatgtaagtactaacatcaagttaattaatataacatcttacttatatattatattgttttaagtaatttaccatgacaattcacaataaattgcactaattactagtttgtaaatagtgtaaggtatgggtttgtaacatgttgatgatatagcttttgttgcttgatgttatttgtctgagaataatgctctatattaacatggtagtatttgtcattctgacagcaactttgttcctgggatccacgaagaaggccaactgctgagcaatcactacagcatccgttctttaatgcacctaatttacacattgagttattcatgggaactatacttcgct

SEQ ID NO: 65044 - DNA, 1273 bp, Oryza sativa
atgatcgaaatgtcctccgagataaagcaatatgtttttttttcctttcttatatttgaactattgttgcttgtgggtctatttagttgctttataaaaaaaaggactataacactgagaatcgatatgtttaataccattttggttgaaatttacttcacacatttgatcaatgcatacacggtaaggaggtgtttttagaaagaaacatagaataatctatgtaaaaacataatacaaagtggtgatatgtctattatttataaaatgttcaacaaaaattacgtataaaatcgtaaatcgccgagtaatgtgggcattgcaagtacacgtaacggaggaaacacaaaatatacagtaaatataagtatagcaagccacggacatcaaacgtatggagaaggtattagatcaaactagtggatacccctcacgttgcagtggggaatttacaaatacttcaaataaaattcgaagagaataatttgtaatccgtatactcgtaatgcctaaaaggcattattttgagctccttaatagttgatgtggaattttggacgtgtatatcctttatagatatagaggccagattaataaaaaatacattatctaaaaaaatagttgatgtggaattgcaattgcacatcacataggaatggttatgtattgggaatgtgaggatccaatggttattgctttccgcgttatacggttaaaatgcacattaagatttatagcaataaatcaataactacagtaagtaaatttatagtgtattataaatgcatatgacatatagatggttaagattaaattatgaaaaggaaccaaacactactattttctagatattttgatgtaccataccctaaaagttcgaaatcgcaatcctaattactaaataggttggactcatgctcctttatataatgcagcaaatttgcagaatttttttttcacatgatttagttcagtttctcccgaaatatctaaaaaatcatccattcagagaagacataagtggcatctttcaaacgccaccggtataaccgctggttctacgtaaggcagtactagaccataaaatatctgtccataatcaaatgatgcatgttttatccaagataaccaggaactagaattggccaaaaactccgtgcagaggggagggacacaccaaacttattgatgaccgcagtcaacacgcagcaccactcacatgtatggccttgcttggtataagtactcggcatcgaatcgaagtgtaacgcat

SEQ ID NO: 65045 - DNA, 1105 bp, Oryza sativa
gccgccctgggggagggcgatttttgcctcccccctataaagcccagcccctcccctgtcaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacactgcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcatatttcagatagttcacggtgaaggaaatattagatttggtccagatggtgttgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtac

SEQ ID NO: 65046 - DNA, 860 bp, Oryza sativa
agagcagaagcattccaagtgctgaggagaaaaccagttcaggtggttttccttcttgatgatctgtttcaatgctctttagccaattttatacgttttctgttatctgctgaaagtattaggagtagactgcattttgtcaagtcagagcattgcatgacatcactggtctaacttggttttgttcattttcagggttatgatatcagtttcctgataacaaactaccactgtgaggacatgcacaagcataagctcatagatttcattgttcagtttatggaggtaaggaaaaatgttttccttggctttcccatttgctacagtttgtgactttatactcatatcacatattctgatttgtgctgtaggacatcgacaaggagatcagtgagctaaagctttcggtaaatacacgtggtcggttagtggcaactgaattcctgaagcagttcatatgacacattcttggcgatctttggaaaacataaaaccctagcattgttagctatgctgtcttggcctttggcgagcaaatctggaaggatctttccaccactttgttttccttttgtaaatgcgttgacaaggatatgtgaattcttgatccaactagacctcattggcagctaaaatctgcccaggcaagagagatgaggggaaacaaagtcatggtcagtaggttgagatagattttttggccttttggttcaagaatcctgtactgtgccggccaagttttattggaatgtggaatgtcaaaattggggctgattctgattctgatatgtcaaaattggaatgtgaaaatcagagacgcttgttgtctctgattctgatttcagttccatggcaggctg

SEQ ID NO: 65047 - DNA, 7856 bp, Oryza sativa
aactaaacttgagaggaatgagagagctcttgcttgaggtgtgtgttgaagtgaagagagtgagcttcttatatagaggtaggtatgacggttgtggaaggggaattgtccaaagtgacctccaaccgtcattgggatgcaatcctggacgttcttgccaaaacctagatccatcgacgcctggattggttcggccgaacctggggctggcccaatccagcccaatttcggctggtggcctcctctattgctccactccgcagacttgtgaattttggcccaatttatcgtgtcaattctaagttcttggcccattcatacataagtctggtcctcgacatcgtctgattgatttatcgttggtgttgatgttaattctccttcactttattgtcattctctgcaaaaaaaggttagtagacctaatactagtggaatattattgttctaacatatttatgcattgcaagcatcactagttctctcctgttttagtaatattgacggccgaaactgatcgataacgaccgtcaacaaacccccccaagcttgaacctttgctcgtcccgagcgaagaacgaaaggaaacaatgacttggttgttaatcaggagctgctactatgctgcatatctcagagatacaggtgcaaggtacatgtactctctctcagattaaataatctttggcacggtggcttacccttacccctgattcccacgagacactgcttctccttgccttgggcgttgaaagatagaacaacaattagagcaccaatcacccaatctttattcaactcttattccggaagttttcaaatgattttggaaaagaaaaccaagttcctcaattgattcactcagtctctctaagtgtatcagcatgatttcctcatcaaatgttgccttgttgattccaactctaaggtttatatgtggagctcggtagggatcaaacatggcatacttgcattcacatttattactgagtcaaaaacttagactaaagcagataactaaacatactcaagatcaagatcatgcataatgtgtgtgtggtatatagtggaaatggtgtatgaggaaaaataaataaaaataaacaaaatgcttcttctttgtgcttactttcttctcccaaaaatctttcttttattgattaggagagggcatgattacatttttttttcaatcatgctcatgcttgatggagcataactttttttttcataaccatgcctttccctcctctcttttttttctttttaggagaagaaagcacatgaaagcatggagaatttattttggtggtaatatggatatggaatggaatattgcttagctcccagtgtaggagtttagcatgtccatatatatgggtgtatgatcttgatcatagagcatgagaagtatctacacaagtcacaagagtttgacaaagttcaatggaatggcaagcaaccaaaatgcatatggtttaatcatgatagcacatttttggctctggtaggaatttatatcaaatgaggaactttcaatttatcattttgaaaaacaaaacatctggaattcaagccaacctagtatcaggatcatagctactcatatttactatctcatatctcgcaacagcttagacttagatcagcaagtgcagcccatttacctcaggttcccggataattgttggctacttatatttaacctttgagagagtacttaccaagaacccatatatcagagatatgcaacagagcaactattcatcatttcaacaaagagaactagcttgtcttacctagcatgactcaaacctatcctatctttttggtattttctattttgcaaatttttatgttgttttcaagttttataagatgcaattggaaagcaaatatgcaactggaaagggaaatatgcaatgtgatacaagttacctcagtggggggagcgaagtctccccccaagcttggctttcgctcagggtccttgattaggattgaacccctgaaagcgaaagtacgcttgaaagtcatcgtgctgttgctgcatcatgctgttgatgctggcgaactgagcatcagcagattgttgtcattcttgcgtctgagctatgtgttccgtgaggttgtactgaatctctcccgtctgcacatcaagggtgtctattctcctagtgatttcacccaagtcccaacgagacgaacttgagcgccattcacttggggatggaggcacaccacttgatctggagggttggtagtccccccagtggatgtcatgaggcgcatgccaccggtcctcactggtgctttcccaggttgagactccgatgctatggcgtggagcttgggtccatccgggtgcatccccagttggtgcccaacctgcctcatacatctgcacgggtgtcgaggatgatgaacttccttattcgttccttgtcatgttgcgcgtctccctgtatgttccacctgcacgagattcttctatggtctgcaggggaatggtcagttcatggcagttgtacaaataataccccgcatttggcaacgggatttcttttgtacaaccggggaaaaagtatatcaaagatccatctactccatgtttcaaaatatgcccttgcactaaataggcctcatcaatatgcagacgagcggctgagataaaagcaatttggtcgctaacgacccctagcccttttgctatccaagtaatcagaaaagtgcactcaacaagagcagagaactttatactttctaaccattgtcttatcatacatttcacaggagaaatttttatctttctaaccatggcaaacatgataattaattcatctcccctaatgggtctcagatcacttctaggaaacaaagtcatagaaatccatttgtgcatgagcctaagtgtaggattatggatatcatttgttctaggtttcttgcaaattggagcaccagaaatatcttcccaaaatctatttttctcgaacccagaaattcctttctagagatcggttttacaggaatcgtgaaaaccaagaagtgtactcaagcctttccatctgagcgtgaactccttacggaaaaagcaaaaagaaataccatcttctatttctttcaaagtgcacagaaattgcaaagtaagcaaatgagaaccaggctcatctaccacagcaaatctctgccaaccaacagctttccaaatataacgaaattcaacatccatacctatctttttcagcagctccggcgagtattctcgcgtgtgagcacactcccgatcgctcagcatgtagtaggcttgtctctcccgatcactgtcatggtcgaggtcagcgtcgctcaagagttgtcgcggagcgtcggtgtcttccatcgagacatcagctgatgaacgagtactagattcgtcatgacgacttgatggatagcctgatcccttgaacagacgagacagtcgcctcctcatactgcacaatggaacaagaacaggctaactcggcgggggttagaattgacaagagtttcaccagccggttagtttcgccaaagcaacttgtatatatgcaattaaagatttgaatttgaggaactatcaaagcatgaataaacttgagagcaaactttggagagggaatgaaaatgtgttgaaatggggtggaattccctctcttggccggctggcttttatagggtgcccacaacggtcaagaatgacatgtgggacccactagccgttgcctcaaaaagtgaggcagccgaccgttgcctggccggttcggccgaacccctggtgggcccaaccggccccactttcggccgatggaatccaacggtcagtgcggtcgtggcacagtgaatttttgttgaaaattttattttggtttgctctgaaaaattcatttgaagaatttcctcaaaattcaaaaatcctaaatgcaattttgaaattcaaatatgtggtgatgcaaaaattcaaattgttgaaaacaaatatgcagatacataccaatttacctgttggcgaaggtcgcgtcatttaaagtccgacatgcaaaaccgtacctcctttcgattcagtgcgcggattttccacccgctccagaggtgatggagcgggcgtctttggctttctcctcccacaccttctttgattttggtgcgaaaaacggcttcttctgagccgggtgctctaacttcttgactggtacaggtgattttaccggtgtcctccaataacggttccttggcattgttgtttccttctccaggaagttctgcatgaactttaccaggctatctgtcttgggtggctccacttcgaccacttgaatattctgcgggttcggcccgtacttgattctgaccatggagcattgttccgtccttggttgaaactcaaacttttcctccttcccgttgatatggaaacggatactcccagttcccacgtcaatgttggctcctgcggtgctaaggaatggacgccctaggatgagcggcgtctccttccccgtgtccatgtctagcaccacaaaatcaaccgggatgaagaaatcccgtatcttgactggcacatcctccgctatccccgccgggtaacggactaacgagtcagccagttggaggcgcatcggtgttggtgccaacaccgtgaagttgagtttgtcaaagacatcctttggcatgacgctgacgctagctccaaggtcgcacaaggcctggtcgaattgttgtgcccgatcgagcaggtgatcatgggacaccccggatctttcttcttctccgggaacttgttgagtatgacgttgctgcagtgttccgtcagcttgaccacctccgttgttgggagcggtctcttgttgttgagtatgtccttgagataacgggcgtatgttggtacttgcatagcgtccaacaacggcacgttgatgtggatcttttggataacttcaacaaaacaagcgaactgctcgtccactgacggtttcctgctccgctgagggaatggcagcaaacgtgtgtcgcagtactcctacggcactgtcttctctggctgaatcttcttgtcagccgagttagtagatggcgtttcttttgacatcccattagttcctgcaaggttaggatacggcggatcacgagtagacttacctcccctcgttgtgatcgccttaacattttcaatggaggagtcaggttgccctgaaatcctcccggattcatttgcagggactaaagatgccaactgagttaactgggtttctgtcatcttattcaagagttggttagagaagttaccgttattatttcctcctcataatacgggcgcggttggttccacccctgacctccttgtggacgatacccgttgttgttgcccatgtacatcgcctcctcatgggtttctgggcagtcattcccagaatgacccatgccgccgcagacctcacacgtgacgtgtgactccaaggccttgacgttgccttgtggccgtttctcatggtcgtccaagcgtttcatgaggaggtccagcttggcagcaagtaactccgtctccttgacggtgtgcatgcctcgctgacgggtctggagtcgttcctcgctccaacccatattggagaccatcttctctataagtttaacggctccttgaaccgttttagagaagaatgctcctccagctgccacgtccaggtgatcgcgggacatcggggtgagcccattgtaaaagttctgcaggatcagccagtcgtccatcttatgatgaggacaggcggccacgtactcctgtagtcgttcccatgcttcaggaatggactcgtcccttgtctgctggaaactggaaattcgtccacgaagagcgttggttttgcccatcgggaagaacttcgagaggaatgccatagagcatttatctcaagtgttgatagcagcacagttggcatagaaccactgcttcgctctcccgaggaggaagaacggaaacagtcgcagcctgacggcgtcaggactgacttccttgatggtgtacgtgctacatatctccaggaattgttgcagatgagcgttggcatcctcattaggcttgccacagaacgggctagtctgcgccatcgtgatgaggctggacttcaagtcgaaatccatatctcctatgttgacttgcggcccgacggccatattgtcagtagagggagcaacgaactcacgagattcttgctggccataatcttgaaagttggtggcgctggtacggctggtttctctgttggtagagttttctacggagcaacgactcgcggcctgacgctctggaagaaagcttctagattttctttggagttttccggcaggttgaaaccagtcatgcactaccctgttttcacaacaaaaagtgaaaacaaacaaggttagcctgcaaaggaaaatgattatacagaggtaaatataaagtgttactacaagtaatctctattatgaatcttccccggcaacagcgccagaaatgcttgttggtatttcttaatgacattactagaaatataatttccaacaatggcgcagaaatacttatggtatattatggttacagagttcatccgcaagcacacggatataccattgtagcatttcacccgagagtattccaagggtatcatatttattttatcccgtgggaagatcatgtagagagaactcaactaataatttatatattacttgtgataatcatattctaagcagggattaagataatccaagggtagagtgacacacaagcatttctactcatcctcataataaataatctaagctaggtggaaagaaaagagaaagagaatctattcctatacttctaatatacatagtatacatacattctagttaactgatatactagctaataccctctatccgatgccctcctggtacttcgagaagccacccctgactgccgagttccttacgacagcccgtcatgaccatccaaccggggctaaatacggaggaataccctccccaataaattaacttaggattatatataggcgcagaggaatacccgtactgagctgtcaccataagcggcccacctctcatccgcaatatataaccctaaataatgatatcccgtaatctagacaccacgcctaaactaccagatactactctaatatcatcgtcatgacatagagtaattgcataagcaaacattataccctcaccaaagcatctcccagataagctagcagtatattcagtataataagaacataatgtaaagttggtactcatatacttggaaagtatttcaataccagaaatgtatttaaaagagtattctaataaaagtacaaagcttacaaaagaggaaaggaaagctactagagccatacccgaactcttccggaggcttccggactcctgattcctattctaattctattccaccatctagatactactaaactaaacttgagaggaatgagagagctcttgcttgaggtgtgtgttgaagtgaagagagtgagcttcttatatagaggtaggtatgacggttgtggaaggggaattgtccgaagtgccctccaaccgtcattgggatgcaatcctggacgtccttgccaaaacctggatccatcggcgcctggattggttcggccgaacctggggctagcccaatccagcccaatttcggctggtggcctcctctattgctccactccacagacttgtgaattttggcccaattcatcgtgtcaattctgagttcttggcccattcatacataagtctggtcctcgacatcgtctgattgttttatcgttggtgttgatgtcgattct

SEQ ID NO: 65048 - DNA, 871 bp, Oryza sativa
aaaaattaatgaaaattttaatatgattttcacgagtttcgtgtttttccccaactagagaggggaaacctaaatccggaccgtaccgcagctaacgctatatactctaggagtacacgctttgctctacaccgataatacacacatacaccgccgcggcggaggcgagagaaggggaaaaaaagaaactccgcccaatcagccactgccacgcgggctcaggtcccacctgtcatccgcacggacccaccgcccttaactggactggttccacccccctccggttcagagctttcagaccgaccggcgaccgaccccaccttccctccgccttccccgaagccacgcttctcgaagctcgcttctctttctctctctctctctccggctcgacctcctcctcctccgcgtcctccattaccggtagctcggaatccgccgccggcctccgacgatcgccgccccctcgccgggcccggagatccggatccccgccgcgctcggtaagccctagagcttcttccccccatcaacccccctctcccctttcggcccccaatccgattcggccgagcttgccgggccgattccggtgttcgcgcttgtgggggcggctgctggagcttcggggaagggagcttggggtctatttggcggcgccgcgtggcggtgggtgtgggggggccaccccgtccccgaggttggggggtgctgatccgcgcacggggattgggcgtgggatccggctggggaagcttggggatttgggggagggctgtgcctatgcgagaggtcgtggtgcgtgctgggttgtgccggaattggctggatctccgggtgagatccgtgaggagggggcgatggtgtgcgt

SEQ ID NO: 65049 - DNA, 3564 bp, Oryza sativa
ccggccaacaacagcatcaaagttttccaaaggaaaggaagtttcacagctacttgcagatataatataccgtgatctagttgttgtcaaagtgtttggagctggcaatccaactacaaccaaaatatcaacaatgataacactgtatgcaactgtgaggttgatgattttaccttgcttcccttctggcgtagaatgtacattgttatattcatgggtccagacaaacaagaagaaaaatctgagaaggcgcttaaacaagaatccttcacatatcaaacaacgaagcttgaatttgagcctttcaaaatgaatttccatagtactgtgaacccattgcgtcaaagggtgatacttgctctagaagcgtggaacaaggaaggcatagcagaattgctggataattgctgcaagattgaaggattgtatgtagagcatcatatagaagatctttcgtttttcaggctagctgcatggacaacaaactgtgatcttatccctaagctgatagactggaacatcgacataattgaagagaaccaacaaacactaatctcgattggaagcaaaacacatattcatctacagtactgattcacatcgagaagttgtttgactactgcgatgaagacagtggaagtgaaaacaatagagaggcgctaagtgaatatgagaagaaccaccctcgactgccaatcataaaaacattccaatgggcgcaaggccagctcaactctgatgtttggggttgttgaaggcggatcatcatcggtgccaccacgccgtcttcctctcgaacttcgtaggcgtcgacgatagttgcatccctctaagtaagaaaatacatagttatatgtactgtggacaaaaacaaactagaacatacatgcctatcttatctattgtacgatccgttaacttaaagcaagctaaatgcggttgtgctagcacgttcattacctatatttaaccgaacattgtgctctaaatttactatatgttcctactataaacctgctattttttgctctgtaagattattgaataatggttcgtaaagtatatacctcttaatgaacggtagggcaccgtgaagcgtgcatgaagtcctagtatgatatattacaagtatgaagtagtatagggcatcatggagaggtaaacaaaagcactctatcacacgacatcccccactctgcttgctgaaatatatatatatattgaattagacaggaatgaaaaacatagagaacataactcacgaagtttcattaaaattcacaagtgaaccatcagatggtattgttcctatcaggaaattcatgcaaacattgctgcacaggtgaaatttcttatttaatttgcagcacaaagttagcataacaattcaatggatttatcaagataaaaaaacactcacaatgaagtaagcttcgtcagcttatcacaataaaaaagcactcacggtgaagtgcatctttgcagtgccaagggcccgagaagacactccgtcggcagcagtgatggcgatggaggcgggtaggtggcaatggtgttgtgtggcttcgtcgtctcgtcacggcgatgtggcaatgacggccacgcccatcccgctcctcctcgttggctcatctgacgacgtggtccaccggcgtggtagcgccgatgctgctggtgctggccgcacgacactgccatagcccgtgccatgtaggtcgcccgtcgctgcctcatgtggattaagacgagcgaggagcgaccagatgagaggccgatgacgctggaggcgttcacctgctgctacttgctagatacctgcatatgggaaattgcgacctcgtgtgtgtgggtgggtgatgacctcgtgctgtagccgtgcagtggatagagtatggaaaacgatatggccacactcttttttgcccagccggctctgtaataattgatttatctcgtataaaaatatgcactactttttttgttctcaaaccgactacaaataacttgagacgtaaaaattgggggcaggaaacaaatttatttataataaggatacaaagttgttgcctcattaaaaaccttacaccctagagtagggttccccctgtaaggaaaagagtacaactttcttacactattacagaaattgcattattaatttcgattggcaccgctgccataagtggtgatgccaaattccatcaatgcgtctgccgctgcatcagtaatctttggatcctctaaccggtattgtgtccttgcttaatatgctttaatccagtctttaaggcaaaatattgcctcaactgtgtcaggtgcaaggcatgacctctgttcttcaataattcttccaacctcgctaaatgcatgctccgaagagatagaggaaaccggaaccaatagaacgccctgtgcaaagtgagctagcacatgaagagttcgttctttctctttccaccgctcaaggagatcgaaattttcaccatccaatgttcgatcatgttttgtgtgattggtgttgaggtaatggttaagctctgcatctggattccaatttgacctactacctgatgaggaggcttgtttcttgcccctgatcttcttccacatattcattgcacttgatttgctttgctttttttgtggggtttcctcaggcacctgacgagcaacacttagcttagtttggtacagacggaaaaccttgaacaactcatctttagcatgttgataagcttcaaaataatcaagactcattgcatcacctattgatagaaagcagtctccacaacctccaactttttacggtgatcaagtatcaaagcaaaataataaaggtgtggaatagcagtgaagaatttgagaaatttttcttccatgggttgaacaacagaagctaaaactctatcatgtcggtttttttgaaacacaagggacaatttccaaagacattcaagcaccttacaagaagtacgatagtaaattctagatagtaggactgtagctttataaaaaggctttaggaatatacgcagacgtgttgctatgttccattcttcctcagtaagaagcaaaatctcaccatcaccatccttatcaatatcattgtttctaaagtgcaatgaattgatgaaaacagaaattatttcctcataccctttcggttgacgcaacatgaggtatgttgtgttccacctatgtttcacgtcaatgccaagcatcctcacaagtttattctttgctcaagaatagtcccggaatctctccttcatcactgattgaccctcaatgatagaaacaacttgacgaatctttttgagtaaattagtaataatactaaatcctgcatagacaataaattccttgtcacggatgcattaaaattgataaattatttgcactaaaaaatctataaattctcaacgactcctaatacctgcttgcacaatcaggttgatgatatggtagatgcatctctaatggataacataacctccaatgtactttgtagatttggctccaaaatcgtcatggccgttgtatttgctgatgcattgtcaagag

SEQ ID NO: 65050 - DNA, 4731 bp, Oryza sativa
ccctcaaatttttgctttcacccatcctaattggtaggtcctccaaaactatgtaacgagcaattttcatcttgagctactcatggctcataggtccatgtacttatagaaccgtcgggtcagaagctcagttgcgtctaccttgctcccaccattgctttatccttaaggtgcgccaaatattgtcggttgagatgtcctgttcctgaactagaagatgcagacaaagttttcccataatgtttacaagtagcacgtgttacaagttgatcgtccaccattaccttcattttttcgaagtgccgccaacactccactctccgtgcagatggtgtggatagcttggcctcgcctcccggcatgggcaagaccgtgtcgtcgttggcctcgggaatgggctattccgtaggatcatccccatgtccctccagaccatccatatggcggtcatccatcccttaatcgtccatacccggggatagttggcgatgatcgaccgacctacgggaaggatcaggcgagcctttgcgggggtctcgatgaggtcgacctccgacgagtatcaccccacatttttgttgtgggagggaaataactatattgcttttgttctgtttatttgtgctgcattttttatttgctgggaagaagaggaggaggaggaatttatagaacaaattgccttcatgagctagttgtttctagttacacttgcacatagacacaccacaaaacacacttgctgcctgctggctccatggagacatagacgcacaaccaatggccatgcgccatgcccatgcttctctgccaccaggcgtcccatctccatctcaatccaaggcgggcgctaccctgccacggcgtcttgcggttgtgggctcgtggcgaggcggcaaacggtgatgccaggatacgaacggacagcagcggggcagggcaaggacaaccgagcaagggaatcacaagtactagtccgagctctctgtttgtccagcggtacatcgcaggtggtgtccgacgccgcgcgacgctatggctgcgtccgttcggccatcagccatccccatccccggtactcgaccagtcgacctccccatgacagtaatggactagtggtagcgacgcctcgattcattgcgccaatgcggaagggaatcgccggacaccatcgcattcttgcaggagaagctctgagcatctcatagagatgtagactcatacgcgcgtgtgacgggcggccagagatgctcagatgcgtcctagacctgcaaactgcggtgccgagcttgttgccggggcctggaacgagatgcgaagcgggaggaggcaccgagcatgcgcgacgacggaggcacgggtcacgggtgcaacgaagacgaagggacgccgctaagcctttgacgccaatgtgcttgcgccctagtggctaggcctgataggccattatcgttgccatgggccatcggtcgtcgtgcctacgggccgttcgcgtgtcgtgtcggcccaagcacggcccactagtcgtgctgtgccgtgctatgccgctcgtcgtgcccgttgtctaggaccaggcacggcccacatacaggctgtgccagcccggccaatttacgggctgtgccggaccgtgctttctacgggaagaggaaggagagagagaggaagagaaagaaaaaaatgagtgagagaatgacatgtgggtcccacatgatgtcttattaggatagatcatgtcaaagcaccacgtcagtgaaaccactattaaaaaccgttagaggagttaaattacaccggtttttatagttaagggtgtcaagatatccggttttgtggtttagggatatgaatgaggttggagctatattgtgagggagtcaaaatggacttattcccagtatgaacactgcaatcctactagctgggccggtgatacggaagcagagaagcacccgtcttgatgggccgcggtttgatcacgccaacacccaaaacaggccgaaatgcagcccaccagttcaggcacaaacgattaaaaccaacgcacgccgttggatctaccaatcgtctcatcggacggatcacagcgaactccggcagcttccgcaatacccgttcacgtggctcgcccgggccgcgccaaagcttttctcccgtggcccacccacggttgccgggcaagaggagggccccgctcgtcatccaagcgtctcagcatggacccacctgtcagtgtcacgtgatcccccgcgcacttcgaagccctagccaagtacagaagccacccccgccgccgcctcacaacctcactccccctcgcttcaattctaatcccccccaaaccccctccaaaccctaaccctactacgacctccccttcctccgccgccgccgccaccgccaccgccaccgccacgtccagcctccggtcgcctgttcggatcgaagcggtgaggattcgcgcgtctcctcctcctcgcgttctcgccttcgattcgggccgtctcgtgcgtttcccttcgcgttctctgatttttttccggtttttggcgctctcgttttgcagatgtcgtcggacgatgaggtcagagaggagaaggagctcgacctctcctcctccgacgtcgtcaccaagtacaaggacgccgccgatatcatcaacagtaataaacgcctctcgattttacctttgctattactgtcgtgctcgagttcattattgtctgctttttgctgggtaatggcggtgttttgttatccgtaagcacgctagggaagtttatgctctgtgttgttagcgttaccttgtcttacttgggaaagattagcttgggaaagattagctacgggagtttagctgttttatttatggactatgttttggtaagggaagaatttctgtgatgtagacgatttacacggtttggattctagtgttagttttagcagcttcgttgaagagtaatatgctttctttctaggttagtagcatgctcttcttctgtattgtcactggctttctattcaatgagtgcaatattatgtctgagtctctgcctgtcgagaaatcatgtgcatagccacagagccactcactggattgcacagggatgtgcatttgtgtttagccttgtgttctgatgtctggtgttgtcagaatcactagttcctcctctacgttctcccgtccctcactccgctattgttgctcttacatgtatgaggtgattattctatgttttgttgaggggaaaatggtgctctgttatccagggtagatttgccacaggctttgttttgttttgttagcgtagccgtctttagctatttagttgagccaaaaaggttgttttttgctaagatatttgtttttgcccagtttgcaagtctgatatgtgatgttcgtagttaggtagtatcaactcaatataagtttcagatatcacaagtagagaggagttgtgagtaatatgtgttaagatagttcccttctttcctttgtccattcaattatgctggcacagtgccaatatcattttgttctgcgattgtgccggaatgccaaatatgttgtcttctatggtgatactagaattgtagtgctaaattgatttttattggtgaacagatgctcttaagttggtagtgtctttgtgcaagccgaaagccaagattgttgacatctgtgagaagggcgattcttacataagagagtaatgcatctaactttgtcttaatgctctctctctctctctctctctctctctctctctctctctctctcgttttactgattacttattttttttctttattgatatcaggcaaactggcaacatctacaagaatgtgaagaggaagattgaaagaggtgttgcttttccaacatgtgtatctgtgaacaacacagtctgccatttctctccgctagccactgatgaggcagtcctggaggaaaatgatatggtcaaaatgtattgtgctgttctgaccttttcaacttgttcttagtctactttgagccttaatgattctattttcatttgacagtgatatgggatgtcatattgatggttttattgccgtggtggctcatacacatgttatccatgatggagcagtcactgggaaagcagcagatgttcttgctgctgccaacacagcggcagaagttgctctgaggcttgttagacctgggaagaaggtgcattgaaaagcgttgctttatttacttgctctctttttgcaatttatgctgttcacatttagtgtctaggtcaactgtgcacacaaatgttgtgcttgtttctcttactatgctattatgttttgctagacacacaaaaactgtttggtagtgagctaacctgtatgtcttctctgcaatgaattaattcagttgcatgcctttggtttgtattagaatgctgatcttgccagtaacaatttttcttttgcagaacaaggatgtcaccgaagcgattcagaaagttgctgctgcttatgactgcaaaattgtggaaggagttctcagccatcagctgaaacagtttgtcattgacggtaacaaagttgtacttagtgtgtccaatgctgatacgaaggtggatgatgctgaatttgaggaaaatgaagtgtatgcaattgatattgtcaccagcactggagaagggaaggtgagaatagctgcttttatttgaaggattgtcttctgtttgcttttttttttta

SEQ ID NO: 65051 - DNA, 882 bp, Oryza sativa
ctatcatgcccttcactgctaggttgctacaataacgcttacttcagacgcacctttttgtttactatattgtaacatgcattttgaattgtcacagggcattggaagagaagcgtgcacgcttaggtttggtggaatgcatgaatcatgaattattgcagccgtaccctgtccttcacgagaagccaggtacacatatcatcgctctaggtgttgaatactgtagaattttggcaattgttctgccttgtttttatgagataagccttggggcgagtacaaatctgtatcctccttttgagattatttgtgtttatttgtacaaaccgcttctgttgattactgctacatgccatatttctcgtttctagtggttgtattaatagttggttgtttgtgcaggcgaccttgttgcacacatcaagtttactgtgcttctgctgccatctggttcacagagggtaacatcgcattcacttcaggagttgcagcccactaaatccattgaagacaacgctgagatcaaggcatggcttgctttggggacaaaaacaaagaagaaaagtggtgcaaaaaagaagaaaggtttgtcctgttctttgtaacacaattttactggtttttttgtatttaagttgcctcacctggatggaaccttcaactcacctaactaccattttgtcatctacaggtaagaaaggagatgcagcagaagcagtgcctatggaggagggttcaaatgatgcaaacaaagaataactgattgttcttttgaattgcttccgttagttttgtacttgctccactgcatctgatgctattatatcacgtcagttgtggaaaatcgagtactttttcaaacttcctgggaaatgatccgtc

SEQ ID NO: 65052 - DNA, 2530 bp, Oryza sativa
cacgttgcagtgaattgaaatatcctttcgctatttgctaaatattgtttttatatagggtgaaacaacgcccaattttttttggaaactgttatttcatacgttgtagcaaaatgtttcacgaggtgatttggttgtgtttcaacttttttaaaatattgaaacattttttatctacttagtgaaacaattccgatctacttggtgaaacaatgcccgatttttgctaaaaaaatcgggcccccgatttgtaggtggccccctattttttctttacaaaactatgaatgaaagattcagaaggaaacagtccttgcttccttacatacccttcttaatcctgcgttacatatacctcacacatgcaaggccttaaaattaaccccacacttaggatatgtacaacaacactcaatagctggcacataatcggccaactagaccaataaaattttagaagaagataaggagaaaaatttcttcatgatgctggaaaagaaagaaaggataataaaattattttgtgggtaactgttagaacctttattgtctcaatttttagaagaagatagtctctacttaacatttgttgcctaggatttaatacttaactcgagtacttgcctgaacaagtataataagaaaaaaatggctagttataaggagatcgcgtagcatggccgagatatctggttaaaatcatttattgtctcaattgttaaaaaaagagagtttctagttgatatatctaggaattactgttaaactcaattgttatacctgctatacttgcccgaaccagtacaataacaatagagataatccaagaaatgccattgacaagcggctagatccaagaaataccatcaacaagtgtgagttccaagaaatgccatcgtacaaatgactttgtcccaaaaatgccatcgccgttacggttccgtccatcctgcgctgttaagtgctataggatgaacagtgtatttaacggcacgggatcgacgaaaccttaacggcgatggtatttttgggacaaagtcgtttacacgatgtcatttcttggaactcacatttgttgatggtatttcttggatttggacgcttgtcaatggcatttcttggattatctcataatgataaaagggctagttataaggaaaccacataacattgcatatctagctagagcctaaggagagagatgaggagagaaagggtgagttggctactaaatagtactcctaactaattgcacatgagctcgaagaaagtgaggtccaacgcaagtctctactattataaaaattgaagatgtttttgtcgatactttggtacgtcatccatgcatgagtcggtttttaagttcgtttgcttttggaaatatagatctgtatttgagtcaggttttaaattcgttcacttttggaaatactagaagtcatataagaaatctcttaaaaacacttgtatgctaacttgagatgatcggactcctaaatcctaattatagctcataattttctaaaaaaatatatatccaagcgaatcctcacagtgaaactattataaaaattgaagatgttttcgccggtactttggtatgtcatctacatatgagtcggttttgaagtttgctcgcttttggaaatacatatgtgtatttgagtcgggttttaagttcgttcgcttttgaaaatacaggagcagtcgtataagaaatctctttagaaaaaacttgcatgctaaattgagatgatcgaactcctaattgcagctcacgattttctagaaaaaaaatatccaaacgaattctcacaatgaattttgccttaactaaacctataataacagtaaaattaaaatagccttcacctgttacaatgcacgagcaatttttatagtaaataacaatgcgtaggatatagtagagtgtgaaaaaagggatttggctaaaagtctactccctttataaaaaaattcaaatgctaaggatgaatctagaaaaacaaattcaaatgctagggatgaatctggacacaagtcagagtcaccgctaacaaatactagcattacatacaggatatgggagtgtgtgtgaagtgatttggctgaaaatctattggtaaaatatgtttcatgattattgtgtcaatagctacctactatatgctctatttgtatgtgtatctttaaatgatgtggcacccattcatattaacacttgccttacaagttgatgatcgacttttttttttaataattttacatggcttctaatatttttctaaagacatactactccttccgggttgataatacttgtcgttttggacaagggtgaggtcaaattttaaatctctggttataaataattttaaaaatatttatctttgaaatatggtgactatatgtatagattagtcttaaaaaaatactccaataaaatcatatatttgttaacatttatatacatattataataaaaaataatggtgaaagttgtttttttaagaccgtgcccttgtccaaa

SEQ ID NO: 65053 - DNA, 2626 bp, Oryza sativa
ttgcaaagagtgtttaatcaactccgaaatccattgtcaatatgttgatgcaaatgccttcggtgcttaaatcagcagcagatacaactgtactcttgtgatacactgtcctctttatttgtctacaatttcttttgaaaacaggctatttacattagtatgatatgatatgacatgatcatcttttatcttttagaatgatactggtaataacaggctgttattgcaggcaataaacagcttgtccgttcaagttcaaacagaagggttggaataatcaaaccaaattcacccaagtcccctgttgccagtgcaagtgcttttgagagtgtagaaggatcagatgaggatgatgctaaacaaccgaatggtaaacttgaaaatggctacctgaagatgaatggaaatgttgtaagtttcagccatcctgttgtcattacagtttttcttgttatatagttcctaattcctttattaatcgcctatatttttggagttaaaataggtttggcatcaagttttgcacgcgcaatcagtatatcatgcacataaaggaagtgaatttgtggctatcattttcttaatctattgagcatcgattcttgtggttatctattttcttaatctattattgcattgttttatatgctgtagtttattgatttatcttcttgtcgtttagatttaccttagacaaaagacatcttactggctcaacaatggccacataaatctagctaggcaatactgctggcatgcattataaaaaggtactacacacattgaacactatctgtatttgctggctgcagattttgttagcctgcagattttatattactcaaaacctagtaaccggcaggagataaatgtgagttcctcggacagtcattctacagttagtgacttggtagaagaaatcatattgctaactttagctgtacaaccaatagcatttggtgctgatatgaataaagcgtctgctcagctggctgtgatgctgctgcactgcacagccgcagcaaagactaccaagtgcccaaatatgctgatatttctctctgtttgggggaaatttgctgattttcatttggtacaatggctgcgactgattctgtttttttttaatgtctgatcatatatgtttcaatcaggaaggagaacagaaaggaaacaaagtactggaaaatggggctgcagcgccattagctgcagcaagtttgattcggtctcatagtatatccaatgatcttcatggtgttcaacctgatccagttgctgcagacattcttcgaaaagaacctgagcaagaatcatttattaagctgttaactgctccacatggtatggtattagatcttacagaacagtaatattctccctgtatgaatatcctttaattttgttatacttccattttttatgagcactaccatttttgttcttaagaaaatttgtccgataaaatattcacatgctgtattttatggactatggagttctccatttctttgaactattaggtgcaagtcaagaacctggaatactagtaaaaattcatggagaccatattattgaaatgtatgcatgttagtttcatatttttcctgtcaattagtcagtaattcttttgtattttaatgcatataattttagtcggatacatcaaatttcgttgttagtaagagtaaatatttttgaattaattcttctcatttccctttattcccaaatccaaagtaatttctttcataatattattttacattttatgtagagattccgtctcctgatgagattgaggtttacaagctccttcagaagtgccttgagttaagagactgttatctttttagagaagaggttgctccatgggagaaggaggtcataaatgatccctgtactccaaaacctgaccccaatccgttcacctatgtgcctgaaccaaaatcagaggtagcctagttcatttttttttcagtatttcgattcttcctctctgttttgtccttctgatttctgccattgattatgatttcagcatgttttccaaatggtcgatggtgttgtccatgtctatgcagataaagactgtaatgagcactgcccgttagcccttttgcttcatatgtttgaccagatgctttcaatttcctatgactcatttattttcctcattttgcctcagatacggaaatactttatcctgttgctgatgcgacaaccttctttactgacttgcattatatgctccgtgtgatttctgctggaaacacaagaaccgtgtgccataaccggttaaatcttttagagcatgtaatcatattgtcaaatcattgaccccttgcttaccttggtgaataaacttgactcctaaaattctgtatgtgtgaatgttttttcatttctagaaattcaaatttcatttgatgttaaacgcggatagggagtttcttgcccagaagactgcaccacatcgtgatttttacaatgtcaggaaggttgatactcatgtacaccactcagcgtgcatgaatcaaaaacacttgctgagatttataaaatccaaactaaggaaagaacctgatgaggtatatttttgaaacaattgctgaactgactgttg

SEQ ID NO: 65054 - DNA, 925 bp, Oryza sativa
cagcccaacctgctagcctaaataacacatttgtcaaaacattaacgaataatcaataggttactcaaccttcagaagctactccactgagcaagttacatgttccatcattaagctagctcttaagccttacccatgaggacctaccatcatcctcctatgttttgaacaaaattccacatttctttattgataaccagtgttcaataggtgcatttcaaaaaggtactgctcaaacccactacacacaagaagcatgttagtgtatctaagcccacactagcttcattccatgctaaggattacctcgtgcacgaaatccttccctctttctgtttttgaaacacttccagagcttgttatacacagttttcatggttcctagagcttgaatttagcattcatgttccatccaaactattcgtaaatccatttcatactatactactagattttcttcttctgcattaaaattcatactaacttcagcactaaatgtccaccagaagagttatgggaagaacacttgattaaagcagtaaacacaacaatgctttcctcctgctgacacactgcgcatgcacactcggaggccattattttgcaaagctagcttagcttagctgtctcccactccaagccaacatcaccaataccaatcctatccagtcgagccaaagccgcacacacgcgccccacaccgcccacacgtgtaaaaccagagaagggacaaaactcaccgtcgggccccacgtgcagcctggggaggccgaggggaaccgggaggcacgcctcggcggcgtcgcgagctccttcatgccgtcgtcgtcgtcgtcctcctcctcctcctcctcggccacggggtacctcctggcggcgcccgcccctccgacgccgaggccgacggagtagagcgaggagaggt

SEQ ID NO: 65055 - DNA, 1293 bp, Oryza sativa
tctaagccatacttgtttgggaagttataaaattcgtttatatatattcttgttttgccttgtcttcgatatttacactactgatctgactctcatttcattttcagacaatattacggtaccaaaatcagtccaaagggctagtacatcagatgcctctcgagcaagcagtcaccttacggatctgtcattttcgaaggaggatccctggacaaataatgtaaaacaacgggaattgttgcttgatgaagttgtaggtagcataacaggaggaaccctgaaaacgtctggccttggtacttcccttgtgagcaacacaaaaggaaagagaagcgagagggaagggaaggggcacaaccgagatggtagcagatctgggcgcccgtcatcatccaatgcaaaaggagaaaggaagaataaaacaaaacccaaacagaagacagccaacatatctgctcctgtcagcagcgctctaactagggatccacagtcgcaggccaaaataacgccttctggcaacggcagggacaatacctctgctgctagtgctaggcatgaggaaccagcaaatgcatcgaatgacgcagaaatgccggacttgtcaaacctggagctcccaggaatggatgttgatttcggcggctggttgaatatagaagacgacgacggactccaggatctagacttgatgggcctggagatccccatggacgacatcaatgagattaatctcatgatataaccgtagcttgtttatctacgggccccccatagaaagcttcctatagtgcacaggtaacaggtgattttctcaagataaccaccaaccccagcaagtttaacacaaggccagataggctccaggtagttttggtaaagtttatagagacctcttcacattccactctcccacttcctctctgtatcagcgtgtacttatgcctccctaccttgtgccgtatgttactctgtggtgtacatatctattttggtacggtacgaggtagagtggcttaattgcttcatttatccagagaaatgtgtactcaaaaggctgtacatatatgatcatcatccctaatgctgaaataaaaccacgccagttatagctttaatttactcgtcacctgttagctgcggtttcccacaacagttggcgcacgatttcgttgctgcctgtcaggcaccctcttccccatcccaatttgaaaccacgttttgcatgcctctcaagtcttgtggggtatcccactcccacgtacaaaattgatcagtcattgtctcgtgtttgat

SEQ ID NO: 65056 - DNA, 3719 bp, Oryza sativa
atagggtgtgtttagttcacgctaaaattggaagtttggttaaaattggaacgatgtaatggaaaagttagaagtttgtgtgtgtaggaaagttttgatgtgatgaaaaagttgaaagttcaaagaaaaagtttggaactaaactctccatagaaactagaataaattgattgaaaaaaaaacagtaaccgaacatatatatagcctattaaaatagaaactagaatgtggtcaagttaagacatggcatattttagaaaaataaaaattctagcaatgttgtaacccattgtcataaaaatttggataagagtaaaaaaacttattacaaatacaatgaacaagtaaaatgagggaaaaaaaagaaatgccattacaaaataaaaacatagcaaaatacttagacataatggtgaggacattgggacaggatcctaatatcctatgggacaggatcctaatatcctataccttcaacgttagagacatatgggttttgaaggtaggatcctaatcactatgggcacttttggaacataggatttataaaaaattaggaatagtatagaaacgcatatgaaaaaaaaagagggtttaaaaatatggggaggtgggatgtgatgtttgtagcttcgagcattggtttattttagatttggcaaaggaaaataataaatactccctctgttcagattgaattctttttgggacagagagagtaggttgcaagagcatctccaaccgattgactattttgagctctcaaaatgctcatttggccagtcatctaaaaaattagtgagccaaatttgcctttcactccaacattctctccattctagcaatgggatacacacatcagccctatctcctttttttctcccttctttgcacaacctctcccctcacctatcaccgacgctccaagacagcatgggagagcaggcgacagttggcggttgacgagctcgatggcggcaagcggatccaggcggcagccggcgacatgggtgggaagcggcgacgtgaacgtccctcatcgattcccccgtgccgtcggtgggcgggcaggtaggcaaatctgacgaaggtgttggcggcgacggaaatcggcggcaacggtgacaacgttgctgctgctcgcactaatgagaggcggaggcgatgccgtgggctgcggctactcacgccgacaagggaggcagcgggtgggcgggcgggtggatctgacggcggcggaggtggcagtggaaattggcaactacggcagaaatcggcgatgacaacgacgttgttactactgctgctcacaccatcgagatgtagtggcgacgccaatgccaacggtggatcctcagctccatccctgtccgccgccgctgctccaaaccgatgcctttgctgtgctcggatgggaggcggagacacaaagtggtgtggggcccgccatttggccagtgagtttgcctctccacatttggccaggcagtggggacgtttggccagtcgaatggcttagccatccggttagcaactctattggagtattcctttttgcttgacttgctaaaatttagcttggagaggcatttggagagaccgctggagatgctctaatagatgttgaaatttaaacttttttctagtaatggattctattctcttgaggacatgtcttcttgtgtaccattttcttttaaattcaatgcaaatagttatttttttaaaaaaattgacaatgtagagtgtagtaacgtctagcactccgcgaaaaaaccaagttcaaattcaatctaaacaatgataaaaaaaagacaaattcgaatataaatagtactactattcatttgctgaatttgtttttcttttcgtgtatcaatgtgtaagtttggacctataagattttgtggagcactatcaccttgtttagttccaaactttttcttcaaactttcaacttttccatcacatcaaaactttcctacacacataaccttaaaactttttcgtcacatcgttccaatttcaaccaaactttcaattttggcgtgaactaaacacacccataataatataagggattattctcttttgggaaagattaaggatgagaagaaaagactacaatacccatattaaatgtgattctggttgtggtgactgggtagttgagggttaaaataggtagaaatttaaattagaattgatggatgtgacaagcagtgaagcaaaatctcttatattatgagactagtagaagggataaaatctcttatattatgggacggaaggagtatatatatacattgtatgactattgtcagtcttttttttagatttttttcataactacttgaatgattttcagacaagtactcaagggtttaaaacaattttcctgtttttcaattggaatctatggcaaaggagaattttctccagttctccctaaacgaatagtgtgaatttctataggaatctgatcgtctatttctccaacaaaatccttcaaaccaaacgaaacgacccttaaagcggtactcctacatattattgccgggaaaaaaaaagaatgtgatgaacgaaacgaaatgataacggcgagtgctgcgcgcgcgacgaggtttcggttcagttgggaaacgccgctgccactgaatgcacgcacgcacaacgcctttgttcaaggaagggatgatacacaggagtactatccacccaaccaaacctgaaccgcccaactgaaaaaccaaacggctcaatacccacatcaaaccggctctaactaatttaatcacacgagaaaaaaaaaaccgagccttacaaaattctcaagtaattacatgagattaataagctaactaagctaataaactatatattattatttgagtaacaaaaggatggaaatggagtaattgatgaactaaccaacagcaacaagtttgttttgagttggaaatggaaaaggctttgcaatgtaaatgcaatgcaacaactacaagaagatgaatcaagattagagatctatgatcggttgatcaatcaatcctgaccgttggatgggcggccgtcgggccctttccggccgacgccgccggcgttgcccgtctgtgccgccatcgccgcggaggatgccaccagcgagtacaccacgctcacctgccgctgcacctcctcggtgatcatctgccgcatcatcgccatcagccacgggtcctgctccatcctcgccttctccctcgccacggcctcctcctccgcgcgcgccgccgacgacccgccgaccacggtggaggctgagatggcggcggcggcggcgcccggcgggctgagcgacagcgacgtaggcgggtcgggcggcggagcccggtgctccacgccggtgggcggcgccacgcacagcctcttggccgggggcggcggcggcggaagcacagggacaccagcgacgaccgccgccggcgacgactgcgcagggatcgccaccgagtcgtcgctggtgccctcgtcgtcgttgtcggcctcctcggtgagatccatggactggtacgacacggatgcagccgccgcggcggccgcggcggcggccctgcggttgcggcggagcgaggagttccagtggttcttgacggagttgtcggtgcggccgtcgaggaggcgcgcgatggtggcccacttgttgccgtacttggcgtgggcggcgacgatgagcgcgt

SEQ ID NO: 65057 - DNA, 3800 bp, Oryza sativa
gggcgcgcgagaggcgtttccggcgcgaggttttcttgggcgttttcgcggtggtttttccattcccccgcatgcgttgcgttggacgacacgggacgatcgaggtcgtggtccaccaaccgccaggcgcgcgcgcgggcggcacgcacgcacggttggatggggacgagctccaactcctcgctctctctctctctctttcctcgtcggagtccggtgttggagcatgcggttctcatccccgccgttacgggcgcacgctcgcgcatgtacggggggtgatgtgggtgtgtgtgtgtgcggggggaggggatttgctgggccttttcgggacgtgtcgttggaagtggaactggagcgcgcgcggctgcgctgctggctgttacgtcttctttctctcaaagaaacggaagtcgtggtgtgcgtgtgttgtgggatctttttatcgtgttgatctgtttaggtgtgtcgtgtgtgaggaccggcagtgatacataggtttataggtttatagtgagagtagatttcttttccttttacttatatatacatatatttttattattaaatgtgtacatgttgtaattgtaattttttaatatatatatttttttatctatgtgtccacaaaatatgtaataatagattggtcgattttggtttggctgtagtgtatgaaggtgatatattttgacttacacgaaaacccatatcttgtatttaatatacatttaatatagtaacaagtatttggtcgtgtcatataacctatgaaacttcatttctagatcccaaaagtaaaccattctagagacgggggctgaatcgtcttgtatagtaaaagggatgtaaaactttttgatggttaccgggggaaaatatgttacttgcgaaatgctggagcggtttaaccgtcatttaagtacgggcaggagcatcgtgtgtcttgccatgtttgggctggtagtgttgatggggactacaagtcaagtgatcagcacttccccggccagcgttggcacatgcagttctcgctgttacagccgcacgcatgcctatgcatgggatgatgtgggggtggaggatttgctggcctttttcaggacgagcgtgtcgctggcgtgagacgtgtcatgggagatggaactgcggagcgcggctatctgttacgtcttccttctgttaaaagggtttggcaccttgcgttgggtgtgtgatgtcgtaatgtatgtgattgttgtggggaccaatagcaaaaaaaagtgagtttataattatagatagcttgtttttaattttacatttttatattatatatcttttattgttgaatatgtacttcgtgtaattgtagttttttctgaaatatgttttgttatcggtgtgtcaacatgtatgcaatagtgaattggtccattatttagcttgttttagctcgagtctatgatggcgataggttttaacttaaatgaaacttcatttgatcttgtaaaattaaggtggtttattgtgtcatatagcttcatgaaacttcatttctaacttttcaaaagtaaactattccggagatgggttaaactgttgtgtatggtcaaaagggtgtataacttttgatggttatttggagaagatgttactacttgtgaaatactagagttatttactgttatttaagggcggacaaggacgttgtatgtatggatggacctggactttggacgggtcccgcccagcccatagtgattttagcccaaacatctaatacatgatgaaactagatgggtttaaatgagaccttcacgcctcggatggcagcctgggtggtccggggcctaggtccactcctaaggacttgtataacccgtttacatcgtcttattgtactcgctcttatgttttgattgaacgaaacctgaactttctattcgatctggtggcaagtgatttatcgtgtcgatcgtatagtttaatggaattctatttctatcttacaattaaagtaaatgagtttagatattcctttaaaacacgaatagttaaaaaaattcaactgcattatataattttgaacataggcaataacttgtatcattaacgtaaaaaagggggaaatatactgctataaatcttaagcatgactaatagttgtatttcatgctagcttactgaggttgcattgtatgaacaactacttggggcggctattgcatcattctccactaatacagaatggatttttgtggatgaggctccctccaggctccaggcggtccgtaatggcattcgcatgggccaaggaggatttggagagattataaatatgataagtcattcttaccgtggcaccttttagaggaactaccatgatagatgaggacgctacatgaattttatatgaaggcatttagaaagggcctcggttttattagtgtcaaggtcccgcttgatgctttcatgtgtggactcaataggatattcataatcgatttgtgtcacctacatgcattgttcaaactagagaaaatggatgtcaatctcgctaccacattttgtttgtaagtgtttactcttgtatgttccacataaatgtaggaaacaaatgtccgttgatttaagttgtattctataggacgaggcaaccggttggctatgtcaacccaactaattaagatttgcaagacgcaacatactatagagctgcatgtgaattgcatggaactaaaggtaagatagccaaggaaaaggaatcatatatcaaaaaaatgcacaagcgaaagaagtacgaggtagtggtatacttggaacgagcaatgcgctcacaccaagacaaaagatgtcataattttcccatacaactttaagtaagcagcaactcttctatttcattacgtggttagtgttcaatactacataattactagcaaatatcgcctctaattcatctatcttatttgcagtgaccactacattttatttctagtatatctggtggtgtttttacttggtcatagtgctcgacccatcaaactataacaagaatagctacatagagttccttactattttgactttggaagtaaataccccctgagtaccttaatgttattctgaaaattttgaagtaactcaacaagaaataattttatcggcacgatgcacataggatatacgttaaagaaggaatggcaataaaggagcaaaagccaaagctatacatcaaaacgggttggctggtacttacacatgacatgtacaagaaattttcaaatgattacttatttgtaccgagcaatgttattattatgttcgcagtgtttcaaacaacccccaagcaccctactatgtactatgtatatattatgtgtgcaagatgcttagggtcaatgagaagtacaaatcaaaccctgataatgtaagtcccgagattattctctatacagagtatttcatccgtagttcatttcctaacatgtattgttagtttttagcaaattcatcaaatcccttatgttgcaaacaagttcaacatggcaacggtttggaacattcgcattggcttgtgttacttcatctgccatgactgttgcaatgcactaggtcttttttttacaacaatgagagccaactgaatgcagaagacaaaatgaatcaccttcgagagcggggaatagaatatgtgaactgaaaatatactatttcataaacgagatcgatcatttgtaatatagttcacaaacatatgtttatatgtacaaatatataaatattttctgttttatatattgaaacatatttatttg

SEQ ID NO: 65058 - DNA, 9143 bp, Oryza sativa
catgacaaggttcgaagaaaccacgcatgagaatgccatgagaggaatcactcgcgcgcatatttctggcgataggcatcgatcgatcgatccttttgctgtagacggacaggcacagatatatcgagatggagacgtacgccatgtatgtgacctgtgaactgtcagggttagtttagcagcatgcatggacgagatggcccaaagcatgagcttcactgtcacatctatatcggttcggtttggctcagtatgtaccgccggccggtggttcatggaaagcgcatcaaacaaaagtgtaacaaaccttctgctagctagcttggttacttggacaactggcaaactctactgcttctgcccatgcatgccatgtcacttcttgtcatgtaccggcaaggaaagtgattgtcattagtagttgttgcttaattaactggaaattggaatatgcattattcttcttttagcaaacatgcataaacctttagcgtgtgcttaatttgattgtagggataatgttggttggatggctagaaattatgaggcaatatcgattgatccctatgtttgatataattactcggaatgtaggtaggagtatacagttaattaattccgttctcgtaactaaaattagctagctaggagtagttatcttgggtaatcctacatagaaatttcatatatcgcaaacttcctgtgataaatatacgctagagattaatgatgcgttcatatctctagtccccacggttaattaggattatgcggtgatattaatattaactttaatcctctttattacctatatagtaacaaaacaaacacaccatacgttagcttttcgtagaaaagaaaattaaactaacaagatagataatacaagcaaaacagagaaacacaagagacgaaaaaaggggccgggtttcacatttttcgatcgggtcgggaccgggaataatcgtgtgcggcagcagcagcaaccggtatacgacgacgcgccgcgcgcggcagacggacgggtgcgtgcgtgcgtgcgtgggcgggcaggcgggcggtggcgcgcgcggccggtgagacatcagctggctgcgcgggggagggtggacgcgacggctgatcagccgacgggcgggcgacgacgcgcgcggcgcgcggcggttgggctcgctgtgctgcctgcctgcctgggacggacggggcaccaaaccgttggcgtttggcgttttggtcgcgtacaactcctacgtgtgttacgtcgtacgaggcgactaggcgtgcaggtgtttgcaggcgacgcgcgtggtgtcaacggctgcatcggccgttacggcaggggcagtcaattcgtcagtcagtcagtcagatcaggtggggtcggtttaattggtggtggtgatggtggagtcggagaaaagaaagaagaatttcatcgttggttacagccggatcggaactgagatccatagctgccagccttggcccacaccgactcttgttagatttcaggtcagccgctcgctgctcacaagtcagagctgcgtcggctcaaggaggacgtcctaccttacgcacggtgcgctatggctaactacctctacttttgcgaaacacagccgcactcatctcatatttgtcatataaaggtagagatacatcgtatccctatgcactgtcgcactgacgcccttgagctttaacgcctaataacgttgtcaagtgggcgaccacttcttagagcatctccaagactccaacattctattcaaaatatatagactctccaaacatccatataatcagctatccaattaatttggcaagtcgaactcattgcctcctccaataacctctccatctatattatctattctaagcctattacattgggacccatatatcagtctctacgaccccttcttctttctcctcctctttctccccctcttcctcttctaatcttcagcaatgacagcgcagacgacggcggctggccatggcacagacaacggcggcgacgactgatgtcggtgaccaaggcgacgacggcagctgcagcggatggttagcaatcggagccgcggttgtggcagatggcaacgacgacggcaaccgcagccccgcgcagaggcgatggaggctgtggaggtcgtgccctccctgaatccatgccgcgccggccaaatccggcgagcacggaggggcagaggtcgcgtgtgcccccctggatccatgctgctcaggtcgaatccaacgcggatgaaggtggcggaggctggcgatagtggatggcgacggcgtagatggcggcggctgtggctagcaacgaagacctcggcagcatcgacggatgacggatggtggatggtgatggcgacctcgacgacgaccggtgattgcgatgctcctctgtgtgggtgcgggaagagagaggggaagaagggtgtctgacggcttggggcccatggttggaaatctgatttggccagtcgtgcaggatggctaagtttggctagctagggaaccaatttgctcagctggatggctcggccatccagttggcaaagctgttggagtgcactttttcatcaaactggctaaattttatattggagagtctgttagaaatgcccttacgatatcttgtgactgaatgacataatgttttctattggactaccgttctttaagtggtgaaccatgttttacatgcatcgacaatagttagcatagtagttagtagtggagacgcatagaaggaatcttgatgacttgttcgggagttgggttatatcgaccattactatcactatgagcaactctgtgagactaaatcgatatattttgagatagacaaagtcaccgcatgcgtcttactgtccatcgttgtttgtaattaccaatttttacatgcagatgattaaaccgcctgctaatgaagatgacatcattttcatgggtggcttaagcttccacatgtgaaaatttattcttttatgtgggcggcctaagccactcttgtgtgaaaatcaatgaaaaaacacatatctacacctattattttcatataaagttggacgaagacaaagtttatatctggacaagatctataacattatacttgacaaccttttcatttgaaattatttataggctcaaatacttcttacaagatcatagatctatttttacaaaatctcatatctatgtttcaaataaccttagataaatattgtagaaggagatttggatcaaccgtaactttcattgatcaatggagcttatatttatacatgtacaacaaggcttgggagttgcctgggcctaactaatcccctgatctaagggacgtgcagcggtgcgagcggtgcgagaggagcgcggcgtcgtgcgcggggtgcgcgtcgtgcgcgtggagcgcgccgcgagagtctgacgaagccgttcgccaacacccccccgcagtcgcagccgtcgtatcaccgacgcagagactggctcggaactcgttgaacatgcttgaaggaagcccttttgtgaacacatccgcgaactgatgggcactcggtatcggtaggacgcggagttcaccgagcgcgaccttctccctgacgaagtggatgtcgagctcgatgtgtttggtccgcttgtggtgcaccggattcttggacatgtagacgctggagatgttgtcacagtaagcgatcgtcgcctgtggaacgcggcagtggagttcaccgagcagctggcgcaaccaagtgcactccgccaccgcgttcgccacacctctgtactcggcttccgcacttgacctcgagacggtcgtctgccgcttggacgaccaggagatgagggagtcgccgaggaagatgcaaaagccggacgtggaacgccgggtgtcggggcagccggcccaatctgcgtcgctgaaggcggtgagcgtcggcgacgtcgaggcgcgaaggtgtaagccaaacgcggccgttcccttgatgtagcgcaggatccgcttcagcagggtgacgtgagcttcgcgcggagcatgcatgtgcaagcacacctgctggacggcgtaggcgatgtcgggccgcgtcaaggtcaggtactggagagcgccggcaatgctgcggtaccaggaggagtcctggaagagaggcccctcgtcgcttgacagcttgggtttagcgtccgccggagtggccacggccttgcagttcgccatgcctgcacgttcgaggacatcggtggcgtacttggactggctgaggacgaacccgtcggcagtgcgctgaacttcgatgccgaggaagtacttcaggggccccatgtccttgaccttgaactccgcttgaaggcgatcgatgatgcgctgcagcaagctcgacgaggacgcggagaggatcatgtcgtcgacgtagaggaggaggtaggccgtgtcggagccacggcgcagcacgaacagggaggggtcggcgcgggactggacgaagccgaggctggttgcatgatcggcgaagcgcttgaaccaagcgcgcggggcttgacgaagaccttacagcgaacgggagaggaggcacacgtccgccgggcgagcagcatcctcaaagcctgtgggctgctggcacaggacacgttcctgaagatggccgtgcaggaacgcgtttgaaacgtccagttgatgcgccggccattgcttggaggaaatcagcgtcagcacggtgcgaatggtcgctggtttgacgacgggcgagaatgtctcgccaaagtcgacgcccgggcgctggttaaacccgcgaaccacccaacgtgccttgtacttgtcgagtgagccgtcagcatgaagcttggtcttgaagacccacttgccggtgatgatccgagcaccgggaggccggggaaccagagtccacgtcctgttcgcgagcagggcgtcaaactcagcctgcatcgccgcgcgccagttgggatcccggagcgccgcgcgaacagacgaaggtgtcggcgacagggtcgacgtggcagtcatggcgtaccgcgggttgggttgctgtgtgtgtgcataagcaaagaaggaacgaacagtatgaaacacctcagatgccggaggaagagccggaagcaggtgctgcgcggtcatggcctgttgggcctggaacggcgggcgagggcccaacacacccgcgccgggagcccggaacgggaaaggccaggcctggacaaagcctgtccaggggttgtagccccaaggcgcaggagggcgaggctggccgtcgtgcccggcaccagcgccgccgccaggagtcgaaggagcgccgccaggtggggcgccgccgccccggccacgacgcttgccccgtcccttgggacgaggctggccggtggtgtcggaggtgccggaggaagacccggtgccggcgtagagggcctccccggcttcagccttggcgtcgtgctgcatctggagctccgccagcagcaggtaggagcgcgcggtcatgaaagtgtgtggcggattccggtcggcgatgctggcgcggagggagcggaacttggtgttgaggccgcgcaggaggttgagcacctggctgggctcagacacgggcatgttgatgtcgcggaggccgtcggcgagttgcttcagcttggcggtgtactgcgtgatggtcatgtcaccttgattgatcgagcggaactcggtctcaaggtagacagaccgttggacggcgttgtcacggaagacgccttcgatgtcgctccacacggtgaaggcagaggcgcggggcttgtagacgacgtcgaagacgttcttggcgatgaagttgtgcagccaattgaccacgcagtgatccgcacggcgccactcggcagtgcggaggtcgagagcgggcggctcctgaacatgggcctcaaggccgaacttgccgaggaccgattcgaagctgcagcgccactggctgtagttggagacgtcgagatcgaggacgaccgggacgtgggagcggatgttgacggtttgaagaacagaggtggaaggcgccggcacaggctcttcgtcagaggtggacgaggcgtcggaagcgccggagctgtgcgacatggctagcaagggagaggtagcggaagactaagatcagagggtcactgataccatgtagaaggagatttggatcaaccgtaactttcattgatcaatggagcttatatttatacatgtacaacaaggcttgggagttgcctgggcctaactaatcccctgatctaagggacgtgcagcggtgcgagtggtgcgagaggagcgcggcgtcgtgcgcggggtgcgcgtcgtgcgcgtggagcgcgccgcgagagtctgacgaagccgttcgccaacaaatatgtatcacaatcaattgtagagcttaactaaataagaagtacaattaatgacctttttatttaagaacatttggaggatcaaataagaagtacaatttttggagaggtgaaattaaaacaatggcatgttaattccaaacaacaacgagcaaacctacctgtattaaaaaaaatgttaattctaagaatttatctggacaagcacttgtctatttttagaattggactttttctacaaaagaggggagtatgtgtatctcggcccaattccagagttattttatcgttctcgttgaaaatggtagaactccttcttgtaactttatttacaagtacgcgaattacaaagatataaaaattatcaattctctaccttaatccgtctcaagataaaaagaacaaacagaactttttgataagatgtggacaggagcggtcctatagagctagggctggggcccgataattgggactacatgctcatgggccgaaatgaattttttgggaataagttcactctaggtcccttaatttgtcaccgagtctgaatttaatctataatccgcaatagcagatatgacgcgtccctcagctcccaaaacgtgcaagcactgttgcctcagccttctcatccatcaccgtcatgtctccctcgcaggcactgccgtcgtacttgttggcgctttttctgaccaacacagactcacttaaagatttgcggtgttaacggagtcgccaatcatctcgatctagaaaactctaaaccaagatggattttgaagatttaaccagctagtagagctgatcgatttgaagataaccacccgtctcgtaggcgaaacagaaggtttacaagacaaagctacaaaggggtatcgcactcatgtagtgaaggcgaaaaatttatggcacaaatcaacaaagatggactaaactaggatagtgtagaagatatgctgcaaagtaaaggtaaaaaaaacgattcgattaattttagaggttgtggttgggagtttagaatccaacttgccatagcccttataaaaaggttattcttgcctcacagggtttttcccacgtcctattatgatgagagatcatttttaggattaaaacaaacctcaggcccaaacaaggaaacccgagacccgacaaaatttggattcagagtcatcagccgatctgatcattgccattgggccaatcagatcggcggtgtgtggccggtcagaccggccttccataggaaacctgatcttctcccaaatttggcaatgtttttctatttcgtgtctagatgtcaaatttaggcgttaacacatacccctgcctttttggcgaacttgtgagccgaaaagcataggacatgtggtcttagggcaataatttttatcggccatatgaggttctaagtgtttagtaaatcaatctctttgtaatatcctaacaaatcaataatttcttacgaacgattcacacaacttggtatagatatttccaactagataattactcaccgagcaccttgcacttagacccaacaaatggcgacttcaagatgtgaggtcgtacctatcatcgttcgtgtctcctaatttccttagaagcatattaacattttgcccccgagcaaaatcggctttgttgaatgcacgatttcgaaggtaagataaacattgtgttaacccctatagaatcatgtggaagagattcatctctaatgaccgatggttcttttctcaacgaattggtttcatcactactcttggaaatcaccggtcactcaacttttccttctttgggtctcctcactcgcctaggtattttttgaggctttaattgttgtacgtttcgttcctcacgtcttcggcttttgtcttcatttaatctttggctcgaatacattgtagcctccttttttgaaagcgagataagccaaaagatatccatttcggctctagttgtgttccaggagataaatgatgattcttgattttctttttttcaaattagaagctcctgtgttgccctcaagtttcctgattgtctttggtgcatcacaaaaccagagaggggttgtcgttgggggtttagaaacgaaccagccatagcccttataaatgggttggtcttgcctcctctggaccttttccacgttctattaggcttgtccttggtgcatcacaaaactagagaggggttgtcgtcggtggtttagaatcgaaccagccatagcccttataaatgggttggtcttgcctccactggaccttttccatgtcctattaggcttagagatcaattaggactaaaaaagcctcagtcctaaacatggaagcctgagacctgacgaaattggactcagagtcgaactcaaccgatctaaccgaccatatgctgctggtcaaaccaactccaaccgccagtctgaccgtctcgatggtggcagtcagaccggccttccataagaaacccagtcctctcgcaaatttggctatgtttccctatttcgtgcctaggtgccaaattaggtgttaacaacactgtaacaaccctccctctataagcgtgtagccagcccatccgataggcgggcccactttacacataccaccccatttacactttcgttattacttcgtgtaaaaggattaacctgggagtggcatggttggagggaatagaccttgtaagttggttccacccttgttaaactagcaagttggtactaaacatgtccgtaaagccctcatgggccacacatg

SEQ ID NO: 65059 - DNA, 3398 bp, Oryza sativa
cgtcggattcacttgaccgatcgacaaccgccagcatgtcatcccccaccacgtcatatcagggattgcaattccggaacagaattatgaaatttcagttatttcgccctccccccacccaccagaaagcacgtatttccacccaaaaaaattccctttttaaaatattttttatgaatttgatcaaaatttatttaaattcattcaatttattaatttttcaaataattttggctaaaaataccaaaattcttgaaactttggtggcaaccgaaattccaattttttgctgaaaaatggaggtgtaaaccatgccctacattacatacaccactgtagtgtggaggagttgtttctacaagcgggtttggatggttagggaaaaaggtacggtcttgaaaataaaatatattactaagatttatttttgagtttttatttaatactagaaaaaaaatatccgtgcgttgcatcgggtgacagctattttaatcttgttattattatatggtttagctaagttgaaattcactgtgagaattcatttgaatatatacgtttttagaaaatcatgagctttaattaggaatttaggaatccaatcatctcaagttagtacgcgagtttttttgaaagagatttcttatacaactccttctgtatttcaaaaaacgaacgaatctaaaaactgactaaaatacggatatgtattttcaaaagcaaacaaatttaaagactgattcatacacgaatgacataccaatgaactggcaaaaacatctttaatttttataatagtagagataaagatgatttgagtaatatataaaattctgagatttatttcgttttgctattgaaaacggtttttcccctcaagaaaacggtttttctcagtactgatgattgattgaaaataggaaaacccaagcacttttgctcagatctttgcattgaagattcagaacatccaacccctagctaaccagtcacgcacttaagaaactttcattcccgagattaaattaatgtccattaagtacacaagtcaacaccactcaccatctacaaaaatcagtactccctccattccaaaatacacttatcccaaaaaccaaaagataattatttcgcctactcgtctgaattattttataacaaatacaatacgtgcaaccaattaaattagagatcttgagatgaggattaaaaaaaacaaatttagaagagatgtgctaattacttacatgcatatatacacatcttctattatatatgaaacatctatgatacttaatattcaattaattgctcattccatttcaaaatatggcgcgtaatcagtttttcaatatctcatagcaccatgtatgcaattaacgagcactcccgccctcccttaaattcggcttttaaatcaagatctctaatttaattatatgcatatgtattatatttattaggataatccgaatgagaagctcctaatatataattcttactttaagttagtggttttataatgaaaggagtctacactaatgactcgtcttgttcaacgccactgaaatctagctatacctaggtaggtaaggaaactgaagaggttgatcatctcttccatgcaagttaacggtactgttggcctggattgtggccagatgagacaagtaaattttatgcaacaattaattttattccttttgtgtactatattattgaagaaaaccaaatctttcaaggaaaacaccaaaaaaatgttcaatacgcatgtaacgggtacattcacacaatatcgcgcgcacaccaatttaggagattttgaaactcgatcaggagttcgaagattgcaaagattaccgtcatgacttttaataatgtaaaggcacaactcaaaactgatggtttatcatctcattgggaaatgcaatcagtaatttacagatatatatgatgcttgcttgattaatgagacaaaattagttatgtgtggagaaataaaataggaatcatgtatctgttgaaattcttatagaattagaattatacaagtccttcaaaatcagcagaaataaaagcaataatgtgattcttttttttactttacaaaaaattcgtcaatatttattttaaataaatttctccaacgaactagtatgtatatgagtatatgattatgctcaattgttaaggcagaacatccatttggataaaattgtaaaaacatcaggaaaaccatatgttttaagaagccataagttaaatgtttttatcatatatattagatggaggtcgggaatgtacccgagaactgcgaatggtgaaagagcaaaatagacaatatgttcgtttttttaagatacagggcacacttgttaatggaaggaaactaccccaacattttagagtaatagagaatataacttgtagggcacacatggcttcaattgtcataataaaattaacacaaactagattggagataattattttttcatgcatgagatcatatgctgctgaaatcaaatcatcaattgttctttaaaacatcaacaatttaacaataaaagacagctctttatcatgtaaatcaaattaaagatcgaaaaaaacaaagtggggggtttagtatagcttgtgttaattaaacatcgcatgtgtaaattagaacacaaagttctagcctatacataaagactacgtactgcaccaaaaagataacagtacaatattgttcaggattagaagtaacctcagattttttttttgaaacattgctactcattcatatacaaagatcaataaaaaatacatatcatattcttgtcataattaagcatgcatccattgatgttgcatgcaaatggattttcaattactaaaatcgaatcttaaatcaattgtaaaccctaaatcttcccaataccacctcattaccccaagcgaaccccaccaaacaaactacgaagaagaaagcaaaaaataataaggaaaaaagaaagatgaattagtagaatctcaaatcgaaaccctagttagctagtgaactgatcaagctaggttgcatgcagatgcattcgccatggacgcccccctcagctggaacgccaagctaagctaagctagctcgccaagaactcccatgcatgcatggaatcggtcacttgaggaagagatcgaaccaggggtccggctcgctccacagtagcgccgccgcgtagtcctcctcgtcgccgccgtggaagccccacgcggcctcctcctccgccgccgccgccgccgccgctgacgcggcgtcctctggcgccgtcgccaccacggcctgtgtttcagccgtggaagacacagcagctgcaacaagaacagcacccggcgcggcggcagcgagctgtggtggc

SEQ ID NO: 65060 - DNA, 5212 bp, Oryza sativa
acaactccatcccaacctctcctaccaggcagaaacagagttacaagcactattacaaaacctacaaactataagcccctctccagagacagcagacacaagagaactcctgtatcccaagcctttgatctcaacggcaaatgcttatagactgctgactttttcatggatccctttggaatccggctgattacatatggatctacacaattcctcagaactgcaaggtattcctgtggctagcttttagagacagattaaataccaaagccaatatggtcaacaaaaaatggagtaatgatccccactgcccaatctgcctggccctggaatcagcggaccgcattatcctaagatgcagaaatgcaaacaacctttggaaaagactaggacttatgcattcggccaacagatctgaaacaatctctgacttcatccaagcagtcattgacaggacccaatcaacaaaaaggttagaaccaatctggtttgcagcatgtgcttacacgctgtggaaatcgcgaaacaacatggtcttcgaaagacacatggaccatattcagaacatcacacaacaaatctgtgataccctaaagctatggtgtctgcgaagcaacacaggaactagccacgaaattcaatcttggtgtgcgtcataggcaacagcctgctgtttatacccctgtaaatccacccccacccccttttttttattttatttctttatttttcctctcaccctgtatctctgtaatcttcttgtttctttccttttctctatctcacttaacctaaaatcttgtaactttgaatctcgtttctattaatgaaatgactataaggtagagctggctctaccttcttcgtcaaaaagttttcagtaatgcactattgaggtaaaacacacaaaactgattttttttttttagacattgagtccccacatgttctaagcatgacacttttttgtgtgttttgtctgctgctttccacagggaactagtaaatcaaagaaggggaaccagatagagatatgcaaaggtcaatgcctgaacaatttcagataattagaggccagctgaactaacgagttaacaatcttcattgatttagtactataaccggaggtaaaaccaaatctgaacattcagagatatagctcttaatctccattttttctgagatctaccatacctagaagattagtaactgcgttattttgttgagatggaatattttttttcaataactctattaatcaatgtaaattctacaatggagttgtttttttttaaaattaccttgcccatgtcagcatcagcctccttggtcatggtgagggaaatcggtgtcatcatggccgtcgatgaaattaagggtgcagatgaggccggggtggctgggaacacgtgttctactgcaactgcggtgctctcagctactggtttggtgatggtgccacttgttcccgacgccgaactcttggtgggtgtcacgtcagccccgttccgagggaagagctgcgcacgctggacatcaaagcaggcagcacccatcatagacgttgcgtccattagtggcagaccgaaccttcccggtgtcgtagcttgactagagtctagaatcagatgagagcctcaatgccccaagctcacggcaagcacctgcactgccactgcaccataggcgtcatagacctgactaagcacctcgtgggtcaccgggaatagaccatggctcacagcgacgtgaagaacagcacttgagtcatgtcccaattggctcggcatttcaccgaacaggtggtgggcatcacgttcggaagcacctccatcaagctgttgaccgcttctctggccatcggtgctatcacacaccatctcaacaccagaaaccccacaaatcgacggccctgatacaatattgtcaagaacccgcttaattctcaacaaatcaagcacaagcacaagagataaatccacctccaaatgcaaatacttagtaactgaggatagaaattgggggaaatagaagtgtaaggtgggaataagcaatagattagcaagaaacaggggatcagaggggtagagaatcagagaaccagattttgaggtggagaatcaagagttcagttcttgaatcttgatcgatccgcccatgggacaatagcagtcagccactctcccagccgagagggcccaatcaggcagcccacatagaggcccaacgcccatggcagcgccacacaccggcacgcgccaacaaatccatcgccgccaacacgcgcgaatcacaacaaggaagaccacacataaaagtttattcttttcaaaatcagtgattaattacatcaatgttattattagttaataatgataaatttttacatacaataaataattaccttttactacatctatctacaacttaactacactaaatgtacaactacaaatctatctatacaataaaaatcacaaagtggaaagtcttcgagctgagcagaatctttgactctcgaattgcgtcagtgcttcttgttcttcttcagtcttgacgacttcacttcgtcttcttcttgcggaggcgctcgtgcaccacgccgcgtcgatcatcgtccaccttgtcccagacgaccgccggcatccctcctcctccctccgaccaaatgccgggacacacgtacgcctgccggcagagtgtgtgagccaccgagtttccctcccggtagatatgccgcacctccacctcggcgaagcggcggaggagggagagaatctcctcgtgcatcgccgccgggatcctcgtgtgcggcttctcgccgcgcaggagctcgaccagcaccaggtcgtcgccctccaccacgagccggtccacgccgcacgacagcgcgagcctcaggccccgcatcatggcgcgggcctccaccacgcccaccccccggtgctccgtcgtctcggcgaaggccagcacgacgccgccgtcgcacccgcggatgacgccgccgatgctcgcttgtcgggacccgtcgtggaacaccgatccgtcgaagttcagcttgtgccaccccggcggcggccgcgcccacctcacgatcagcctcgccggacgaaatggcggcgagtaaggcgaaagtggcgtcgagcagcggggagcaggcggcggcgcccaccggacgagcagtcctctcggctgaaacggcggtgaggatggggacagcggcgtcgagcaatggcgagcaggtggtggcgagggaaagatcgtcggcggcaagaaagccaaaccaccgccgccgccgccgccgtcatcagggccaccgacgcacatccgcttcccctgccagaaccctccgccatcggcggtgtgattctggcgcttcccattggcgttcttggcccgcgcgtcctccaagaacgcggcctcgtcgccccggccgtgatccgcgagaagcatccatggcggcggcgcgctcaggggattgaacctgaggcccgggaggagcccatccgcgccagcagccgacagcgtcatcatcatctcgatcgcgcgcagcagctgaagaatttagggtttttgggaggaaggaagcgtgggcgagaggattcgagatggggagggggagcagaagagagcaggtgcgagtggatcgcgtcggcaaggcgggatttcaatatatagaaatggctgacgtcagcgcgacatagcgttgtcagcacgcgcgcgggggttgagggtttaaccgggtgaatgtgaatcttgattttggtacttgtttgggttagtctcaaaattcgagcagaaatctgagcttatttgccatggtgattctgatttctgtaaatgttagtatctgcagcttagtgccaatccctgaacttttgaagggttttacacaatgtccagttcttccgtttgttctaaaggattttattgatgagggacaagggatcagttctgaaggaggaaaaacagagttttttttctttttatttctgaaaatcatgaaactgaaggtgaaaaacagagtactgtgtatagtatatgatgttaacgaaacagagtacctcttcgagaatataaagatttgatcttgagcatgagaatggtttctttatcggaaggaagtcattgcaagttcagccattacaaacacataaatagatgtcaatccttttattagatataatcaatgaatatgaatacatcgatgttaatgataaatacatctatcatctatgtctacaactgataggaccggaccaatgaaattaattagctctacatgttcaactacaataatcagtaatcacaaatgagaaagcaccatttcgccgagccggccgatcgatcgatttgagcaaaatcctcaactttgccaagccgccgttgctcgccgtcgcctcccaagttgttgctctcgtcacacctgcttgcggctgctttttgggttaaaggatgatttttaatttggtaacaagatgagagacctacaaaacagcgtcgccggcggcttgccgccgcactccaagtggccgccgcagtcgccggtctggcgcttgtttcatcagcatggagacaccatgacacaagcatatgcaaatggatgaccaccactcagcactcagcaggaccagcgcgagtacagaacgaaaagcaaaatactccgtactagtagtagtactccctccttccaaaagtttaattcctatttctttttcatcaagaccaataaacaattaatttattcatcatgtgataaaaccaataaacactaaaatgacttcttaattcctatcaacaatttaatttagaatataataactataaatagaacttagacttttggaaaaaatcaaagaatgaaataggtcttaaacctttggaatgagagagtatattacaatctatagtaatcgaagtgcggcttacgagtcacgaatcacgaacagatgcaggacgctactatctcaagcatcgatcacaaaaaggaacaagcgggaccatttgatttctccgaagctgcacagatgctggaaataaatcgagggcttcgaaacccgacgacaccccggaggagtctatcgatgtcttccttccgcgatgcagaaaagaacaggcagtgcagagtgcgggttacctgctggggcgcattgtggccgggcggggcgcggaagacgtcggcgtcgagcggcatgtcgacggcggagccgag

SEQ ID NO: 65061 - DNA, 2546 bp, Oryza sativa
gtatatactcatgtctactgtgaaagagccatttttcttataagagtaagcaaaatagtttttcgcggtcaaatacacttatatagatttgcactgcaaaatgctttgataatattctaattttatccattacgaacatatacatgaatgagaattattggttgcaagaatgcaaggtactagtatcttgccaaaaaaacaaagttaaaaaagaaagctatagcaggaactatgacaagctctacaattaatcgtaaaagagatgggtcaattattatagctagcaattaaccatactatttaacttgctctaagtttcaatattaatattttttttgaagggaactcttaagtgtcaatatgaacacgatacatttgttcttttttagatgttagtataaagctagatgggcactttttctaaggggtgtgtgttttcgtagggtctagtttctctcttttttttcccactgggtgcattatctatggagtcaaacaccacaaactccgaggcaatctacattgagagagggctcaatattggtcaagaaggggatggaaatgattcttggaccaaaggatctgtttgactcctagtcatttgctgttgtctcagaagagtcgcccccctagtgaaagggactcgattggatttatgtgatggcaagctcactcttgggtcacaataatggaaacgtatcctatacacacaggccctcgcgtgtacacatcgtatacaccaactaaaaattatcataaaaaattctagaaaaattcatacatgtactttcaatagtattacatctacgtgcaaagtcgcatcttcaaattcattctacatagaaaataacaaaaaagataaaattctaacaaaattgcaaccttaaaactgtcagattttttgtttttttgttacggctaaaatataatgaatttgacgttaagattttaactctaggtgtaatacaattgaaagtatgtgtatgattttttctagattttttggtgatattttttagttggtgtgcacgtgtgtacacgtgagggcctgtgtgcataggatatgttgcccacaataattcatagcgtttgacactatgtggtaacccaaaccgacatttttccttctggggagcaaaacaagcggcgccactttattcgcaggagtataactgtgtaagaccagttaaagtacatgcaatgttggtatagcatccttcacaaacgagaggctgcacaattacaatcacgccgaagcaattgtttgcctgcctcccctacactacaccccaaaatccagcacccagctgagccgcttcatccttcctaatctagtaagatccaattttattgtgtatatcttgttgtacttttggttgtgctttttgggggcactacttggtttgaagtttctctctcgtcggcttggaacccggacacgatgtgtatcacaacacttctcatgctgacttccaataactgcaatgttgagagaaagtgtacggtttaggcatgcagttcagtgatcgattaataaagaaatgaaatgagatgtagagtatgaaccggcagataaaaggtgaataatgcttacccaaacatgaaatgtaactcccatggcaaccgcgccatatacaccaggtacatgttactggtccacctcgtcaggtaagatgacattgtttaggtatacaagacgcatctcatctctccaaatctgaaaatcacgcattttctgatcagctaacgcggctagcaagggaacatgaaaattcaagtttttcgtccaacagaagtgaaggaaatttgttcgtaccaagtccctaaactgaaccctgatgtgaggcacattagttttatgaatatcgttccctgtaggtcctcttttgtaatagttcttgccaatccagtgtgcctgcaatagatgaaatgatgatatgcttcacggtgccatataatgcattacttacagagcatatcaagcaataagttgctcaaccataatttgtgaaaaatggtttgtggctgaaatgaatgtaataaggtaaagatcaccaacgagctttgaaagtagttgacaaaggttgtttacttgccttgagagcatgtgaaaaccctgattgatagacagagtttctagctatttcacataaatcacaagaactgagcttccagagctgaaacaaaaaccacaataagtgagtttgtccttttgttcgaaaaaaagtggttagcattttatttgttccatgaacaagcataaaggtgcacactgaactgcattcatgtatgtcttgtacatgcacatatataaacataagtatgtacattagtgtctgcataagatgaatagggtgaggggagagggaaagagggagtactgaagcagcaatgctgtattcttccaccaatggctcttttgtcaggtgaatttgcaatggatcatccgttgacagggaaacattcaggcctcgttggaaaaacattgggaaaggattccggtggtaatcaagaaacaaggagttgttgcttaatggggggtgcag

SEQ ID NO: 65062 - DNA, 3149 bp, Oryza sativa
tgaccatcattgataaccgttgctcgcatcatagctcaagggagacgtcatcaagttgtccaagttctacaatccaattcggttacctactacagtgttgacttcaaacggccactaaatatacatacgaactccgttttgggtctatgagtacctgatgaaaagcaaccagagtcctctttccaacggatcaagccttatcttcaaatttcatctcagtcggtcgcaatcatagaaacaaagtattgtgtcacctataatgggcatatgagcttataacttcatctgggacccatgtggggtgcgtcacagccaggtcgagcacaaccgtagggatcccttggccgtcttcccgcctccttaaatagctaggtaccccttcaaggttgctcggggttttgtttataaattaaagtttagccattactattttgccttgtaattacgcatgtcagctagaccccctaattactcgtcttcggaacctcacattatcgtgagttctaattcctatttgcagttcagattgctttgtatcttgttattatttgtttcttcgatttgcttgcaggaataagattgatctgcaccggcaatatcaataactcactgagagatgtatcgatcgctaaggcacaacacaacaatatctcgtatggctgtagtcgtgtcaacaacttctctcccaaatcatagttatctttaactcaccgaaagatcgggccaataagaacagttagcgtatgaattgtagcttaggattaccacagctaggcccacaggttcactcatcaggattgtttgtggtaccatagtaatcgcttttataattataaacttatcgttttacctatattaccgtaataataaacactagctatcaaaaactcagtaaacataaattaattaataatttggatattatcaaaagaataaacactcattaaggaagataaggtgatcttttgtactagcaagctaaatgagcaactggcggctaaatgcttagctcaacccgattgattatgactacaagtttaagtcgagctcaatcaaaaccgatttgagccataagcttcgagctatttttttcccaccccaattaatgcccaacttcatagaaccaacatatatatataatacattcacacatgaagttgtgaatagttcacacgattttaaatttcaagttcgaatctaatttgttccgatccggcctatacatttccaaccggtcttaggctgtgtttgaggagaggagatagagaagatcgggaagacacgcaaaacaagatgagtcattatcacatgattaattgactattaactattttaaattttaaaaatgaattaatataatttttaaagcaactttcctatagaaattttttgcaagaaacacaccgtttagtagtttggaaatcgtgcgcgtggaaaacgaaacaaactcactcacaatcacccagatcacccaggaaagaacatagccttaatatgcaatgttccgaaatttggatcctttatggcatctgatgcttgctgcccctcttgcagtacgcaaatatccttggtagaatgggagagaaaatgacgtgcaactatctccgaagcctatctttgcaattttgcatccatccatcccatccatgcatgcagccacttgacctttggtgagcatttcttcttgttcgattcagaaagcgaaatatcaatctcttctccaattctccaaatatgcagcaacttcatggttaattgagctgcacgtgtatgaattatgaaagcaaagcattcatatgaatttcttcaaacgtatgacaggagtgaggaacgttggaggtgttactttctagagataccaaaaggactttagtagaaaaaggaactttaattagactaaagaagacattaaaaagaaactgaattagacgtgattaattcttgtaaagctcctgcactgcaaccacagtgccagacagagggaagaattcttcagccgttcggcgatgcgaaaatgacaggccatggtcccagtgccacggcgccaccaaacgcacgcaagagcgagattaaattaagtgctccccaacaacctcgtggttttcgcgtgcaattataataacctacgtactctgctcacttatttgaaaatgaaagaaacattcttcctctgttctaaaatatagtattagtttttgcaatttatatataatatatattgtttagtaaacaaaataccctacacccatctctgcctttttaaaaaaaaatcaaagctataatagtatactaattttatccatctctttaatacccatcttgaagttatatttttggatagaagaggattagctagtcgtcaatattgctgttgtctttcaaccgtgtctcctagtcgatgtggacatcgttgtccctgtcgaacgggacggatcagatgagccgacgaggcgcgtgcgtggatagtgaggtggatcgaattgcttcgtacacatgtaccattagcttttattcagactgtttgttagtgcctccaaagatgctctcatcttgctctggcaacatagaagaaaaataagtgtgattattattattattattactattattattgggagtaataaacatgaatgaatatcgttgctattgggacttatactctatacatcactcgacacaattcccttttcaaatcacacgaatttaaaatggccaagattgatttaagattcatacaatacctcctaaccatatcctatcctttttgtcttcatcactctttgactccaccgccaccctccgtcttgtgcatctcctctagtgtcggctccagtacgtccatcctccatcttctccaacaacaccgttgagcaccccccctctcccggtgttcttcttctctgactctagcaatatgatgcccttatcccaccggtccttcctcgcctccactgttatcattgggctttcaccaccctaggcatccctccaaaaccgtcggtcactatccccaagacccctaccctccatcacatctcaaccccaaaacgctaatctcaaggttctctaccaaagttggaaactcgctagagacgaagacaatgcataaatcttgaagtagatttaagagaaaatttgatccatagcat

SEQ ID NO: 65063 - DNA, 11337 bp, Oryza sativa
ggatggatattatattttaatgcttctagtgtcctgcagtaaattaccacacttttgaagtgttttcgggcaaattcacatcttttcggtgtcccacagctaattacacattttttgagtgtcatgtagcaaattttgcccaaaaaatagcacaagaatttttcgcttttgatcagaagcataggccaccggtttttcttcgccccgtagcatttccgttaggtttggagttaacagcgttagattgaagtacagaaaaaattcgttggacccatttgccctttgtcttcctcgccgcattttccccgtgtcatctacccgttccgttttcaccctattagcctcgacacgagtacacgatgacatgctccggcgggtggcctcctagctcgttgagcaggcggggcgcctacgcctccctgctccaccgcctccctccccggccggcgactgctgcagcgatgatgctcgagcgccatccgccggtccatcctggcctccgccccgcggcggcgacggtgcagcttcggcgcctcccatcaggcctgagggttactccacctccgacagcgaggtggacgggctaggcaagtacttcagcgaggaggacgaggaggaggaggcggcggaggagttcgtcgaggacatcgtggcgtaggaggagtgggagggcttcacgttggagtacgaccatggctccaacgccgacgaggatgctgcggagtaggagaagaagtagcggcgctggaggtgggattctcttccttagtctgtgttgcacgctaggtgcttgcggaaatgcatgtgaggttctacgcatgctttaataaactctttagttgtcgataaatgatcttggatgcccatttgggtcaaacctgattaccgttgtcttaaacaatgtgagtcaaaacctaattctaccgcaatatcgtaggcatgtattgttggtttattggagtggtgtctcccctctaacagccgccgccgccgtcaccctttctcttcagcttaatcagcgaaaccaacgcaggactggctaggggtccagcccaaccaagcatagatagaacaagggcaatatggtctttctaactcttgactaataactaaacaattcactggaacgatgaccacgacggaagtgctacggggcgaagaaaaaccggtagcctatgcttatgatcaaaagcgaaaaattattgtgctattttttatacttattttttcctatgctatggatcaaattctctagatttaaaggttttcaaagcccaaagataacgatgtgcttgtgctgtttaaacagcagtaagtaaataggacggcccagcagcatccatccgacgacccggcccatcttattaccaaggaacaagcgtggacagtatcgaagttccaacaaaaggtactcttattatcatcagcaaaaagtttctcaaagaaaagattatcagcaacagtagaaggtaaaggtaaggcgacgctgacgctgcagatcacggatacatgatacaccagtacaacaccgattgataaagatctcatccccaaatagaatatcaaacactcagcggcatactcttagtgagtgtccgctggggtcatcacagtaggcaataggagtctcatctctccacttactaagatttcaggacttttaatttaaagtttcacaggactctacccactgttccaaaaacagcgacaggaaaccgtatgcaagcgcatcatcatcttaaggcagcgtagtgacatggtacggtatgttacttaaataaacccccccaaaagaacaagaagcgtatctcagctcctccacttcatggactcggtgcattgtggcgagagttgggcttcaaccttcaatcatctgatgccttcggggagttctcgggtgtcttgagtgtgccggacgcctttttcgccttgtgcatctccaccgcagctttgaactcctccctgatgctggtatccctgaacttcagagcaaatgtggcaagcccgctctgcgagtcgccgatgctgttcatacaggcaaacgtcacgcccttcttgtccatgtccttcagcgacatgtcctcgtaaaggcttgcgttaagaactagcctgtaattgcccttggttctcatgacgagacgagacctctcgccaccagatactgggatgttcaactttagttccccctttcctctttctttccaacccccatccaagtattcatacaatgctgagtcggctgtgaatatggccttctcattctcttcaccagtttcaactgggccctctggcatagcaaatttcttgggagcttctgccgaagtcgcaagcgcaggggaggaactcccattattcgaagcaccaatactaaaagatgggaatgatgagccatcagtctttagcccaaacaggggagcactcgagctttctttagagcctgatccaaatgaaaatgaagagcctgaaaatccagttccagccagtcctgtgaaggcattttggccactcgacaggttcttgaaagagaaaaggggtgttggtgatgacgactgccccttgttatcagcatccttctgctcctcagacgatccatcctttgtctctgattcatctccatctttcttctcatcatcacccttgctaattttgtcttcagctccagcctcatttgctccatcctcttcttcagcatctccctcttttgctgttttgtcctcgatatcagatgccttgctgttatcttccttggcctctccagctaccactgatccgccccccaagtcttttgcttcgtcagtggtctcaacaggttgagaaggtggttcaattgagtcactggacttggctttttcatctgatccgtcagatctgatccatccttttctgtctcacctacctcactagaacctgcactcttgtcagttacaggtaaagcatttttcccactgccattggctccttattaactttctcacttgaactatgctttgcattcgctgtaatgacatcagaaggttgaggctctgagacagggatagttgcttgggcgctggtatcactgggggtaaatctgattgcagagaaaggattagaaggagctgatgagggctgctggcgtcgaacctttacaattctccgtgttgccatcacttcctcactagctctcttaaatgtccccatctcttgctcagttgagtcatcatcaggctcaggattatccttgttgatttgggtacctgcaaccctcttcctagacgttggagcatgctcctcgtctgccatttcaagttcctgagattacctggaaatcaaaataaaagaccagagattagcaaaccaataatgatgtcgtaaaacttacgcaggcgttgcaattaaaacacctattagtgggtttcaaaattccagatcaaatatgcagtcttttcatgtacgtagcatgagtcaaaacatgaatgcagcatgaactctaaaagagagttaacagaaaaggctcaacatgctctctaattacacaaaactacaaaacatcatgtctgtacaggtcaatagcattatgaccatgcaaattccttacaatccatcaatctatgcacagaaaagaactaaaaaaccagcgaacttgaaacgaaaaaatggttgtgcatgtacacagcaattgaaggcagagttgaacaaaattacatgatttttctaaaatatatgtgtgaagtataatatcctagtttaaaggctccggcaacttttagctctttccttcaatcctctagggcacataaaaatagtttctgacaaggactcaattgatcaataacatgagataagagatatgtgcaaaggcctcataagcagttattaataaaattaaggttgaagttggagagaccaaagtttataaagtcatttcaattggcccatgaatactatatacatagtttttgaactaaatgttgtaaatgaccaagaatatctaccggcgtttaaaaaatatctaccgctgaacaagagcattcatgtttttcattgaaaaaagaaacatggccaaactatgtaatctagtgatgaacatctgaagcatgtacgtttatgggcagtgcagtatttacacctgggcctagggcaagtaaaaaaaaaacttctttttttctatctttgcttggcatcctaactagattcacaactgaaaaaccggttgccctaacagtaaggacccctccaatatagttgaagacagcaatggaacaacataggcatggacgcatggtattgactaactggaagctatgcttcagcaaacgtctgagaattagcagattctagtacacattataggaattccaaaattgtatacgcaacgttatactcagaagagttgttgctacagctaccaatcagctaaatcaaaacaaaagtttctacataccgacagagagaagtataaaggtataatcaatactcaggaggtaaaaaatttgcagctaaccaaacaaacatgaacaagctgaaaattcatgcattcccagagtagtgtaggtaccataagaggaccaatttcaaaaatactttactcctttaaactcctttaaaaggagttgggatgatggtgtgttccacagtagactctgtttgatattttacatttttctcaggaccaagcccagcacaggtaaaagccccaaagcctgaagtaaaccctaatttcagtttatcttgactaaaaagaaaattgtcctttgtacttcactagaattcagaaatcatcagctcatcgctacttcaatagaatttcaatccaaacgcgtgcagtaccgaactactactgaccaaacaagcccgtactcaccagaaacggcggtcgacggcggcgtagggagggaccacgggacgaggtcgaacggagaggcggacgggcggatggcggagaccggggcgtggccgctcagaggcgccggtgcgccgcccgagccgaggcggagcgccgctgcctcgccctcgacgacggcggcggcggcggcggcggcaagtagcgagtggctccgacccttcgcctccggagtacagatctggcaatttagggttgggggattgggagtggctcgttttatatggcggctgggtgctgggctttgtaggcgatttgggccttcgtcgtatccggacttcccaaaaggccggcaggtttacataggagtcggaccgggccgggcttttaagggttcagactttaaagcccaattctgataggaaaaacaaacctagctggaaaaagtacaccgagggtccctcaatttgttatcgggatacaaaattgcctccaaccgtaaaaccagatatgcgaggtccttagctacacaaaaccggtcacaataggtccatcggcggttttaattccggttttatcctacgtggctgttgagtcaacgtgggacccacatgagccccacatgtcagcgtggccacgtcagcttcctctctctttcctttcctcatctctctctctttcactcctctcttctcttttttgggcaatctggccggcggctggggcgggcttgccttgtcgacggtctcgtagtcggagaactggaggagctcgtcgacggcccagccctgtggcaggaactgcgcggcgagggcgcctgctgcatcctgcatgtcgacggcagcggtctgtgccggctgctgctgatgatgatgtggtggtgacgctcggaggacccatgggcggggcgtggtggtcggagtcatgggcgtcgctgccgccgtcgcagggcgaggcggaggcgaagccgacgcggcagaagagcgctagtgcttcctgcggcggctgctccggctaccggctagctagcaagcaaacaaatagtagtatatgtgaggctagctagcttgtcattctgtgcatgcatgagccatgcgaatatacgaatgtacatgccgtatatatactctagctagagaatcaagggctagcatttgctaattggccggtggagcaattacgtacgtacatgcatgcgccatgcatgcttatcgtattgagggtgaagtaattatcgtattttacgcgccgccggccggataaactcagtcgatcaaagtaaagattttgatttgatcaagttaaggccgcgacctcggcgacctcggcgttgctcatcttcgacggcgctgtcctcttccttaagatggtgctgagagatctgcctcacgctcatcatcgagccactcggtagaagaatgctactccctccgtttcaaaatgtttgacaccgttgactttttagtacgtgtttaaccattcgtcttatccaaaaaatttaagtaattatttattcttttcatatcatttgattcattgttaaatatactttcatgtacacatatagttttacatatttcacaaatttttttaataagacgaacggtcaaacatgtgctaaaaagtcaacggtgtcaaacattttgaaacggagggagtactaccctgccgaagcacgctcgccgagggtcgtcggaacaaggccctgaacgccgccaagattgcctgcatccatgaacgacgtcgagatacaggatgtcctcgcttcgccggtcgatggcctctcagacagtgcccctcctcctcctcatcctcatgctcgaggcggcggcgacaggggtgcgtcagcggcggtgcagtgcgggcaggtgacgcagctgatggcgccgtgcatgccatacctcgccagcacccccgggatgacgccctacggcatctgccgcaacagcctcgtgcgtgctcaaccggatggccccgacccccgccaaccgcgttgccgtccgcaactgcgtcaaggacgctgccacagagagaagagtgagagagagaaaaggcagagaagaggggaaagaaagaggaggctgacatgtggggcccacgtaggtcccacgctgactcagcagtcacgtagaacaaaaccgggatcaaaaccgccgagagacctactgtgaccggttttgtatagttaagggatctcgcatatctgattttgtggttggaggacgattttgtatcccgatgacaagttgagggaccttcagtgtactttttccaacctagctcgagagtactacggggctgttcagattgatgccatttttaaccataccattttttggcatggttgctaaaaatgtctctacgtttagtttgttgtcaaattttggtaaatacataagaaatcctaccaaaattttggtaatattgtcaacttgccaaaatttggtaagatttattttggctacaatctgaataggccatacattataggaaaacagtccatgacttcctcaaatatcagtcgaatctaattcatatccatcaaccctctcaattattaaaaccatacaaaacgtccccatcgattgttttgagggcaatctttactggtatggtgttcatgtaacaatccagtcatcaaagcaattaaaaatagatataggcccacatgtaagtaacaaggggggaaaataaaaaaccatggggcctacatgtcaatcccactcttattgtcgttctttcttctttctttcgcacatgggcgcaacaatccagcggtgcaggcccgcttatcgttgtccccctgcactgaagagtcgaggaggcgagcagcgaggatggtggaggaagacgaaaaggccaccaccgccacttgggttgtgtaccatcaaagcccactctccctacagtggtagacctcgagtcgctttgccctggctccttctccgagtgtctcggcgagcagcgaagatgcggtcgacgagctaggccacatcgacaccatttcccttgatcccatctccctccgctcccgcgcatgcaagggagaaggcacgtgctaaagtcattgtgctgcacgagaacgacatcgtcagggaagaagaagggatgcatcggcggagctagcagcggccatggagtatggcatcggggaggccaacatcatcggtaaagcttgtagaaggcagagatggaggggatacgacatagggtggcatggcagagccggcggtggcgctctctcctccttctcctcctcaccgccagctctctcctcctcaaccgctccgccttgaggccgcatcgtcgcttgtcggggcatgctagcacctagatcttggcccaccaaaaccgtctacctgtgtcccctcggcccttgctcgagctcattgccgccatcgccgtgtgcccgtgtggggaaaaggagaggacagatcggggagatattcttttaaaataattaataaatctatctaagttataatagttaatacttactcatatttttccgtggcaaaataacctgaatttgttcagccgagcctaacataccctaaactgtatgtgccaatggtttaatcataaaagacgtgatacaagtatgttgggaataacggattgcgtgtcctatgatactgtaacactacaataccttatagcaaatcaagtcaataaaaaattgctcatcaaggattgatatcaatggtcttgatgggcctattcgattggcattttctgcagctagctgcagccgtacaatataaaacgtctcagctacagcgttgccgtaataatggtagctgaacaggcccaataaaaataagtttactgctggctagaaaagaatggttgaaggagcatttacctccactctttggattttagttcctaggccgatcagggtaagcttctaggcctcttctgttgttgcttgtttgcttctctttgctcctggtgggatcgttctagcaaccagatcggttgcaaggttgcctgctcattgtatcttcgacggtgttttttttttcaatgctaaatgattctctaccggtcaaggccatgtaaggccctgtctggaaacgtgccgatgcttgttctgttgcggcttgccatggttgctcttgccacctttgtcatcaacatagatgaagcaattgcgtaagacaaatcaagaaggtcttgattgtgttttttagattttcttttgtcctgccttgaaaaatctaggacctttatataatttattctatcccaaatgattgtctgatactggttgtcgtagtattttaaaaataaagtcagcaggtgcaaaaaaaaaattaacggttttactataaatatatcgacggatttcttacttcaaatcacacggttttttttctttgacctaccacatcaaaacataagttttcttgtctgttgaccatagtaaccgactagtgttaatgtaggctgacaaaatcttctagcaaatgcctttgtgggatgagcatatgaattccaattgctagaacttgcacttcaccagtggaacaagtgaataatttaatttagttgcatagccaaaattacacaataattacagagtaactccaatgtaattatggtgtagatacactgtactatgtactatggttgtaattatggtgtagatacactgtactatggtagtttcagtgtaattatattacagttatattgtaataagttgtgataaaaaaagtttgactatgagtctgtttataattttttttagcccgtgcgagcaccgttggttggtccagttaggttgaagcccatcaagtagttactgtagctgttattgatgtgcgtcggatcttgatctaagggttgaaaattctgtgtaatatcgactctgaaatctgtggaatgcaagctagttagtctccaaaaataatatttccttccctacccaaaaaatatagttatatctagagcttattcggattacaagatagacaaaacatattactacgatagaaatagaaaagaaatccaattgtaaaacataagaatgaaaaacaaaggaatataaaagctgagagcattcggattataggatatgaattaaaaaaaagagcttgaggtggttggatttttctcgtacttttcatgtgaaattagcattaaatgaaattttcctttggattttctacgatctgtttccacatccgaacagcaagaaaggaatttttttttaaaaaaagctctcatacacagtatcctctaaaaatcttgttggaatcctccaattcgaagaatataataatttcttcatctaagctcatctcaaccaatcacaaccatcgttgattttattttcttcagctacttattcatccaatcacaaatatcaattatttaattttatctcttacaatgttggtcacaaacattaggaattttctttaagattgaaagagacataggaaacacgtatagttatgtgctccctccgtctctaaatataagagatttttgataggatgtctattcagatttattttaatatgtcacattgcatgaaaatgatttagggagggagggaccgagggagtactccggtcaagcgatcacgccatcacggttggtcggatgaccggagtgcttgtgtagtactgtagtaggagaacaggcacaaggcatgaacacacgcatgaggacgaggccgaaaaagggtcaaaaacatcgcgttatccttccctcctctcgcctcggtggtgtgcgtcttccccacccacccccagtctccaatggccacctcccacctcctcgccgccgcctcctccaccgccgcctcctccgccaccttccgccctcccctcctcagcctccgctccccgccgccctcttctctccgcctcaaccgtactgcctccccctcagttccctctctctctctctagcttcttgttcttgcagctagccccgctgtgtgtggctgatgcgtctgagctcctccattcgcaggcaggcgccacttccaggtggtccgcgcggccgagaccgacaaagagagtaagctcgggcgtctccctgtttgttcgattgatttctatggcgttttcgggttttcctaatgtgcggtttgggttggctgcgcagcgaaggccaatgcgcccgagaaagctcccgcgggaggctccagcttcaaccagctgctcggcatcaagggcgccaagcaagagaacgtgagtctcccatcccgctcccttgcgctacgttctaatctggttgcagaatgcatatagagcactgggcactggggttttagcagcatatagagcgctgcatatatgcatgggcattgagcatgtcctacactgggttcttggtgtgtgctgtagcgggattgccgatgcgctacccagtggcgtcctcctcgaaaatttcctgtttttggatgccatacatggccctttctctacctttttgggagagcattggagcatttttcacaaatgttatatgcagctgcggcttatgatgccacg

SEQ ID NO: 65064 - DNA, 3021 bp, Oryza sativa
attcataagacctaatcaacggtttaaaagtgtgcatcgtccctaaatgatgaatttactgaaccctagtaattttactgtgttgccaatttgcataatttacaagatctgtaggtctgcaacttattttgtgatgaagttacttcctgattatcgctgtattagagtggaatcagccaaaagattgaatatatgtgggctaggctctatgcgagataagtccagccaaaagagttctttagggtggcaatggcatactattagctcattgctgacagtacctgtacttatgaacagtgttcctcctggtgtacaaccataaatttattatttgcttatagtttattctaacctcttgtattcaggaaatttccactggacagttgaagatgttgcaaaatctattgtctgcatgataatgtctggtccatgtcttacaggatacacacaggtttgctgttaggacttggatatgttttatacttttatcgactctcttcataacttcatattatgctgcatggagaactttttgcactgctgctaacaaatatgtcagctttcaaatgttcctgactgtagacaattaacgactggtatgatcgagatatagatgcgataaatgaaccttaccgtcctattccttcaggcgctatatcagaaaatgaggtatgccaatggagctttttcctttcttttctgtgctcatatttattcacagttttgtttagtttcatcagctaatgacaaatgactactctgctgatttatgtgccatcagctatcactttaacattggggaagcacctttagcaatgggtttctgacaaaatactccctccatttttctttataagactaaccaacatcatacagaaaaatagagggggtataccaatataccataagtcgtaaaattgaaaaggttatatatatatatatcatgtaataaactaataatcttattacaagccatatatatttattgatcaactatctacacaatacctcatcgattaaagaagtggtggtgggatggcagacttactgccaccacgactactagttttttttatatatatacactagagattgcgaagtttcgatgcaatccctaatgatgttgccaggtgcaactgtctcaacaatcattgtgtcatgcaaaatgtatctcatgtatttactgacggcaacgatttcatccaggtcattactcaaatttgggcactgttgttagcagggcttggcctgggtgctctgttagatgtatgggtaagtctccagctaactgatcttgaatattagcaggttgaaaaagaaaacgctcttctttgttttcttaattttttttgctacattttgcaggcaggacatgattttcctattattttttatcttgctgttggtgggtccttgctttcttacatatattcagctccacctctgaaggtatttgatacatctgttctgaatcacacaatcccccttgtttttagtacagtacatcataattagtcaacagcttttgattgaaaaaattgaaaaaaaaacacccttgcacatttcagctcaagcagaatggatggattggaaactttgctcttggtgcgagctacattggcttgccctggtaaattaacagtgcggatcttcttccatattgagtaaaaatctatgatattatatgcaagaaattagatgtatatcctatctgtatgtattcttcgcaggtgggctggccaggcattatttggaacccttactcctgatattgttgtcctgacttctttgtatagcatagctggggtatatcttcatacgattacttttcttgtaacagtgtatgcttttcatgatcattgaccgtctttcgtgattttctagctagggattgctattgtaaatgactttaagagtgttgagggagatagagctctggggcttcaggttcttcttctgtctgtagtgtagagttatcacagcccttttctgtagttccaaagaaaagcaatcatccatatcacttaccttttttcagtcactcccggttgcttttggtatggaaactgcaaagtggatatgtgtaggagcgattgacataactcaattatccgttgcaggtaaagacatgcattttcattatgttgcttttgtttcaaacattatcttcaaggctgtatcttggtttcattgattatgtggtccatgttgtcaacttgtcatgctgctatttagcatgccataatgttatgaatttattttattataaggggagggctaaacattaaaggagctaccatgtttgctcagaggcctaaaaattaccatgttattcagagaaaaagagaaatatttgcacggttcgatcatggtgggtctatactctatactgtaacaataaagattgattgctatagatggatgcaaattataattgtatttatagaactagatgcagagttttaagtaagacaatgtaggtctgcacaaccatgcggaaatttgatctggttactatttaaaaatattgtcgtttaaatttccagtgtaatgacgaaagttttaaagaaactataaaagggcagttgctgtgaaacaagaaatgtttcctaaatgttcagaattagctttagaaatgtttcccgtcatcccatgtcagcaaactgtccagcagataaatgttgctatgtcatctttgtgaatttccgtagcaaactgattattctgaggattgctatgttttcgagtggcgaccctagtactttcgaagcaccataaaatattgcattattctgacaaaatgaattccatttttcaggctaccttttcagttccggcaagccttattatgccctggcactgctaggactcacaattcctcaagtggtctttcaggtgagctggtcgttccaattagttctcccaaatggtttcctttatttctctggtctgatcccactcagtacaaaacatttcaaactgctgtgaatattaacatttctccctgtaatgctagtgagt

SEQ ID NO: 65065 - DNA, 7900 bp, Oryza sativa
agccactgatgaaagcagcaatcgccctggactgtgattctgtgacagcgaagttttgggtggaagatgcagattgatggttctctgcaactgttggtggagctaggttcagcagctatgttcgcgagtgtattacgctcttttggcggtgctgggtagtagaatgtagaatcgtttcttgttgattccctgaactgatccagatcaaacatcttctaaaggttctgcgatgcaatgctagctgcagacgggagatggtacagggggtcgttttgctactttgccgccgatgttgtagggtgtgtagacagactgtagatgaataatgtcagtaacacctgtggggggttcagtgctagtgggctgcaaaacttgagcactgcttcgatcaaattgtgtctttgattatgaaattatggaatccagcacaggcaggtaataatttcgtaatagagcataaacaatttgtgaccttaggtgcgaagaacataaagctgaccaaggtgaagtaatattgatgcattgtgcgctgcatttaatttggttgttgaattcagagtacgtatttaaataggtgtccggaggggaaaatgtacacaaatgtttactccgtttgctgtgcatctcgcagtgatacaaaaaaatacaaatcaaaccacgctaaaaaatttagtcagttgctcgtcttcagaattcagtcctcaaatatttttaatgtttcctccatggctgctcgtccgttcattttgcactcgttttgctctctgtgaactggagagccccagaggttctctttttgcatgtaatctgagtttctgatcaaccattcagcctggctaagaaaaccatatggtggtggcgttcttctaacttgtgtctgcgcggctgttggcttcatccaattcatcgatcgccagttactacttacttactaacagcgtccgggaacaggagttgagccaaagaggcaggtttatcttccattaagcttaagagaactcggagatatctcgaagttcttggcacggcacgtcctgttttcactttcaaacttgagcattcagtttagacgaggtacttgattttttttttgtgtgcacgccccagcaggtgttttaagaaaaaaattaggcaacttaaaattgttgtcccttctcctgtgttttgcgctaataattccatcctgcacatggcatctctgaggaatcaaagatcaactagcaacagcaacaattagccgcgatagatcagacatagacactggcactttcggatgaacaacagctagctagattaactgaaagcaagcacggttacaaaggacacacccagcagaggcatcagttggaaacaagaagctagcagctgctggccatgaaaagccaaagcatcacctagctagcattcagcccctgcctgaccgatcctgcaataaactaaaacacataccctagctactgaccatgatcgatcagcacctaaaccaaactaccaaagctagctaaagctaagcacgcatcaccatatgaaacataacatagcaaatcatacgggcgcctaaatgcgtgcatccgtcaagacctacattattattgataagagagctagctagctaagactgactcgatgactacaactgagacgactacgacacactggcattcacggatgcaaaagtgtgtgtagtctaggacttggtcttgtacttggactcgtcgatgtcgatgccctcgcgggcggcgcgctcgccgccggactcgtcgccggtgctgaggccgcccttgcgccccatctcgcggtacccttcctcccccatctgctccttcctcgtctgccccccgcggctgcgccctgatcgatcgatgcacacgtacgcatattagttacgtacttcaaccgaaataccgaatgaaatggcaagtttgatctatcaaaagtttcagtattattttgcataccctcggcgaggttctcctgggcctcgaggctcttgccgccggtgccgccggggacgacggtctggccctccctggccatgcggtccagctccgacctgccctgctgctgctgcccggacgccattgccaaacactagttagctagcctgacgtacgctgcgaactgatcgatgaacaaatcggaagggtggcttgtgtttgtgtgtgtatgtcttctgcggcttgagctgatggggatggacgacgcggccgcgctgtccttcttataggcggcgacggacggggcggtgctccgcggcgggatcagggcgccggcaacgtacgtgtcgcgcggcgacgcggacggctcggtgcgcgcgcgcgcctccgcgacacgcgtcgtggcgaggccgccggagcgcgacacgtacgtgcgcaagctatgcctccgcccgtgcgcggcgcgctctggttcgctgcatgcgcgtgcgcgcgcgtgcctatgcatacgcatatactactccgtatgtccgtgctagcgcgactgcgcgagcgcgagcgagcgagcggcggggtggctgcactgtcgacacgtcgatcgggatgtcgatcaccgtgcatgcatgtggacatgtggtaggctcgcacgcaccacctggtcggggggaagcccatgcgtagaccgatcgtggaccggcgaccagatgtttccggctcgctctctcagctactgtgtgcaactgcatgtgtattgacgcagtactactctcatgccctttctcagatggttttcatgtatgggtaaaattgcttggaccgacaactcggtgacactgtagagtgacaattaatatgaacgttgcatacgtctgtcgtctctttatggataactaaatatttttatgcatgaaggattattcatttatcatttatggcttctttaattgatttgtttcgtgcttcagattagtggtggcgttaggatttcttctagcctagagctcaaattgaagattaaaattgcccatgaccacacatagaccaagtacagtaaaaatgtcaaaaaaaaagcaaaaatgagggctaaaattaccatgacaattcatacacggaacggaagtacagtaaaaattaaaaagaactgaattaacatttcattggaatacccccatgatcttcactctccatcaacagcactacagtatggagagaggctgaacttgaatctgaaaaatgatattactgcaaattatgagaacttaactatttacaaggaatatatgacatacctcgatgatcttcatttctcaaagcacgattatgataatgttctgtaatatcttcgacactagcaaaattatctcgctcttcaaacaacaaaaacatctcatgttttgcttagaaaggaagcaattaaaacagaaaattgcatccttagcaaccaattgtgctttttaaaacataacttccgaaagctcccattcacccctatatttgttctgctcctctttatctaggaaatcaaaccaaatttctcactaactgcttgtctacaaccaaatacaaaatgagaatgtacatcaaagattagagactagactaacctggatttgggggatcaaaacgagaatgcagatccaagttgttgccgctatcgatgcgcgccccagccgatgttgcgagatgagaggagcagtgaacatgcaccgatgcatgatgcaacgttggagtcatgagtgcagcgtgaggagtgaggacggtagactggtggagattatagtttagggttgtctattgggaagtgaggagtgaggacactgaattagggttggtcacttgggttgtctattgggctgtgatccgtctattaggctaggaacctggccacttgaggttgggaaaggatgtgcgtggggctgggctagaggagtagggttgggccaagcgatgttgagaaagtctgaaaatatgataatttcttccacgagtagggctcgggcccaagctgctaaagccacggttctacccctgcttcagatgtgttatgctattatcaccgaggagcacatgcggaagcctttgtaaaatgtgccgatgcttttaccgtgttctctattgtacaaccataaaaacaatatgagttgttggtttataagacatattactactttactagctatgtgatccgggataattttcacatttggattttccccttccattacttaggtcccttggtcgaagggcgcctccttccaccacatcccgctttcgccgtcgcaaaatccctcctatcaccggcgctctactctgatggcctgcaaacggttttcaccactacatgctgctgccattctttcaacatcgcctcctccaattgttactgtctgaatcattggatatattgaccgtattactgtaatctttgtgcgctagagctccgcaagtgtccgatttcaagcggcgacacccacttaggtggacgcgcggaggatgactttagtccccatgcttcagtgttgttccctgtcgcctccttagttcatccccaatactagtcccgaaagacgtctaatgtgaaggaactggagggcggcatcgactccgtatgcaagacttgcacgaaccatcatcgcccacattgtttcttccagcagtctctagtaccgttcatcctcgttgtccttgcgagagctgtccctagccgtccctagtcccgtgcaggttgtgtgactctacagggccctaaatcatatattaagtaccctacatatataatgccatattggttttcgtttcttttttttttcaagttcagttgagtttttttattcacaattggcctaatctctctccagttctccttgtttcctaatccgtgggttctcctacctagctcactagttgcttcccctagggtcacttcgcattgctccattagtattgcaacacgggaggaatgcaatgacagcagcaacactgagcgctcgtggttgctgtcagcctgtcactgctcttagttttcttggagcctataggctgctggcgacgcatatacaatcaaaagcaagttgctgctgtagcggccatagaggcaggtgggtgattggcagttgcagcgacaaagcttcagtattctggtatatactccaagtccaacccttatattccgcttttccttttcattttttttgtatgtacggatcagctgatttagtgttttattgttaacttacaagccaacttaagtttaaagttttgcatggggccacggaattttcggggatggtcctggtccccttgacaccgtttgtccccgtcatcatcaccgcaggtcatcgccgttgttgatccctgcttcgatgatgctctattgcattgccactgactttacgcggggtgcagctgctagcactttcctctggcatgccaaaggccatgtctcgccggctgtgttctattctaacatggagagatgtgctcaaggatggatctagatctagggcagctagggctcaagccataggtctttaaaagttctagactccatataaatttctaaaatctgtatgaatttgtaggaaattatgacaaagtaatggaaatgagtcctagggggtggctcctggctggctctgtaactgattgttctccactgtccctgaagttcatgttaaaattgtgcctttatattccaccggctctacatgtgaaaagtagtagtggtagtatagatgcgcatatcattttgttaatcatagatcacttatgcttgtatggaaagtttgataatggactaatagaaatttagcatgtccaggtcatgttctgttatacaaaagtacgtaaatgtaaatcactcttactactagaatcaatatcgagccttcaattgtttctctatctatttgagtgtcatgattattcttagttagttaattttctcactctccccaaaatgtgacgaattagaaactgggagtgtaacaatcaaactagaaaaaaaaaagtagttgcaagcgggccaaaaccgttttcccaggcagacgagccttccgcctacgagcaaatgcctctggtaaattggtagtagagccaatactgacaaatgcttgtgcctataagggcagacctaaattaccagagggggctcccaagaactcggttaagaattttttttagctataattagtttagtttcaccatatgtgcacccctcaattcaaactcaagcacccatatcagcttatacttgatcaaaaacaaagtaaagcaagcgagtggtacccctctccattttattctagctccaccctgccttgtggtgtgggtaaaactatatggtgatttggtacgttttaacctaatagcttggggtagaaacaattgttgtatttttttagactagaaacaggcctatatgttgtaacgggtcatacatacataaaattagggatgggctagaagggtgattgaggttaaagcaatgggttcggtagttatgcatgcgaggagtgtaaggagtaaggacgctctgactacggtgggaggaggagatgtaaggagaatggttccacttttacagtctcaaatttcaattagcggaagtgcaatagtttggacaaccagttgtacaaactgctccatgcctagagcctaccgagaaagttattacgtaaacatgtgagtctatagcattagtgttagactgttagtgacattagtgctagtgagaactaatggttttgtttagttcaaacatggccttttttttgtgttatttctgatttactttgtaatatctttgggtgtagtccgacaacatgaattctagttacattggcctaaaggtttgggaggagtataaaatcgaaagtaccttgatgccacctataggggggtgaataggcgttcctaaaaattatcacaacttcatagcatattagaatgatgagagctttcggttcaaatcgaaacttcggtatgggattggaagttccgatctcaaccgaaaagttcggtggataacggaataaaacattagctatgaacttgtagctcgaacaaacaaaatgtatatgaatcaaaaggtgacaaataaggtatctatgcaatatataaggtcactaactatattaattaagcatgcaagtagatcgagtaaaaacaagctcaagcacaatatgggagatgacaagaacgagcaaaccaagagagaagacatgttgatttgtttcccgaagtttggatccatggatcctacgtctccgttgaggggccacaaggccgggtctatttcaacgctttcctcacgaggttgcacaaatgcactcattggtttcactgttgatttcttcccttgcggaggcgaaatcgaagccttcacaaactttccgtggcacacgacaaccttggatgctcaccggcgacgcctagccgtctaggagatcttagtccccaagagtaacaaacaccatcgaagatttgcttgctatgaactcgagtgctcaaagtatagagtgaatctcactagctctcaactcctcactctctcaatccaactctcttcccttctcaaatcccactcacaaagaggcactacaaaggatggaatgaagctcactagctctcaacttctcaatctctcaatacaactctctccccttctcaaatccctctcacaaagaggcatcacaaaggtagggaaatgaggatgcctatttggctttggatgcgtctaatgttgcccaagaacagcagcccctcaaaggagggctggaggagtttatatactcgagcctctcaaaaactagccgttggaggccaagactgcgatttttggaaattccgaaatgaattttcggataagtctgaaaatttacagaagcgaatctcagtttcgcagccatttttagaatttccaaaaattttcggagttttccgataatttttcggaatttcca

SEQ ID NO: 65066 - DNA, 2968 bp, Oryza sativa
tgtagcttcaaatggcctcacacggtctatcatgacaaagctgtcactcgtccttcaccaccggatttggttcttcggcgccaagcaccttgattgcccttcaccgccgcatggtccatcgtgaccgagcttcgcttgcccttcaccgtcttgccatagtagccacttcgtatcccacatcttcaatatcttcactttgtcattcttggtatcgttaggtgtaattatatcacttgagcatcaacacctttgcaatccttgggacctatttctttcattcaacccaataaaattattagtcccaatgatccagttgtcaacctccacaagttgaccaaccgatcgcatgtataaaagaatatgaataaatgatgagtattaatcaataccacaagtgccatatactcaaacatacactcaaatgtaaagatcccaattaaatgaaagtgaataacttggatcaattacatgcataactaaagtataggatttgctccccctaactgtatgaaaaaaaatgtttgtgtgaagcaagagtatgcataaaagaatgaaacattaggagcttaccctatacaaggatagatggcatttatcaaatataaacattaaaataaatgtataccttcatcatctttaggttctcaatgtaaagagataaacaagagaaaagactcaaacaaaacattagtctcacatgtatattgttattcacatggaaatattatatatgaacatatcaatatgtacatggagagaaacagtgatacatatagcttgatctccatgcatttcatccttgtgatttaggtctatcatcaatgaatgtttctatctcaactcataagaagtccggtaatcacctctcacacactccactttcatgtccacatgagactaggcaaagaaatgcttataaaaatattagtttcacataattggatttatcattaatcaccaaaaccaaattaatggcacttgaactttcaaaaatgatgggtaatgtggtttttataagcgaggacaaagactactaattctatattgagtatgctaagggtaagggttttattgtgagcccaaaagcaggtgtgcacgcagaaatgctaggtaagatacattgttctctcaacccttaatatccatcgttatagaccagaagtagatcggattaagtagagcaagacctttaaaaactaggtgaagtggaaggattgtatggtcatatggagtcagtttgtatgctcaacttaaggctatatggatttgaaacactttgaaaagacaaaccagaaaagagatccgcaggccctcactcgttgtggttgcaaagctaagcttgacatagagctcaatgaggagagaggagtgtgttgtgttaaggagtttaaaaaccaacatacacgtgaacttgcaaatctctattaagtgacaggtttaataccagagatatgctggatagaagacattgtgcgaaggatgatgatgatctaacatgtcttgtgtaatggtgggcacagggaaactagacttcatcttttctttacttgcccttttagtgtcagatgttggcaacacctgagaattgtttggaacctggaaatttgggagatagtaatatgcaaaagcaattgctctattcgtctcatttttcatcgaagattcttgcatcaatgttgattccattaatttgcaaagctttcctacttgatgattctacaatttgtccccgatagaaataaacatatctaaaatctatggctaaacgaatttgcagtgatttgatctgaagtagactagatttgagacaaaggtaggacgacagacatggcacaagtggaatagcaccttgttggcaaagagcagcgacgctcaaaggcgtgctagctgaagatggatgtgatcgacagacacacgatgacttgcacgtagcccagccaatgcatgtgtggaacagttgagctaactagagttttcagtaaatgaaataaacctggtaaaataatacctagtttaaaactagtaaaatacaacagttaacttactcagtggagattatgggtaccccatacccacacggcatggttatccgaccggtgtagggggtaacttatatctatgaaatatgtaacggatcatgacatgggtattacgtttccttgtatattatggaacggtctaaagtcctggtttggtaatattgtaaaatagattaggaaaccgataccgtattggttaaggtttctatcttgtaatcctgcccaccatcctatataaggtgggcaggaggccctctagggggcatgacataattagatcgtcagagttataatacgcctggcggattcaaatccccaaaaaggagtagggtattacctctcatcgagagggcctgaagctgtctaaattcttgtctcctcatccatccacttttaggtctcgtgcgctacacccttttattattgctgaaatcatgtttcgacatactctcttgtttatttttcaatattttgtaagatcatattattaacttctcacttaaatgtgttatcggctcttgtcctttatgagtaatgcaaattcatcttctttgtttcaacgatttgtctagtaattactatatatggccaaatgggttgttcggtccgacacagctgttggtatttcttaacaacattactagaaatataattcccagcaatggcgcagaaatacttccggtatattatggttatagagttcatccgcaagcgcaagcgcacggatataccattgtagcatttcacccgagagtattccaagggtatcatatttattttgtcccgtgggaagatcatgtagagagaactcaactaataatttatatattacttgtgataatcatattctaagcagggattaagataatccaagggtagagtgacacacaaacatttctactcatcctcataataaataatctaagcta

SEQ ID NO: 65067 - DNA, 3674 bp, Oryza sativa
aaaatagatttaggaaaccaataccgtattggttaaggtttctatcttgtaatccttcccaccatcctatataaggtgggtaggaggccttctagggggcatgacataactagatcgtcagatctataatacacccggcggattcaaatccccaaacaggattagggtattacctctcatcgagagggcctgaacctgtctaaatccctgtcttcgcatccatccacttttaggtctcgtgcgctacccccttttattattgccgaaatcatgtttcgatagttagcgcgccaggtaggggtgcgtcgagtttcctatcaagaagtgcggtggaaccaatctccgacgtcgccggattcatattcaccccaagcctctcactttgggagtttcgatttcttcgtccaccagtttggaattttccgcttcttcaattcagatgcaaatcagtcgggaaggctcaagacctctttcatctcgtttgatcgccgtcatgtttactggttttattgaagaaagttgacatgttgtgttcatcatctggttcaatctgcttggcgataccatgcaacggatcaattctcaactgccagcgttttttatagacgatgtcaaatttcctagcgatactcaattaccaatccaaatcggaatcagcctgcacttggagccaaccgatcagagcagtcgtcgccgagttatttccctgatcagcaatactcgaagacaatggctatcatgagtctccacgaccaatcatgcaagtgtatgtttccatctgaatctgatacatgtgcaaacgagcgtgcatggcaatttggtcaatcaaccaggagctgtcatgtcatcaacaatttcgaccagggggcctccacttcatcagcaccgtggacgtcgccgccagtcgccttattcaacaacaatcacacatgcataactctccgagcgctggtcacggccactggacctttgcaatttttgtttgccacgatgatctgcacctaccacggcctcgacgcgcacacacaggcggagattttgccctcttgggtagtttcatctcttctgtccagatcaattgcgccaaacccgacgccatgcaattttttgaggaacaatgcaatacatcaagccatgtatagtatgttcatctatatattcggcacggctgcctattcatgttggctgtcatccaggacacctcgctgggatctgccttcaccgatggccgtggttgctttcgctaccgccgcctagtgtcttcgtatccacagttggatggtcacaccaccattgctgggcatctacgtcttcaccgaccggctggcgttcgccgtcgcagactggtgtttccgcctgcacggttggcctattatgccgccgttgttgggcatctacgacttcaccaccggcatgcctccgtcgccgccaactggtgtcctcacctatacagttagttggtcacaccaccgttcatggacgtccacgtcttcaccgactggctggccttcgccaccgctgactggtgtttccgcctgcatggctggtatattatgccgccgttgttgggcgtctacgacttcaccgtcagcctgcttccgtcgccgccgactggtgctcacgcctatacggttggttggtcacaccgccgttgatgagcatctactttttcaccatcgacttgcctttgtcaccgctgactggtgtctcgcctatacggttggttggtcacaccaccgtcgatgggcttcatcatctacaccaccagcttggttccactggtgccgactggtgttttcgtcagcaaggggactaccaaaagctaagtcatcattaattttcttttttatatgatatttttccttttcctctgcctcattgcatcaactagttctccgttgactagtgagtcgggggctacagatgttatatcatatttttttcaataattttcataatatttatcttgattgcttgcgatataatctgagtacaaaagttctatcttcctatgctttccgtttggtttgtcgatggatagttgcctttgggccgattcctagcaccgggggctcgttggatggaccgagtaacgcaaggtgctaagtattattcggaataaatcaaaagtatagagataagataaatttttttctgctcttaacaattgcgaaagtacctgagtagtaaattttgattcgtgaaactttgttccattaatgacgaacgcatgtcactcctatgcatgtttaggaagtgcctaggccgactcccggtgcttgggggctatgactagtcgggcagagtgtttaaacgtaaggagtcatctgcttggggaaatcaaaattaacaagaggagaaatacatatttataaacattttgaaatcttgaattttcctcaagtactatatttacatcagatactactcattctatacgtttgttctgcaggatccagatccagatatgcataatagggattcatggctttaagcttatctcctatgcttcaggaatagatcaatcagaacatcaccattggcttgttgtcgccgccgccgactggtgtccttgcctacacggttggttggtcacaccaccattgttgggcgtctactccttcacccacggttcgtctagtccgccgctgactggtgtttctgcctacacggttggttggtcacaccacagttgttgggcgtctacgtcttcactgatcggcttgcctttgccggcgccgactggtgtctccgcctgcatggctagcctattatgccaccgttgttgggcatctatgtcttcaccaccggcttgccctcggcgccgccgactggtgtctccgcctgcatggctggcctattatgccgctgttgtcgggcatctacgtcttcaccaccggttcgtctagtccgccgccgactggtgtcttcacctatacggttggttggttacaacactgtgttgggcgtctatgtcttcaccattggcttgccttcgccgccaccgactggtgtatccgtctgcacggctggcctattatgctgccgttgttggacgtctgtatcttcatcgaccggccgcctcgtatgatgccaacttgtgctatcgtcttcacggccacgacgccaccgccaccgccgctaataggcgtcatcatcttcaacgcaagctgtctgttgactagggccctcgcctctacggctggtttataccactatactactgatggacgtcatcgtcttcattgctggccaccttgtctgacgccgactggattattcgccttcacgattgcgtgtcttcatcatcattgaccggcgtcatcgtcattgctggtttgccttcgccgccactcgtggtgtcttcactttcacggctggcctattatgccgccgctcaaggacgttttcgttttcttcatcactctacttcttccgtcgccgactggttatgccaccgtcggctggtgtttttatcttcacaatcacgcgtctttgctaccggtttgcttatgatgccgccgactcgtgttcacttcatcatggctatgcaactttgtcattatggtggagctacttcatcttcattgtcttcggcaccagcaaactctattgccggtacttcgcaagttttgctactttaccagccacgacgtctccaagagcctcgacat

SEQ ID NO: 65068 - DNA, 6754 bp, Oryza sativa
atttcttgcatgtattcgacgaagggagggacttccctaaacggctaataagtcatcagtaaccgtttaggaaccgctaccaatggtcgtccttatgctggtggataactaaacatcgtccttatgctggtagataactaaacagaatctatttcacatgttaatctttcttccccactagaatacaatctcacaccctcgtacgaatttgtcaacccatgtagtgcaggtacacacttcacgaaatttttttatttatacattttttttattaaaatatttacaaaaataatttttatatttcaaaaatttacaaatctaatcgcgtgccgccctctgggagggccaaagggcggcaagggatctaaatgcaaattttccaacacaacttgttagctctatgattttacaatttaaaattatattatataaagtcagatgaaataaaactttatattaaaattgtagagctcaaggagatctacaactttgtagttaacaactttttcatttaatatgttttagatatccaaatattcgttacaaaatataaaacatattttaaaaaatctcagatctacatttcaaacaatattgaatggagataaactttatataaaagttgtagatcttaatgagatctataactttgtagtttatcacttttccatttaaaatcatttagagtatcgaataagcattattaatttttaagcaattaaaaccgatggaaagggtttgaacacaaataaaaattttgcatttaggtcccttgccgccctctggaagggcgatttttaaaaatcgccctcccaaagggcggcaggcgattagatttataaattttcgaaacaaaaaattaattttgtaaatattttaataaaaaatgtataaataaaaaaaattccacacttcacccgaaaatgcttcgcggccgtcccaatgtctggttctttctattgggccctctactgttggtggccctttttttttcccatttccccatttcctctgttccaccacaaagctactctctctgttcagattcgttatactagaatgtgtcactatggtagaatgtgtcactatggtgtatgtcactatggtgtaggggagcaagagaggtcaccaactagcgcttggtgtgggaaatcaggcatgggagcttgtcgaagatatgctggtgtggccaaggtgctcgttgtcatggtgtgggctcgcatcagccaatagcggtacaagctatagcgatgtggcatgcctttcttctctagtgtggaagggaggagaccgatttcttgtcactgttgggtggttggctcagaaggagaagccagagatttagtcactgaagataaggaagaagctagactaagtaggtatattttttgatttttttttatggttgagctaatatatcttgatgtttcacatgtgtttgaaaaaggttttaactggaggtaaaacgatgttgcatttgtttgaaatatgtacaattttacgattttacgattcttttgatgtttgtttttgatgtttcgccgatgataggaaaatgtctcaactatgtttaggcaatgttgtattttttgctacaattttgtctagtgatgaaatatttctatataaagtgacgaaacaactgtcaatttgccgttgtgtcccactttaccacacacactaatatactacttcataaaattattttttttggtcgattatcgaacgttggaattgaacattggttgaggtacttagtgatatgggaagtgcgacatgtgattagcgcatgatcaaataagtgtattataaatatacaaattggattcatttggtttctaagaataacttctataaagtttttttttaaaaaaatacactctccatctcaaaatatagcaaacttctaagttctaaaatatgtcccaaaataacacctagcttcaaaagtgcactttttactatgtaatatacaaatcctacccttgccttgttttctatactaagccaagacatattaatgcggggtagtataattgtttttacccgcctccttaataattgtgctcaactctaaaaattacgtagtactatattttagagcgggtgaagtattgtctagcagcttgagactcacgataaacaaaccaaaagagaaggtcattccaatagccaaaacaaacgatatctgaatcttataaatacgaggagcgctccaaatttataatttgaatctgtattgaatggttctattaatattaatataaagctcaagcggaaacattagtgccatggagtggtcaaaattagccattgctttgcgtttctaaatatctgcttaccttaccatcatatacttctaagtatcgtattggtagcgatgatctagaccattatttattatgctctaaagttcagaatctacatagatttttggtaaataataaagctaagtgttaagtgttacagagtatacctccatcccacgatatttaaatggaatacagtgatatactccatctgttttatattataagaggcttttgattttttttctaaatcaaactgcttaccaagtttatcgaataatgtagcaactcttacaatgttccattaaatcgaacattgaatatattttagttttatagttttatgttatttgctattaaaaattgctacattttattacaaatttggccaaacttatataatttagacttcaagagagtcaaaataacttgtaatatgaaaaagagatagacaaatgtttactacggagtatatgatactcccttcgtcctataaaatcaactactgactatgtatctaatttatatccatacttagctagaagtttgttttctattgatagtgggagtactacctctgtctcaaaagatataatgctagcttttgaaattacattacatggaaagaaagctacttagataaatggttgggattacaatggacaagaaattagaataaagattgattgtaggaaaaacaatatttcattaccatttataaaaaaagaataaatttcacatagacccaaatattatgtctaaattgcacaaaaccacaggagtttttgacacgttacatataactccaggtattatggccataaagtttcacaaaaccacaatattaatcattttaactttgatttaccatgcttttgagttctacaaccacatctcaaattttgatataggagtacgtcaatttgatatatgagactttaggaccataatatctaatgttacatgccacgtaccaaaatccatgtgattttgtctaacttggatcataatagatagatagggttttatgaaatttattcttaaagaaattaaaaaaatgagtaagttataattattatttttattacggagggcctaacaaaaattacaaaaacaagggaaattagtacagttgttttttttagccccgggccggcgtaggtaacacgcagaccacctggcgggacccacagcagccgtggccccaccctccccgctccaaccgggccccaccccaccaccgctggcggtggcggcgcctctcccgtggctaacaaaaaccctagcgcgccgccccctcctcctccttcttaccaccaacctctccccccacgatcgccctcctccccgaaacttctggaaccgagagcagcagacgttagctcttctcctccgatggcggacaaggagcccgtcgtggaccgccccgaggacgaggaggaggcctccgccgccgccgccgccgcgggcggcgaggaggaggacacgggcgcccaggtcgcccccatcgtgcggctcgaggaggtcgccgtcaccaccggcgaggaggacgaggacgtgctcctcgacatgtgagccccccccgccgccgccgcttgctctctctcctcttctcccctctcttgtagctcgtgtgctttttttcggttcgatctggtggcgctgatccgcgcgattgtttgcaggaaggcgaagctttaccggtttgacaaggaggggaaccagtggaaggagcgggggacgggcaccgtcaagctcctcaagcacaaggagaacggcaaggtccgcctcgtcatgcgccaggccaagacgctcaagatctgcgcgaaccacctaggtttctccccaaactaatttcctcctccgaatttccccgcctctctctctctctctctctctctctctctctctcttctcttcgggggaggattggttacagatgttgcaatcgcggtgcctgtgtagtatagattcatgtggcccaataacctcgttgctaaggctttgtgtcgtcttgtgtgcagttgcttcgaccacgaagatgcaggagcatgcgggcagtgacaagtcgtgcgtctggcacgcggcggacttcgccgacggcgagcttaaggaggagatgttcgcaatccggtttggctctgtcgaaagtgagttgttcgctcccgtcgtctctgggctaatttgttctgttgtagtcgtatctactatgtagtgtggttatccttgcttggtagtattatgttggatcatgccgtttgcttttgttcatggtggcaatagtagttttcctatctgagattccgttgaacgttgatgggttgcaatttttgcttaaccaaagttgtgcttaagaacatgttgaattgggggtacttgtgaatctattggttgtttcatatgatgtttctatgaggagtgttggatagctaaccttgaaggattttcgcacgctttggatcggatgggtgggataacataggggcaccaattcccctggtcttccctgtcattacagttttcatctaatttttaccttaataattattgagatttgtcatgttcaattttaagattctgttattagaccctatgaggtaaactggagatgggacaccatgatgtctctctgtttatgttgctacttgctagtcatgtggagaacaatcttactgaaacttaaaatgtacagaataataatgaactagactggtccatgatatttaacattctgtttacctcatgttttgttttttactccctccgtttcacaatgtaagtcattctaatatttgccacattcatattgatgttaatgaatctagatatatatatccatctagattaattaacatcaacatgaatgtgggaaatgctagaataaacggaggaagtatgtggtaaagtacacttgatatgtataattcccaatgtatatttttgtgtagctatccaggtgcacactgttgtggtagaacacaggttgtttgctcttgctggccattggcttctttaggcactattgcggtagaatgatttaggtacacactgttgtggtagaaaaaataggctttctttgtgttaacacatttttagcagtcgttacagattacattctttcattccttgtctgtaaaggtgaagtagtgaactttgtaactttcatgtgtttgtgggggcatctttttcttgaatagtacaatataatttttgccattagtaatgaacgtgtttattattatgtagctacaacattatgtctagtagcatctgcatgagcagcatcctcttcatctactatgttccatttgttgcacatatttcattctgttatttgaatcttctgaaaactatctgaatttaactgactaagattcctatcatataattcctagattgcaagaaatttaaggatttggttgaagagatttcggaatcacttgcaaagacagaaggcaaagaaaccgaggaagattcgtctgccgctggccttctggagaaactcagcgtaactgaaaagaagtctgaggaagtggcgacaaaggaggaatcgaccgaagcagtcaaggagactgacaccaaatcagctgccacctcagagtaatcagcagtgtgttacctccagaacactagtgctcggtgggaagggtaagtttgtcagtgcttcccgtctatggaagttaaaagtcgttagccatgagctatgttgagaacatttgggcagagtcggaagatgtcagggtcatctttacctattgggcgttcacttgttattatttatttgtttgtgtatggtttctgcttagagtcgcaggttggcttttggatcaggtctgttcggatctcgcttttatcgagaacacgaaatgtagtccatgagtaggacgagttggaacgttttgggtccgagttacgagtatcttgacagcaagatgtttatggatgcgtgctattcatataaattacatgataccatgttcaactctaatccagttgctatgggaaagacgatatttcatttctatgtccaatttgtcatatttctataaggtcttctcgtatatactcctgttggtttgctcaccatagctgctgtccagcaactgtatatctttttgtcgtcgtaaaaatgtaaaatcctccggttgatttgcttgccatagctgttgtcctgcaactgtacaggaaaaatgttgtacgtaacagtggtttttgaagtatatttacgcgttagtgattcacgattcacgtgcacattaaaatttggatccttttggtttagtttcagaataattcatatttttctttttttatttggtaaaatattgatgttgttcagaaatatataggctggagctagataaatgtgttgatttatgttatctactccctccgtccaaaaaaaactcaatctgacccctcctaagacaacgaaagtctagatt

SEQ ID NO: 65069 - DNA, 2491 bp, Oryza sativa
acatgataatccatagctttgaattgctaaatggaataaaaatacttacattgtatcttagaagtgagaaatacaaagtaaacaatacataagagcaaagaatagaaaactaagctttgatcttctactgcatgatgagccctgtcacaccaagaaccgcactggatcgatcttgaaacgcagccctaacatgcattcttcatccatgatccattcacggattcacctctaacttgctcttactcaactttgcccatatcatcatatagatccattcgattcaaaaccaggcccctagagtttttgcttgccaactcatctagtatcagactatcagatagaagccccccgccccaacatagtgctatatggatgagattcaggtagaaacatctcagatctagcaaaacttgagaccctagataccgtgttgcatcccaaccatcactggcattgccaaccaaccttttgttattcgccggttttgcaactcactacagccgtctagctcagcaaaattcaaccgactctaacccttaggccagatcaaactaccgttgttgctgtcggcaatgctcaagtccatcatcttcacttcttgttgcagccacctcacgtccaaagagtactttcatgtgatgttttataactaaaggcgatcatatgctacaaaaatgttatcctgaaaattttaattcgtaagtacatgagtgatgtttaaccttgtaacttctgaattttccaaatattaggtttagatttggtcaattgattgtaaagttttgcagttgttactgaaggtgcacttaaactccctagtgggttttggtgattaatgacaaggtggttaaaggggactaacatgtttatcaagtttattcacaggagtttagtcccaaagcaagttgtgatggctaagaatgcaaggagaccccccaatttgaatgttcctaagtgcgaaaaacaccgaaggtgattagactaggtttttctctttcgaaattgagtttaggaaaaaccgtactattaagaggggtttcaagtgtggttctagggtatacaaagtgctcttagtcatttccatgagtcaaaatatttttggaatcatttttgcaaaatgatttttctccccgggacagagagggctacccggaggttttggccggaacttccgggcgccattgcaaaagcaaaaatttcctaagtgctgcccggaagttcctggcacttttgcccagaacctcctagcaggtttccagttcaaatttgtgagtaacggctagatgacgtcacctagccgttatatatatggatttcgtccccaggtcaccctttggccattccacttcagctctttcatgttctagggttttctagccactcccaagcttcctttgctttctccactcaaatctagagcctatcttgtgagattgagatattagattagagtgtaggagcgttttggagatggcttgaagattaggtttgattgagcactttggatatcttgtgggctgtcacttgggcttattactcttggagatcttctcctagatggttaggtgtcgcccgtgagcttctaaagatcttgtggatgtcctgggaaagtttgtgaaggttttcctcacctccgcaaggaaatgaggtaagtgagtaaagattcttgtattgagttttcagaggttgtcctaggtagagcaacttgcacttgtggtcttttctaaaaggaattgtgagttggatcttggtggtcactcaattctagaaaatgacctagaagtgttgagttgaaggatgtggacttcttctgggatctttgcataagtgaggcaaggggttaatcgagactcggctcttttgagcacctcaacggagagtaggatccgtgtgatccgaacttcgggaaaaaatcgcctttgtctctcttgtgcatgatctgtgtttaaatctgctggtatcttgagatttacatcttgtgcaactctgtgcctgatcgtctctagctaggacctgttttacttccctgtttcgttttttttgttgcccggaagttcctgactcaagaactccggaagttccgggatactcatcctgcccggaagttccggtgttcaccaccaggaggttccgggtcctaccaatttaaccgctatgattgttgagaaaatttcaggaaagcctattcacatctctgcacattcagttaccttcatagattcatgttgccattgctatatcttgcatctgccattgttgttcaagaccttattaagcatttcattaatcatgtagaaaattaacctgataaatcaaataaaatgtattagtgatccatttatgcaatcatgatagaaaacaacaacttcaataaatatcgactaacttcattgaaacatttctttttagacaacatgtattttacaacttcatggaaatataaccattaaaatttttgtttataagacaaaaccttttatctactgagttg

SEQ ID NO: 65070 - DNA, 2596 bp, Oryza sativa
ctgattgcttcattttgagctttggtagctttgttaggttattgttggtcgtgccatggatcatggctttgaattggttgttcccagaactttggatcaattcggactgctgtcctttttctgttgtagcacggtagtatactagtatgtgtcatttgtgggtgcatttcagttggcgatggaggtggtcgaatggtcttgtttggtgctataactagtctgaaggagatgctagtatctttgttgatcgttgctcggccatatgtgttgtcatctgtggcatgattaagcagatttggtggaaggtgacaatgaagtagatatctcactgagatgtttgccgaactttatatcctctagtaattcacgcgtagttcatcagattttggaagaatagaggttgtcgcatttcacctagcttattgcaacttgtttgagactaaatgctgttgctgcttttgctgttgtagagctggttgcatatattaatacaatgttattgcattaatgtaacacgtgcactgtagaatctggcaacttcaattgtttcctgatttatgtatatttggtttactgaatgcatttgatgtctttgcaaattatgttaattgatcaatacctgaaaacaatttttggtgtattaatagcaaaatatgaacaaaacaagttatcacgtactcgaacatttacattgaaatagagtggtggtacaattttaaaagccagatgttttgtttggtaaaagctattattttgcaacgtactctggtcatacagacaactctggattgttctgaaaaattgatttcaagttcatctgctacttactgtgccttctataatgacaggtatttgtttgatttgagattttccactgtgccttggacatttgagttctatggttgcaagatgaggctgttgacatcctctggagacatgttgaacttgttaacggtctaaaagtttgtcaccagcagggtgatggcatctagtacaaaatctgacttgatgtctggtagtcctgatgggcatggatacttcagtgggcaacgtggactgtattcagctgcttcgttggaaaggtcagcaagttttcgtgagagtggcgatagttatgcagcattcccagtatcaggttcatcaaggtcaccagcagttgactctgctactctgcttcaatcacttgccatggacttgcggacaacaactttggagccaaagacatctcggttggatgtaaaaaaatcaataagtttgattcttggaatttcccctgaagagtctacatcaactccatgcacaggacggaactcatctcttccttttgaagagattagacgcatgaagaataatcttagtgacatctcaaacaaagctaggtattattttactactctctacattgtcttgtgagattaacttaagttgtgcgatagggttgcaaacaactgcatcactacgtacttgattgagcaaccatctgtattatatatgtagaggcaacttttatttgtgatttactattctttgataatgtttattttacccttctaagggaagattattgggggaaaaaaatctcagtacatatggatggctatgtggactacatttgcttgaaactgttagaacatgttttcaattatgagtatctttgcagggaaagatctagagcttatggtgctgctgtaacaaagattgagagatgttgcccgaatattttgcggaagcgttccagaggagatggttcatcaaatgaacgatctactgcattgttgtctggaggacttatatccaagatgcccccccaaggccatctaaatgcagatgacacagaactggtatctccgagaggagaagagaggataaagaatgcaggacagaataggagattacgcacatccatgtccgaggttatgctcacatctctatgtatcattgtaggttactattgttgcgataatgtgatgttatacttctgaataagttagttctgacaattttcaggtaaaaaagtattattgaatcttacgtagtatgtattgcttgcagctaagccataggcctgttttggccttgctgtatttatctgtgcttttctttattgttgactttgttttattcatctgtttttcttgttttagcatgcagcctgtagctattagttttagcatgtttaatatgataagcatttttactgtgcacataatcatgatggtttgccatttcttaaaacttttactagtttggattgttcttaaaactgattaccacaacttattacttgtttactagatggatgcaaggaccactgttctgtcaaggggactgggctctactgatagaagtgcagatcctggcaaagtcaccggtggtggtccagcagttccagaagaaaaaattagggggctagcaactggtattgatggttgggaaaagccaaagatgaagaaaaaacgttctgctattaaggcagatgtttcaatgactggtccttcaagaaatgttgatgtagaccgggagcagaaaccagggatgcaacacaaatttaataatgaagctagggcaagaatgacaaactcccctagttttaggt

SEQ ID NO: 65071 - DNA, 1229 bp, Oryza sativa
gatcatgaggagctccttgctgcagcaaattctgctctaagtattggtttcacttgtgacatccttccatttatctagatatatttttctggaactatttgaataatgattggtttattacaggatctgctaattcaagtccattctggcggcaggttgaaccattctttagttatctgacaacagaagatatagcctatttaagtcagcaggtattgcagggtcatcttattttgtatcagaagatgtactaattttctctgcagtagagcggttggtagtttttgatcaatatttcatttgcttagatccatttatcggatgactccaccgcgagcaggtcaattgaaggtgatgaaagtcggaagtacaaggtactttatattacttttaagcacctttactgcaggaatatctgaagtttgtctgcttagttatgcagttgcagatagttaaactgtatagaagtagtagaatgcatggggtggttgatggcttgatgctcactttaccatggataactacttattttcttctacttctatctgcttctttctttgggttcagtttattatgctgatatttttggcttttgcagggtagtcttgaatacatctcgcaaccatcaactccggctggtagcaacaaagatgaccatagcgctcttcaaaatgggtataccctgaatgagatagataatgatgtagggattgcatgggagacaagctgcattgaacctatcctggatcaacttgtccaaggaattggggcgcgaggaggtgcatcagttggccaaagacttatgcaagctctgattgatgaagacaaggttgataatattaccaacaacatttacagaagtgaaacatatccatttgatacacatgaaattcatttcgaggaaggaggatggaaatcgcattcacagggttataagttggagtctttaatgaactttgaagctgcagggaaaggttctaatggtttgatgttagattctgattggaaatatcatgatgaactatcacataaaggcaataatgccatggagaaggccaaggtgtggcctgagtttcagtacagtgagatgtgcttcagtgataggatcatcattgagctaagtgaagttggtgtatccattgaacccgtggtatgtgttgtttcactgttcaactgtatcattctgtacaacaattttttttgttaggctggtatagaatttcgcgttg

SEQ ID NO: 65072 - DNA, 1458 bp, Oryza sativa
tcctgcaccccgagtgcagccgaacaggcccatcccacatagtctaaaacacaagagtacatagggtattacgctcccgagcgacctaatctgtatacttggttgtgtttggtgttcatcgtacgaacgaagcttgatctcaactcgccccttagccgaatctcaaaggggagggggggggggagttcttacttccctgctagaggagattcactcttcgacaatagtgaacagtgaacattagaatgtgattcttgctacattggacatctggtgccttagtatttgtcttaaaaaattttcttctaaaatagcaaaagaaagctagatatatacatcattgagtactatcgtgtcaagatgtttcgtagtgcttcagctccaactctacctctcttgaagctagatcccagtcaaatagttttagctccacttaaaaatggcacggagtgatactctcacaaaataaactaaagaagcaaaactaggtttagatagctctataaatccagtacaaatctaattactatagttaaatttaaaacttagagccttaccaaacggactccaagaacataacttcgacagatttccccaaaacaaaagtgtttcaccaggatctagacaaaacaaaattaaccatacacacaaaatatgccctttttttttttttgcccaactctatcatacttgtactaaacttgggttattctgtagaacatgacttcactactaaaatgcatatgagagaatacttgattctccgttattccctcgagatagatgttttgttagttgttcgctgaccatctcgtcgctgttagaacttaaaaaaatcagctcaaaggtcttctttccgcccttccccctttctccgagcagcgaacggcggcgcacggcagccatggtggagcgcgaggatgttggtgggccgatttcactggcatgggccgagcgcgagcctgttcgtcgtcggccttgctcgctcgattggagcggccgcgaaacgaagggtagcagcagcagcgccgtgcgattcggaacggacggaccaaggagcgacgcccgacgtccctctgacgttgcgcttctgggtgggttcagttcggttctagggctccgataggaacgttgccatggcggcggcggcggcgggaggcgatggtgaggcggcggtgatgcgggcggaggtcgccgcgctccggctccgcgtacaggttcgcggaccagcgttcgttttttcctttttctcttcttgcgcggctgtttcggtggatttagtgaagttgtttcttctctttttttttctctactggtgaattataattgggtgtgattaggagttggagagggagaaccagaggctgggtaagattgcttcgagatgcacctgcggcagctccaaggtgagatttcttttatccttagtactgccattttcattcatctaatcggagc

SEQ ID NO: 65073 - DNA, 2220 bp, Oryza sativa
cagtaccccaaaagtgtcactcagcaagttttatggcattagtcaagcatgaccccaccatatgctaacaaaaacctgcatctgtggctatacctttatagctagatatcttggagttttgatgatgttatcatgttgatatcatttctagaagaatgcttatgtactgcatccctcacctgttatcatttgtcatgaggttcttctctgttaacatttttcctgattttcttctgtaggacgacagtgctgcttcctctccagtagttagtgaaagtttgtccagcagtaaacaagaaccacagaagaacgtaaagtcacatgtaagtgtaacttcagaccataatgtcatattttaatttgatcagatggttccacaataacatctaccataatcacataatggagttttgctttcttatcttatctgagtcatatgcatacaatcgaattatagtgcaatggtattgtggaatacaatagttcatgcacatatgcaacttaagatacactaagtttctataggtaaggatagtcatttgtttactagaaggaactctgtttgttgtcatttttgcatgtaaatatattagatgtgtatgtctccattgagattaatggagcatatttttcacctatactaaaacattaattttctaagaaaacttctgtctaatattacctgttttttttcttgtgtttagtgtagaggttgccaagtgggggttgtaagtcactgcccaaagcgattaattgctctgaaaatcatgtactttggtcagaggtatgattttatttccaatacaaaaatcatgtgtttccttcatctgtgatgctttcttgcttaaactccgatacaatcccaatattgtgctagcttctatgtgatgaagataagaagattgcattaaaatcctgctactatgtgatcaaatataggcgtactatatgtgtatatgcaacagctttaagttaggaacctcttcactggtcacagatcaaactttgagtcaataatattaacacatgtttcttctgcaaaattgcaatatgttctcctggcacctgcaaaattgagtcaataatatcaaactttccaatccaagaacttctgctggcacctgcatccgttctctttactttgttagttcttattgctcgtggcctcgtgccttgtctcttttctcatttttttctgcaaatatgcttgttctcatgcagattttatggctttgcttcagaagcccacacagagcctacagttgaggtatattttttttcctacgaactacatatcagcttatttttgtttctctaagggcgtctaaggttttccattaatactcctaccttttctgttccagtctgagatatttaaagcacttgaaagggcgaagcttctggttggaagtaggaaagaatcatgttattctaggtgtggaagaactgataagggggtttctgctactggacaggtacttgaatgtgtatggtttgttcaatgctagatgattatattatgttttcttcttgtatataatataagcttatattactcatagtagtctcagatgtgatcacgaattatttttgtttctggttttatttttaagaagcactcttctggtctttctcatcagaaagtcatatttttcatgtgctactttcttgctactgactagtgattaatacaattatgtactgtgattaatacaagttcactttctctgtcatggaaaataccgcataaaaaagttcataacccaaactccctttttatacataaccatcaaccttttacattccacaatgcaacggttgacctcaaattttaaataatagcctgtaatggaagaaagaaatctatgtagaagtatcttcacaaccaatcagtatgtcattttgatgtgctcgatgttaaatttctgaagacatacgtcaaagattttaagtgctactgcttgcatgcaataggtacactattttttaggaatctagatagtaattttgtattgcaatagtgtttgatgatttttgcatggtgcagaaatgagtgcaatatggaaaatgtgagatatgtctatgcactaaataaaatttgtttcctcatcctgcacctgcaacatgcaggtaatttccttatttctgcgatccaacataaaagatgccaaattggatgtactagacaacaaatctggtatgtttctgccttctattctt

SEQ ID NO: 65074 - DNA, 18459 bp, Oryza sativa
  unsure (1)..(18459): unsure at all n locations
caaattccagtgcaaactttttcattttgccattgcatagagaagaatgatctagaactatccggggagctaaatgttgtctctatttaaaatttggactagtgctatactgttattccacttattataatatcataatactatgagctttattggttgctcatattttctaataagccaaaacgacttattagagaataaaaattaatttataggtaaaaattttatatattaatccataacaactcataagccaatgttaataaaaattacgttgaaaatatcttaaaatcaaattaaaaattaaatttaaaaattcaaatttaacttttgctttggcttattaggctaatgggagtatgggactctacttctccatacgtggtttgttagcaaggatattttagtcattctcttgtcaaagttgattgcctaaatatgcgcgccttggtaaaaatgcaagttaaatgcaaacagacagagcatatatacttgtatttttggtttatgttggcaatgggatactatccagtttatatttatgacatcgacatatgccaaaatagaccattaagcctttgagtaagttgtactctagtatctctttttaatggttggtggctctttaatgtgtcttatttagataaagatctgtttggttttagacagatgtaatgagtggttggatctgtagtttatatcattattaaaaataagataattaatatatatttagctaatacgtccttacgatgaatactacaattttgtggatcagtgaatacatgctctgatcacaaattcacaatagagctagatcaactgttttagagcaagttcaatagtatagctaaccaataggtccaaattatatattcaatctaataacttattcattacttataaacatatattgcaccaaaaatatatagtctcacctcttatgcataaacaatattttagagtccgtgttgcagctggctataaatctgtaacccatttttcgtctctcttatctcttccatacgtgcttatagctgacatgtagtctgctatattgtacttgttcttactagctatctctactctcccaagctcagctaaaaaattcttccaagatattgggaaaaataaaagggcggcgagctgggcgagcgaccaccaccgacggctggtgtggatctagtggcggctctgcctgagctcaacacgacagccgcccggcggagcggatctagccatgggaagactagcgagtagtgaccgagtgacaaccattgtcgtcatccccttcctcgtcgccagggtgacacactgacacgggcagggcagatcaagccatcgcctccgctgccatcctttggcgagccatcgcctccaaatcctccctcgatggcgtctcggttgccggaaggcgtgggctcctgccgccgaatccggccctctgcactcgctctagccgtcggagccctctctgcatcttctgccccttctccgttcgccgccgtagcgacgctcagacaatgaccctcgtctttctcgcggaggtcgccgtcgatgggagccgcacgagtggcgggacctcctctctccttgatccggctcactctctcctgcttttacttcttgtctaacatggtcacccgttcctccattcttcgtttgggtagcgaggagcttacttggagcacggcagatacgtacagacgtgaatggaaatcttctagctagttagcgtgttggggctgaatgtcatcttagatgcattgtgaaaggactaatattcttcattaagtttagcaggtccagcacgaggaaagtgatttggctactgaaccgagactccatgagaaaatgaagtacaatagtagagggaattaaggattgagagatatgtgcacagtacgtacgaggtggacaggacgaaggaatttcctttcgatttcttttgccgtacgtgctgcccaaccgtgagacagggatcatcagtttgagatcgcctcatttggtgcgtgtatactgcatgtaaaaaatagcagcgttgcaacgagtaagacgtttttaatcagtatattatatattccttttttagttttgggtcgaaagcccattcctttattccttttcccgttatagcccaatctgctacctccctccacacagtctgtctctcttcggcccagctcacaagtaaagccatgtgtcttgctggcacgtcttcaacctccatatataagttggtgtcgtgcccctacgatgccagagtcaattctccccaatcaaatccgccgaatatctcctagtattggtttagggtttttaatccactcaatctcatctttccatttcttccaaaatcggagctaacaaaactcgggataaaaacgttgggaagctcaccgatcgaccagccatcatcccatcaaatccggccgtatctttatcgatctactaaaattggtttaggacttttgatccactcaatctcttctttcctttttttttccaaaatcggaccgaacaaaactcgggataaaagcggttgggaagctcaccggccggccatcatcggtgagggttgaatggagattaaatccgacgaattaaaaccgaattgaaagggataaaaatggttgggaagctcaccggccggctatcatcggtgagggttgaatggagattaaatccagcgaattaaaaccgaattgaaataggaaatcatagagaaaaagatgaaggatgagtggggaatcacattttgtaatcaattagaggagtaaacttatgggaagacaagatcgacatggtggcggcgctagggttcggcccgacaaaggaaaaagatggcggcaaaaaacataaatatggcggcaaaaaatgtatggaaaaaaaccggaagagaggggaggagatagagaagagaggggatgaggtggaggaagcggggcccactgtcatgtgggtcccactattttttaatcttattatttaactgacatgtgggcccatatattttgttttattttttaaattgttaaattttgctttatatgccacgttagatgaaaaccgaacttagctatgtaggcgccatgtcagctgagaccgccgtccaaactactttgggacttattttgcaccgattttaacagttgagagacctgttatatcttgttttccaattaaaatatgaaaattggattcttcgataagttaatagacctcagatggacttattccaaaggaaaataggccaagccttctaactcaactctattcattcagcccacgtgcaaacaagattttgataggaatgagaaaacataggaataggaaaaacgcaggattttgataggaatgtaagtgtaaaatagaggattgcaaaacacaggaaaaacacaggaatggtcgtttgattgggccgcaggaaaaacgtaggaattagaggagagataaagactcaaaggaaagtttccaagaggttttaccccatgttagaattcctccaaaacttgcatggcattaggcaatccataggaatttcataggattccataagatccattcctttgattcaaagggctatgtagaaaaaattcctataggaataaaatcctctaaaatttctatgaatttcctttgaatcaaagggggcctaaatagggaaatgaggaaaataattgcaaaaataggaaactttgcacgggcagacagactagtctttttggcttgtaataagtccatttgtcatcctcatttggtcgagtttaattggcatctctcacaccgtaatatcttcgttcctcgtctggacaaaaccgttgaagtcagatgatttcactacttaaaaaataatttagacgagaccttgttaggttgtagatggaccataactacccgtatctgcaaaaatcgagcaggcatttttgcatacatcttcttaagaggatcatatgcaattaaaaaaaaagcgattttcacatgcggaccttttaaggggttgcatgcaaaaataaactcattttttacgtgcagacaacttaagaggtccgtatgggaaaatcaatctttccatatgagcctcttaacgtatgggcctcttaacgagccgtatgtgaaaatcgatttttacacaacaaaggtttctcattttaatctttgactaaaacttgtaactagtctttctccctcatactaacttaaaatgtgttgattctttttcctaaatatttctaaaatcatgttctatcatgttattgtattcttgttgctattattttggccgtcttctattgtgaatttgttttatcaattaaaaatttgaatttcaaaaaaaatggaaacttcaaataatattttgaattagtaaataatttcagttgaaaaagtcatgaacataaaagttgtagaactcatcaagatatacaacttttattttggtcatttgttcatccaacaaaatgacagtaacattgtttataaaatttgcatatctctcttatagattataaaatcatacgagagatatgtaaaatttgtgaaaattttactatcactttgtcggatgaagaaatggccaaaataaaagttatagatcttgatgagttatacaactttgttgttgatgactttttcagttgaaatcatttaatatttgaaaatgttgtttgaagttgtcatattttgaaattaaaattcaaattgttcaaacaaagtcatatagaaaaaatgaccaaaacaaaagttgtagatcttgatgtgttatacaactttgttattgataatttttacatttaaaattatttactacctgaaaaattatttgaatttcttatattttaaattcaaattttaactagtttaatcaaactcggatggagaaatgagcaattttcaaaattggtagatcttaatgagttctacaactttgtttttgataacttttcacataagttcatttagtatcataaaattcgaatattcgatttgaagttatcattttttcaaattaatttttaatgactattttcacatgcggtcctcttaaagagctgcatgtaaaactctatttttgcatgcagacatttaggtggtttgcatatagaaatgctcactcttttttctcccctcctctttctttccctcctcaccacttcaaaattttcatccttatcccctctctctctcgcacctcctcatccttaccttactttctcacctcatcctctctctcactttctctcctctcctctctctcacagcagcgggcgcggctcagcaagtggcaggtgacagtgggcggtggtggcgggagtgggcggcgggcaagcggatccgccacccccgcccttgggggtgacggcgacgcgcggatccaccgcccttgaccttaggagtggcggcggcgggcagtggcggcggcagcgggcagatccgctaccaacgccctcacgggcgacggagacgcgcagatccaccgcccccgacctcgggaacagcaatggcggtgggagtgagcagcgacggcgggcggcggattcggtggcgccgccctcaggagcggctgcagctgaggcgatggtgtggcgtgactacggcgattgtgacgtcggcggctgcggcaagctcgtggatcccgccgcctctcctccctctccctcatcttcttcgatcccgacggccagaggtcgctgggtgcgatccgtcaccgtggatccggccggctggcgatggcgatgacggaagcgatggcgacggcggcggggctagagttttttcttgtggaattttattttttttcgcgctttttcttttttgcatgcaatcggcttaagcggattttcgcatgcggttgtgcctgcccccacggaaaaactccgattttcacagaccttgtcacgcttccggctggagcaaccgcatgcgacaatcagtttcgtccgtatgtaaaaaccagttttgtagtagtgttggtttcactaacgtgtcgttttagtcagcaaaataaaactaagaacaatatggggctacatgtaagtggactttcacctctctcccccacctatcccctctcttcctcatctcccctctctctctctaccttaggagctcattggctaggagaggggtcacccgtccatgagaggcggcagcagcgatggggggttgtcaatgagggggctccggtcttccgtgacggtggaggggaagaggagggaggtgagggaggctgtgagcttgagcttgccgaccagccacgggaaggcggcggtagcagtggccagtgggcggtcgaagaggatggggtcgcggctatttgcggtggtagaggaggagaggatctggtgccccagcagcttcgtctcgcgggtgctcctacggtcttgcgcgacgctgggagtgggctcctgtgccggccatcctgtcctcacaaaaatgggaagggtcgagcagagggcgggcgcatgcagatttcgcagttgcctctctgcctttctcgtctgccgctgccgccaccacggcatctcttgtttgctgaagccatcgtcataggaaagactttaatgagaatggttgcttcatgctggctttacgcatggttaacatctagctattggaaactagatgcagaattgccaatttaattcagttcttaaatcatgcagtaattttgtttcgaatcaatcccatgcgttcaattttttttaaagttaaaagccccgtgcgttgcaacggataaaagcaactgattttttcttgcaacggataagagataaaagcaaaaattatgagtttctagtatggctagttgattaaagcataactgatagtacatgttcaaacactccaactgatttttcacaaaataaaaaggcgaatgtccagcaaaacagtgaacacaattctaattagacgcttcaaaacgcatagtggacactgataatcataatatcacttaaggttagtaatatcaacattaaacttataataatacatctaataaggatgcaacacagcatcagagtatgcacacaaaggaaaaaaaacttcattttagcaaaactagcgaaatgcacatgcacatatatctcatgaacttgcactgtagtatgtataaaaagtgtatatgatatgatggctagagatagtaacaggtacatattctcatacccacacccaaactaaatacgtccgctccaacacctacacccgatcactagtgaaattattttcccgtacccatacctgaacgggtgatgggtacccataccatacccgttgcaactaacttttacagatcgagaggctgaagggcgagacgatgatggcctgggtaaggggcagcctcgcatgcagttgtggccttgccgagcgatggcttagagtctgtttggttgggtggatgagcctggatgggagatggccgtccgaatttttgtggtgtttggttggagggcagggtggatggggcgggccagaatagggaatattctctcaatatgctggatgagtgcatccggccgatttggttggatgaagccatccagttttggtctgggtgatgtgtcctattctgattggctgtggttggtttgattttctgttaagcaagctttaaatgatttttttttctaaaccgtttatctaatttatggtttgattacaccattatatttgttacaattaaatctttaaaacaagatctcggatgattatattacgataaatatatatatatgacaaatagatcccactaacttatggcttctcccatccatactatatccctccaaccaaacaagaaattggattgccatatccatataaaccaaacaaaaaaattggatcgccatatccaacaaaatatgaatggctatatcccatccatacgtgaccgtgaaccaaacacacggtaaagatgagagacgacatatggacttattccttttcgcttcaagtgtgctatgatagcgccaggcagaactagcttctcatgggcttttcttctcgtctatcatgtggtgagagcccaactaaggaataagagcatgtttggttggatacctcagtaacatgcctgagaaaaatgtgcatctgtgtaggaagaaaaattatgatgatgttgcctggtcagacgtatgagtttcgttgtttggttgaagcctgagcctgagcaaaatagatcccataatgctacactaaataaactctgagaagatttaactcttgcaggaaataacatatactacttgctaatcatgtcctggagccgctccctggacatcaggtcaggaaggagttgaagtagtcaggtagcaaccaaacaaccaatattttttctccggcatgtctcggccgaagcaggttcacctcaaggcagcaaccaaacagcctctaagttcacttgctgtccctcaactttacattaagtctatatgacgtccataatccccaatatcagaaatatcaactcctcaactgttcaaaaccatgcaaggtaagttccttggcagtatggatgcgtggtttcgctgacgtggtattctagttagcaaaacagataaaaaaacatatgtagagaccacatgtaagtaagaagaaaatgtggagcccatctgtcatccccatcatcttcttctcctttcttccccagcatgggagagcgggggaggcagcccgacgccagcaggagaagaggtggctggcgcggccggcgggagagggaggagagggggccggccgcgccggcgagagagggggagagaggcggccatgagatggctggatgggggcaagggcagcaaagtgagtgatggtggtgggcgccgccgctgccatggcggagaggaggcgggatggggacggtagcagctaagcaaggtgaacggtggtggtggctgccgtcgctgccatggcggcaaggaggcgggatgcctggtacggtgcttccgcgtagagtgcggcaagctcaaggcgcgggcgtacacgcttggtgtcccacacagccgtcgtcctacctacgacatcaagttccactagcgagcttggactcgccagacgcctcccccggcgcctcccttccctcccaggctcactagcggctgctcctccctctctcatcggcacgtcgggctcccgccgacactgctagtcgcctctctcctgccgaagaggcagccccctctcctccctgtcccgctggcgcggccggccacctctcctctgtctcccactggccgcctcgaccacctcttctcccgccaactacctccccctctctcccatgctggggaagaaagaagatgatgatgaggctgacacgtgggccctacattttcttttcacttacatgtgctcgacatatgtttttttatttgttttgctgatgatttgctacgtcagcgaaaccacgcatccatactgccaggagacttactttgcatggtttgagcaattaagaagttgatacttcttgtcttggggattaggtatgtcatacaagactcgacgtaaagttgagcgacgataggtgaactaatgttatgaagcaagccctcatgggcctcatgggcctcgatgatggttcaatgtaaagcccccttcactctccacggcctcgtcctaggcccgccacgtgtaggcgacgtgtccctctcgagtcacgagcaacccgcggtccggtgctacgtggcgtacgcgcgtcacgtgcttactcgtgcgcgcgcggcaaccggagtagtagtacttcgtacttgtgtccgcctcgccgcgagcccacgaacgcgaccaatctccgccgccgttgagctcgagctctagtactagaccacgaccacctctgctcccatggccagctccgtcggcgacagcaccgctgcagctaacggcggcggcggcgcagcagcatcagcggcgccaccggaggctgcggggaaggggagcgccaccatatccgtcaccgtcgtcctcctcgtgctgctggtggcctccgtcgcggcgttcctgatgtcgccgcagccgggcggcggcaagccaccggtggagggagtaagcggcggcggcgacagcgacggcacccgcggcggcggcggcggcttagagggtgtcaagggcgccgagccggtcgagcaggcggtgggccccggcgccgccgccatccccggattcaacagccggctcgacgcgttccgcgcgtgggccaagctcacctggatgaagctccggcggccacactccggcgagccccggtacgcatacagccatatatcgccgaacagtcgattgatctttgtcatgttaaacttgtactggtggttctaagatttggtttgtttgtgccaaaggaggtatgatgacgacgcggggagctccggctcggcggcggacgcggccaagaggagcctggagatgaccaaagagacggtggagcaggcggcggcgtccgcggcgagagcggcggggaacgccgtggggaaggccagcgacaaggtgaagggagctgcctcgccggcgaaacgggcaccctccgacgcggagctctgagcacacaggaggacacgttgcgcaaaacaccctcatcggctcagccttcttcgcccactgtttttttttcctcgaagaaattctgccagtgttaattaactagcctctgttctatgatgtatggattgaactgaatatttgtatcctgtgaatctgatgtacatatttccactgtactatatacagtagtgtgatccgtcctgttagaatcgacggaaataaaaaatgttcaggcagagttgcagttgccgccgtcaggcctgtgttctggatcaaaactgttgctgctactgacctacttttaaccaaatgacagccaaatgaaccaatgcaggtgtgcttacttttaaccagccgagtctctgtatctctgaccagccgagtctctgtatatacagagcagagtagtccacgggggggtttggtcttgttcagtcggggcagattctcctgaacacgggcagcctccggcggttggtcggaccgtagagcacgttgatgatcaactcgtcctcctcgtcggtcagcggccacgcgaactcctcccgggggctcggagcagacgacggcgccagcggcggtgcctctgattcgggatgctgcttcggtgcagaggacagaggcggcgctctcgtcaggagggtgacggcgggggcggtggtcttcggcggccacgagaactccgtccgcttgtgctgtgccactggtgttggtggcagcggcggcggcggcggcggtggcgttggtcgctctgactctgggagggtgatggcttcgcctctcccgatgagtcccctcttcgggttgaaaccgggcggcggtccggctaaggagacggtcggggtggctctcggcggcggcgcgaagtaaggagggcttggaggaggtcgacaaatgactcctggaactggaagtggcggcggcggccggaggaggaaaggaaagcctgccggaagacctgggatcgcgccgccgcctcgaggtggaccgactcctggaagtgacggcggcgggaagggataaaaggctcccggatgacctgggatcatggcgggggtggcgctgccgcctcgcggtgcaccggctcctggggatggcagtggtggcggaaatcctctcggtgtcggcggcggcgtcgggggccgctgcatgtagaatccggggccctgcgctggtcgtctgatctgcggctccatctgtatgacaagacagcagcatgtcagagatttgctcttcagtttgataacccaggaatggaattgtgaccctgtgaaaactttagcggagacaagatatgaacatatgatgcagcaggcaaaggaattcaacatgaaaatgttcttgatgcagggaatgcactgcagtaaacatcaaaaacgtgtgctgcccaggtcgttagttagattaccagtttaccactttcgtcagtctggtagtcttccagtttccgaacttccctcatttgcaggaattagaatcgttaccagagaataacgctctatggtgtattctatacaataaaatttctttcaactcaagtaggaataatgattgagatgacaaatcccagtggaatcaggttaagacatacttaagaaactactatacagtatcaagatttttatgcaattcgtaatgccatacgagcaaacaaacaaataagataagctgttcatcatccacaagaaggattagagagcagggatttgtcaaacccaaaaaaagggctggaaacaattcactggttcactacagaaagtgtagtactgtacatctacacgaattgtcgagtgcttgtgaactgttttcaggggggattgtgtaaacaacccaagctaaagaaacatgaaacgattctaaacaaaggttaaaacagtcttctggaacagaaactttgtgaaaggaagtaataagaaaccttgtttgatctagtcaatttgaattatgcaaagagagtgctgcatacatatgtcttctgataagttcagaatgatagaaatacgatgcatttttcagggttaaacagtgaatatcatggatcatatctgaccttaattgttagatatttactgcataaaacaatagcaattttacctcataagatgttcgtttgatgggtcgcaccacacgagggtcgcccttcccatcgaaaaactgcagaataaaggtcacggtaaggggaacaaatcatcagggaaagaaaacctggaaacggatttttcgtgatcaggagaactgcatagtgtaattttcaggacaaaagcatcgaacaagatggagtgaacctatcatgactagctcttattagtaggaacttaatttcacaaaatatcaaaaatataaatctactatctggtgagtggtgaacatggccatcaaagtcactaaataatgcagtcacggttctatcttttccatcaattactgtcttgtttcgttaacaccattcagttctccagatcatgtaaccagaagcaagcatgatagagtcaatgcaagttaagttagccccctatgtctgaacacatcatgaattccccaacagcgtgaagcatcaatgcaacgggaggagaacgagaattgagagcagagggaacaaattacctggcgattgaggccgtagcggccgctggcaccagaaccagaggtggtatcgacgagcacgccgtccatgacgatcacctcgtcgtcctgcgtgggctgcctcacgggggagctgtggaagaggaggcgctgcanattcggattccgagaggcctcgtgttggacgcggcggaattcctcgagaccgaggtccaaccctcctgacggcgacgacgacgacgacccgaggatcctcccgtcgccgtcccctgcagcatcatcgaacgccggcatgaggcgggtgcccgtcgactgagccgacaagcggctccgccgcgtcctgctggaggagtcctccgacccatctccacttctatcgctgcctctgctccgtcttccgctgccgctgccgctcccgctccctctgccgcgcctgccgctgccgctgtcgttgccgggggtgacgctgctgtggcggggatccatcgctgcgcatcacaaccgggatcggagatgcggattagtaaatcgaggcttgtaggagatgatttttgaaaaataaaactgaacccaaagctggagaaacgcgaaactgaaattgcgagcacacgaaaaactgcatagctcggaaattagaatctgatcatgcgcgagcaaatctagcagaaaaaaaaaatcctacgggattagggggctcgaaaccgcaccactgcccccgatttcacggaaaaaatcacgggaaatcccaagttcgatccaccaaaatattcgaacagaacagcatcagccaccgagggggaaaaaacccatgacgaatcaaacgaaccagagcaaaatcgcagaaaacaatcgattccgaccacaccgcaacgggaaacttgcgatcggatcgccctacctccagtactccagccggcgaaaattccagaaggttcgagaagcgtgcgtgcggctgggcgtggaatggaagcggagcgggaagaggagagaagaggaggaagcgaaggaagggggaggcggtggaggaggtggaggtgggcggagacggggttaagtacgcggcggcacgtcggtttgctcaccacggcttgcttcccgtttgaaatttggaggtgcgggcctgggagggggacaaacacgctcgaacggctgggctttccttcttcggcccagaataccttcatgggcttgtcatgggggcccacatatagattaactttagctttgtcttagcagtccttgaaactgttgatcatcatcctctgaaacatagaaaagtttgaaaattgtttgttataaatgataaggctgtttggtttgatgcccaaatcaaccctattgaaattgtcaatattttgttgggaagagatgttgccagtatttgataggggtagagatatttaaagtgtgtctggtttgttgccattgctaatgttttgtgagaggaagtttctaggatgagtactgcttgctatatatacggcccagttgtacaattcatgtgtaacaaaaaacatgcaaccatataccaatcaaagaagagcacatatgcattgcggcggtttagaaccgttgatcaaattcagttgtactaagtgagttggatagtttgattgtatgcatagcaatttccttataggattatcaaaaatattattattggactattttgaccgatttttgaatattacctatttattttggtaacaaactaatcacaacgctacatgcttaggctacatataacaatgaatttatcacaggtataatagatccctgcagtgctgtttttttttatatatattgaatgttacttctactccgcttggtaaaaaaatgacgttcagtctttttttagtattttacagtacgattttggtcatattttttttattaaaataagtttatagattgagaaaatttatggtgttgtaaaagcatattaaaaagaagaacacaacatcatttttcatattttcagattgtagtttagagtcattgataatcgaagtcttaaaatttcaattaatgcatattatccaaatgtcaaatattttgtgatccctccgtttcgaaatataagcacacactttatacacaaatataagcattttttggacacaaaatccaaatcaatggaatcttgttaatttaagtcaataagatgaatgggggaattcaaaatattcaaattctagctaatcagatgtttggggggaatccaagccccaaaaaatttaagtattttttcttaaatcttaatatttgttaaataatttagaaatgcttatatttgaaaatagaggatgtatttatttcgacagaagttcttataatcaattttcatggccctctcttcaaagtaaaaaaaaaatctaaattcaactaaatgcaacattttttcaagagttttctcaatgactattttgtttttcaaacgaaccgaatcaaacgataccaagtttcatattgacatagcagaaaaaaattgcaaaaccacaactttcagaggttaatcagaaaaaggtaaaaaacacaccacctcccacaccgatagcacatatacacaaactaaggaaggaaaaagcactaatccgatcaacgctgaacatgatcggtcaccgtcaatcctaagaatgagccacaaccatattgtcgagcaccaactcgaaccagctgaacccaaactccaagaacctcgggggtcacacccttcaccatccaactgattgcagaccttctagacaacgcctctaaggaagatgcgatatttaaagcagtatcactgcacatccaaaagaacttagacatggttttcaataggggatctactagaaaaaaaaggaatgtatctcgacaatggcgcctcctagatagaatatggtatccaaaaggttgctgctattgatctggtgtgctgccatattaggctttcgcctgccaccttcctaccccctttgctcatagctctaacaccccacaaccaacaaaccgccattggcgcataaccgccgcctgtaccgacgccccaccatcgatcaaccatcgtgcgagtgcccaagcacattcacttgagttaaggtaaccccactattttttatagctatgatcatttgagttatgactgataaggagttgaaaaatgaaccaagtaacaaaataattatatatgtattattattattattagtctataaaagaaaatattgaaacatagtctaaaataattctagaatcaacttaaaactgaaattaaactttaaaattgaaattttagctatgataagttaaaggacgacgaaagatttaccccaatattcatcgtacggctcgtactgatcctatatcatccaagtgggcgggggaaccggaaggaaatggaatcatctagagcatttcggaagccgctaacccaagtatcccaccggggacgaatttacggatttgccctccaccttctccctccccctcgcggcgccgcttcttatacccttcctcctcctccggcgtcgtccccgaggtcttctaaaaaaaaccctaatccatccactccaaatcgccacgcaggaagggaggaaaggaccaccagccaccgcgcgcgcccaaatcgtcgcagctgcttccccgaggagaagaacatgaggtaaatactccgtgctgcactttagcttgttactgctggtgatggtggtggtgtcatgtggaggtgcggctgattgtgcctgggtggctgtggggtggtgatgttttagtttgttcttacatgttcttgcgattgctggtatgcttgtgttagtttggttagatcgtaggatatatgaaatcttctggaagaactttggctgttgacttgctatcagcggtggtcaattttctttggtggagcaagaaacattagagttgttgcggttttgttgggacgctaggtcctcccgaatgcttttgccctgttctcggatgcggatgcgatttcttatccttttgagtaattgatgaaacgattgtgctgttgtcctattggttaacttgtctctgttgctgtgatttggggcaatcctatggtgcgctttctggctgttttactgcgtgtgttcatgattgcaaacctgaaatgtgttcatgattgcaaacctgaaattgtgatgtggagtgcgattctgagcaaaattttatgggggattggttttgtgtgcttgcagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggttagcgcaattgatggcatatctcctctgtttcgttataatcttttgcattctaatagtattttttgtcggtttttcgcaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcgttagtccttttctgcatcccttgtgttctgtgtttggctttgtattatctagtttggcgcgaattgacagtgcacttccttcttgttgcagttggtgacttcggtgatatggacttctcggtatgagtctaccgcaatttcagctggtggtaaaggaaaatggtagtaaggattctcatgtttttctttgtgttgcagaagctgggcatgggaggtcctgatgatgatcttgaggacgatgacgaagatgacacggctgacagtgctaacaaaggtatattctccttgtcacctgtatagttaacttggagagaaagactggtactacttgcttcatgctccaagtatgttattagcacttatttcataactgaacattcttctggtattagctgtttgggccagttcgaatgctagatctttctcaactccttgaactgcttatccctttggctcagtcccctgaaactttgctgattcatgaggttcctcagagtagcctttacatcatcatttgtttttaatttgtcatgatttcatgtccatggtcattattacaacttggtgattccccgtgctttgctgcggaaattactaagcaattctcaagaaaatatctactttcttgtatatacatatatttctattagtatatgtatataaaattgattgaatgatggttggaaatagtaaatatgatatgat

SEQ ID NO: 65075 - DNA, 1277 bp, Oryza sativa
cccgattaccaatatggttttctttgagcaacaatagtaagtgtgacctgtctgtatcctgcatgtcactttctttattgaataaatgctgtaactctgactttttgcatgtaatctgtatgtttatgggcaacaacttttccaatggcattccttttgacattccacatcatgttggatgcagcatgttgattctaatgcaggactgccagtcttagcagttgattcaatgaattgccagtcttagcagttgattcaatgaattgttgttatagtctgggtcagtcaacgtaccattttgtctatgcaataccatttcaaactagactagttaaccaatgttatgtaaaactcttgtgaaacatctgatctgatttagccaacatgagcatagtaaactgaactttccagggatcttaatttctcataacaagaactctgtatattcaacttagtgaattcgccgagaggcaattaccgaactaactttatgcttctgcaatctgcagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagccattctgtgtttcatacttttactcatagcggtttggtggcatgttccatttgccttgtactttggaacttgcataattgttcgtgactgtaaaaataaactgaagtatccagcttgctcaatccatattgttactgcctgatctacatgttatacaactaatcatggagatcactgacaatttgttttctagggaattcaaaaatctcaaaactattgatgatcatgtaagcagataaccatattcttgcattgatttaacaaattgtaaggtcacaagaagatgtagatcttcacaaagatgacagaatattgctctcaggggcagtgacaacgagttcggcaaatgcaaactcctgctcccttttgcttaaactctctgttacagctgccatgaagaagctttgcccagtttcctcacaattcaatggagaagacactcctatgatggctcaaagtggtgtccattttagagactgctact

SEQ ID NO: 65076 - DNA, 2005 bp, Oryza sativa
aatttctgagcttgccctccatttcttctatcatttttcccatattaaccaggtgcccatctgccacagcaagagtcatactcatctgaaaagagaacaggtggttcaggattaggttgcttggattttccacagcttagcagagtctcctaataaaaagaagtgtcttaagaacgaatttttttattatgttactgattcaatgattgtgccacaagaaatctgcaaattgataagttatgtctttataagtgttgcttgtctttcaaaaaataagtgttgcttgtctttctaggctttctaagtttgcaattaacttgtaagtttaattctccagaacacttttgaagaattcatctatttcttactccttgcgtaggtgatcccaaaatgtgagccaatcaaacatttttatgtttgatcaccattgcacggaaaggtgtttacacttcagtttggccccataaaattaaattgttatcgctagctttattgtcaagtactcattcataatatgtatcttctgtatctaaaaaaaaaagtatcttctgtgatttttgatattatgatagaaatttgtggccgaattgtagccttgtgaccatgcaagggtctaaaattgtgagagcaaagttgctttacatccagaacgacatgtcttaagactactgatacactatagaggtacatgtgtaaagctatattgatggttcaaattgttttatttatgcacaaagtctgggttctacaaagtactgaggtagtaatacacatcaataactgtggaaaacagggatgaaagatgcccttgaactaagggcaacttaatatgacaaaaaggcggataagacaggaagggagatgttacctgccgcctgattgatcccgacaagttgaaagttccagattgcttgttatctgttgtcaatgatagcatcacagtgctgttcaagcagtaatgcgctgctccttcttcttcaggaccaacctgttaaagttacataaattttcaatgagtactacaaaacaacatagccagaaactaccagtaaaataatcagcgactgcatgaacagttttgtcttaagccacctgaatgacatgaatagcatcccatgaaccaatctgcatgtgccctctttttccttctccatctgcagccacataacaggaatactagttaaagaatttcagattatctggtcaaataaacgagatctcatcgagtgttcctacagacctttctttattaagaagcatgcaataaaactctcatcttcatcctcccaaatatacacagaagagatgccaccttcgtaatacctatttgtcaataggaaattgtactacttactttacatgcacatagcagatataatcacctgtatgctaaattgagaaataacgcaagtgcaagcaataacattattccatgctggtgcttagcattactgaatcaaagagagtatgaatcttactggtcacggtagacagagaaaacatcatttgcctcaacttcaagattcctcatctcttcggagggaactgttccatcttccaaaggaggatcgtatttgtttgaccaaggagacctgcaagccatccccacaatcaacaaatcgggagctacaatacagactgcccaacagttaacatccccccccccccaacttaagtgtccgtggtgatgagaatcataattaaatgaaagcgtttgcaggtctttgcattggttttctcgattgatgcatttgcttgttagtcaatttgtagagcgagtacaggtatagctgcaactatcactaagctgcattcctgaacaattgattatcctgtgtgcctgcctccgcgttctttgatactgcttgaagctttcggtattcataaggtggatgcttttcgcaacactcacaaagaagagataactataacagaaaccgtgagcgtatcgacggatcgctgacctgtaggagtcagcgtcacggttgtactcgcataggatgta

SEQ ID NO: 65077 - DNA, 1108 bp, Oryza sativa
ataggaattacaggtgggccccacccgtcagcgagggtggcgggcgggcccgcccgtcagcggcacgcgcgcgggaaggaggccgattgggccgcgggggagaggagagagagggagggaggtgggccgagccggcccaagaggggaagggggaaaaaaggactttttagggcttttctttttataaaaccattttaactttgtttatttcttaataattattatttgtgctctgaaaattccactaaaatttgagggctccttttagaccaaggagaatttaacaaaaattctccgggccacattcgaatttttcttgtacgtattttaatgtttgccaatttcttttcgaattttaattaattctattattccttttagaaaatgaattttatttcggaatgaatttatcaggacgtgacaaatccaccccccttacaagaatctcatccccgagattcgaggaggctagcaagaagataggttgggcggtcttctcttcttgtctgacttcttccgtcgcgtcttctataacgaacttgcctagcaaaacttctccactctggactgcttgtctcgatctcctgttgcagatggaatcttctgttcacccgacttgtccctggttgcacctttaactgactcagactaggctgtggtagttgaggatggggcttcagtcctagaacttcttatcattcatatctttggcgtcaacctcatacaagttaccaccttcatgacatgcgtcgacatcagctttgtcattactaggataccatgcttgtcatcatgagaataccatgcttgtcatttacttctaacttgccaccaactgcctcatattagctttcctggtctccgggtgcaagctacttctgctattcgatgcaagggtcggtaactttgcctttgaattatgtttctaagaagaaccaacttatcccacttgacatgctttgacgtctccccaaatgactttactgctggacttgttatggtctgatcgttatcctgccaaatctgaagcttcgttgttagatgcgattttaatctgacctccatagactatcttcgagcatatcacttggttcataactgggaatag

SEQ ID NO: 65078 - DNA, 780 bp, Oryza sativa
tgcacacaggggtgtaactatgcgttctaggctcgtggatgacttgaacgtgaaacacgtcgcagaggactacggtatcaaggccacacaaagcacagcactctggtatgcctccggccggtccgatcgaacgctccgggttggcgtacatacgacatcgacctcctgctggatcacgtatggggacgcccacccgacgaccatgggacgcacagatcactcaagatgagcgacaggggcgaggggaagccgcatggattacatctgcgcaaccggggcgaagactttatcaaagttgattccatggcactggacatagtcttttgccatgagccgggcctcgtgccagatcacggggccggtctcgttgttgtttaacttgaacacccacttgaggtcgattggacactggccggccgggagctcagtgagtatccaagggctgttctcctcaatggatttgatttcatcttgcatcgcttgccgccaatgttcatcctgctctgcttcagtgaggttcgccggctccttcgcgactgccaggtagagctcgtccgaatcgagctccaccagcgccgtcgtgtcgaggatgttcgccatgctccggtagcgacgcggcgcgccctggtcatcatcgacgtttggcgtcgagctcggcggcgacacgaactcaactgggggtgtgtcagaaggtgttgccggtgtcacagaaagcactggtgacgtggccccgacgctgggaggggggcttgcaggcgcagtgcttgaggccacctctta

SEQ ID NO: 65079 - DNA, 701 bp, Oryza sativa
tctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaata

SEQ ID NO: 65080 - DNA, 755 bp, Oryza sativa
cggcggcgagcgggcatggcgcgtcgacggcgtcgcggtggggctcgagcgtccggagcttggcggcctcggcgaaggcgccccggcggatgcggcggacgcgggcgaggaggcgctccccggggagcgcgccgtcgcagagcaggacgaaggtggagccgtccaccctgcagacgcccttccccttgaacgcgagcccctcgcatgtcagctcgagcacctcgttgcgcttcgggaagtagcccttgcggggcgggggaggcggcgaggtggtgggggtaggcgcggggggttccggggagagggcggccgcgacggcgagaaggcggcggccgcggtggtgaagcgggaggcggcggcggagcggggagaaggcggcggcggcggcggcggcggccgtggccatgagggcggcgggtggtggcgcggttcggatggagaatggacggtggagatggcgcggagggagagaaaaccgacgatgatgctggtgtcaccggtggtaaggtgctctgtccaagagggcccacttgacagaatcacagaagtcacattatggccatgaaccctgctgtttagcaaaatcattactactcggagtactaccttttgaaatggggaatcttttcaaatactccaatttggattgtttaacgtgaagattccatgaagttacttgctcaagttttggtcacgctttctagaaacccatgctccctccatctcaaaatataataatttttaactctagaatt

SEQ ID NO: 65081 - DNA, 10231 bp, Oryza sativa
tgctgatgctgaccccgcggaggccatcgtcgtcctcgcgctgcatgatgcaggagtaggcgtcgtcgctggccgcggtggtggagcgcacaaggcggcggagctccatcttggcgcggccgcggtgggccgggtcgctgctgagcagcacggccgccccgccgcaccggaagaggcactgccccagcatcatggtcctgtccttcccggcgtaccagtgcggcgccagcgactccgtcgagaccaccagcgccatcacgggccgcggcgaccgcgcgcgcatggcgttccgggcgacgtccaccgcgaccagcgtggcgctgcaccccatcccggagaggttgtacgccgcgacgtcctcgcgcatgccgtaccggcgcaccaccctggacgcgaggcagggctccgggaagaagccgctgacgttgacgacgagcacgtcaacgtcgcgggcgcggagccccgtcctggcgaggagctccggaacggcgccgtcgaagcaggcgtccatctcgtcgaccgcgtgaagctgccccgcggcgagctcctcgcggccgtcgaggaggttccgcggcacgtaggtccggtcgccaagtcccgcgcgggagatgaggcggaggaggaagcggaactccgccatcccgagccgctcgttgcgctggacaatctcgccggcgagctccgccgtcagcgtgcggtcatcctccggcttgtagcagacgtagtccaagaggtagcaccgcgtgtggcggcggcgggaggcggccgtccatgccatgtgcgccaccgcgagcgccggcggcaggaggagcacgacggcgagcaaaggcgtgagctccatcgtgttcgcatgcatgtgatgtgtgggtgcgagtgcgtttcagagccaagaggcgactggtatatataacagcgaccgttgcaacgacgaaattaattacagtttctaacttggttttcttgtttcgcagaactagtacattttacagttagcagtagcaattgacgggccaatattcgcaccacatatgaatcgcatgtttcagaaaacggatttgctgaatcttgtgcgcctgaaatgtcaaatctgcagccacattttcaacaacagcttggctattttgtgaaaaagttgcgcttgttttttcaaaaagaaaaagaaaaagataagccagagtaatctgatgttatttgtaaagatagtgaaaaggcacacattttaattattgatagccaaaaaatatcggagggtagcgataaacgggattatcggaattctattggcgatagaaaatttttttagacaaaattagttttctagtttaatatagttttcgtcggcgtgctcaatattttagtttaatatagttttcatcggcgagcccgggcggacggtggctctagccccgttggaatactaccgcttgatagtttgatttaggagtacttcttccagtttgatttacttggcgcaatcacctaagaacgaccaaaatataaaagtgttgccaaaacttgataggaggaagtcgttttccttttaacaacagagctagggctgtgttcggaagtatcggttcccaacacgcacagtacatacaaaaaacggaacggtccattagcacatgattgattgagtattagctatttcttttcaaaataaatataattttttaagcaacttttgtatagaaactttttaaaaaacacatggtttagcagtttgaaaagcacatgcgcgtggaatacgatggagtgggggttgagaaccctgggttctgaacaaagcctaagcatggctgtgaggactcttttttttctctctttctcaatcacacaaaacaaattaagtcgactaaaaacaccttttctatcctggaaactggaagaatgtctaatccaacactattgctgtttatattaacctttaccattcttactgaacttattttgtacctagaaaattaagaataggtgtctccatatccaatcaacatgtaagtcccctgtttagtaagtcccctgtttagtaaggatagtctggtttactcgatgataacacaaggttatgtacagccctgaacacggccggatccgtggcgcaatggtagcgcgtctgactccagatcagaaggttgcgtctttcgattcacgtcgggtttaataccccgatcaaatatccggattatctttttattccttcgttttgatgttcacgcgataagcgagttaatgctgatacgaacacgcctttcttttttcttcgttctgatgtcactacagtggccaagatcacctgtgacgtatctaaatcctcacctttgacggtttcgcgcatggtcagtgatcagtggtcactggtgagtccagtcaccttttacgggtggccgaccatcacagatgacacccacctctgacgagcaagttactagaaagccgttagaggtgttggtctccgctagccttatgaccagttgggaaccgtcataggtgactcatctctgacggccctttaaataaagaccgtcagaggtgatggtctccgtagatagaagctgtcacaggtgatctacatgcaacggccccgaaagtaaaggcccgtcacagataggtcacctctgacgggcctttatttgcgagtccatcacaggtgaggtaaccattgacggattttggttccgacccgtcactgattgacccatcgacaacgaaacaacgatactttgaacttcaagtaatctagctccaatattttctcaactctgccatagtattgatcatgccgatcaccgtcactagcagcctcgatgcgtaacccactgttctgcactgtgtatttgctgtcttgctttaccgtgtgaaaggtgtatccatttatgtcatatccttgccaggtggtggcactccattcaggaccctatgacaaccactgaagtgtttcactagacaagttctgcaacctggcaattcggttattcagccactcgttgaaagaagacatgtgcttgtttctgacccaactctttaatcggcctaggatctcctatcggagaactaaaaggtgttcgtcaacgtacggcaccatctcagtcataagctgcagtaccttgaaatgtgctttatcatataccttccgatccaacctaacaatcttccttccaatagtaccaacaccatcaagcctcccttcgtgatgagatcgtggtaatccaattgaaaatgtttctgacatgtagtccacacaaaaattgatgacctctttggtggtgtaactctcgatgatactcccctcggggtgtgaacggttccgtacataacccttaaggatccccaggtacctttcgcaaggatacatctgcgtcatgaaaactggaccacaacactttgtttgcctcacaaggtgcacggaaagatgttcatctagtcccacaggaaagctggaccacaatttctgcctgtagttcatccagtccctcggaatcaatgatcttttggccgattgcatggaagaaggagcacaaccgctggatcgtgtgtcgcacgcacaaccgctggatcgtgtgtcgcacgcacaaccgctggatcgtgtgtcgcaccttaggaggcaaaatattctttattgcaacgagcaacagctgtgttgtaacaacgtagcaatcatgcgacttcattcctaccaatttaaggtcttgcagtgaaacgaacctactaattcttgatgagtaaccagatggaacctttataccactcaaacatgttagcaaatcaatcttctcttctttcgagagagtgtagcaggctggaggaaggtacaccctgccggattccttggttatgggatgtagttccgagtgaacacctatgtcttccagatctcgtcgggcgttgagaccatccttggtagtacctgggttaagcagtaatcccattaaactcttacatacattcttctcgacatgcatcaaatctatgccgtggcgaacttcaagatccttccagcatggtagtctccaaaatattgacttttttttccacatgctcttctattttgtcttttgtttttccacatgctcttctgttttgtccttcgacatgctcttgtcttttgtttttccaactttcctcttttttccaaactcgttggttattcccatcactaagttgtgcacctctgtccctgttagctctgccgggggtccgactgtatctttgtgtccattgaaattctttctcatattcctatacgggtgataccttgggagaaatctcctgtgacccatgtagaccatcttgtgtgaatgcttcaaccatttgcttcttgtttccttcatacactccaaacacacccatttccctttcacagtttggccagaaaggttgccaagggccggataatcgttgatggtacaaaacagcatcgcatggaggttgaaatactcttgtgcatatgcgtcccatgttcgtgtgccctcatttcatagcctttcaaagtcatcgattattggtttaaggaacacatcgatatcgttgccaggttgtctcggtccttgaatgagcatggcaagcataatatactttcttttgaagcacaacgagttagtaaggttatagttaacaagcagaactggccatgtactgtgacgactgctcaaatcaccaaatgtattaatgccgtccgaacacattgcgaaacgcatgtttcttgggtcatttgagaattcctggtaaatcctatcgattgtcctccattgtactgaatctgctgggtgcctcaacattctatcgactttccgttcttcggcataccagcgcactagctttgcttgttccttattcgcaaacattatctccatgcgcttcgcaattgggagataccacaccacctttgcggggcctcccctctttgacttacttccttcaccttcactctttgctcgtttgtatctagatgccccatagacagagcagacatccaagtcagcatattccttgtaatacaaaatgcagtcgttcggacaagcatgaattcttctgacctccaggcccaacggacataatacttgcttcgcttcatatgtcatctgcggtaaattgttcccctcttgcaacaggtcctttaacagctcaagaagttctgtaaaactcttgtcggactagccattactagccttaagcttcatgagttccaacacgcatgacaacttgttgtgcttcgacttgcatccatcatacaatggcatctgacaatcttccatcaacttactaaacttctcaaaatctctgtcgttgtcctctgcgtcttcaatgtcatgcaacattgtagatagaaattgagtgtccaaatctatggtctctccacctaatggagaaggtacgaacatgccttctcgagctgcggcggtgttctctacatcctgatccaacacttcttcagccgtggcatcaggcgcctcttgctctccatgcttggtccagcagatatatttcttcatgaatccattcgttatcaaatgagaatacacttctgagctatcaaggatcatcttttcattcttacagtccctacatggacacaatatgtacatgctcatcctactttttctgtcattctccgcaaatgtgacaaattcattgaccccctctctatactctatggacgaacgatgaacatggtacatccaactacgatccatttgaaatcaacaacataggaagaaaaatatatgatgatcgatatattgagaatgaagggaagaataatatgttttttaccttgaattttagcaaaaattcgccccccttgcccttccaaccgatttgtgaatagtgaactactcgggatggaaagcagttggcggtttggggggtatttatagacccaacacacctcaaacgggttaggtaaaaaaaagcccatcaaatgtattggtcatacctttgacaggcttcaattgagttgcccgtcactggtatcccttcacttgtgacgggccgggaaacaaagtcgtcacaggtggcggcccatcacctgtgacggcttataatgcctcggcccatcacatgtgaggggataccagtgacgggttggaagcaaaactcgtcactgactcacctgtgacggattttcctttcggcccgtcacaggtgaggggatacctgtgatgggccacggccggatgcctcaccgttgacggcatcccttattacccttcataggtgacggtcactagtgaccaaatcgtttgcccgtcacaggtatcccgtcagaagtgtgagaatctggcgtagtgtgagccaagtagccgtcttttctttcgttctaattttttcatgttcacgtactcccgcatggcgtccaacacaagaggagagcggcgaggaatggcgtgacacgtcgtcgaaggggagaagtgcagggacgcacagtgcagtccaccaaagcgagggaggggagggagagatcagcggcgcgaacagatctccgagcaggtcaccggtgctgcaggtgcagcaatgcgtgcaaccaactgatgaagagacgagggcaacctgtggtagctgtggatatctgctgttgtttctctctgttgttctttcatccggccggtacatctcctggaccgtttgatttgaaccggtacctcgagtacttacctcaagttactgcttcaaggatgataaaaaaactcattgatttagaaaaacgatctcttttttatttctttcccgccgaatcacgtacaaaggccgatctcctctcacgtccttaagtgctatgcagcacagcataggagactcttttgggaactaaaactctccgtcaaaaacataaaaccgattctatctacaattctaacaatggtataaaaaagacaagtcttcctcgtactttggtcataattttttgaatacctgccatgaaagaaggctataagcactatccttctcctccatccctatcgctggcagccttctccatgaaagaaggctacaagctcccgtcatcgtcatcgccaggatgactcgggaggagcctgtggaaaaattgggcgctgacacttttaaactgttgtttctcttaaattatttttccaaatcatgattcaattgcaccattaaattcgttgcaattaaatctttaaaacaatttcatacatggatatattccgatgaaaagttttttttaacttactattgaattatgtttaaatgttgcacgatgttccaccaagtatatcggaattgtttcactaagtagatcgaaaatgtttcaatcatttaaatcggacgttgtttcacctaatataataacaatgtttcagcaaataatgaaagaatgttccagttcattgcgacatttgattcatacatagtgaaacattataagtgcactaggttaatcttttttggtggaacaaaaaatgaaacgaattcccttaatagagggtttatgtgtgtgatttgttgcaaaaaatgtttcaattcactgcaacattagatctatatatagtgaaacattgtgagtacactaggtgaaacatttttggtggaataaaaaatgaaacgaattctattaatagagggtttccaaaatatgttggtgatttgttagcggtgttgtcacagaagaaacattgctctcctgcttcggcaccggcaacattagtggtggggagttcaaactcaaagccatggccgttggtggagaaagattttctcgcgacggacatggtgttgtacggctgtatatatcggtcgaggctatccgtgttcgaggcaatctgcccatcagttgaaaactcgagaacactttaatcatcactttttttattcgcctttttccctaatatattagtagtgcaaataaatagaagttcatcgattgctagctttccatatataacttcgtatcagtatgattagaaatacatattagcatggacatgaaattagaaaaaaaaggatgggtatggattaatggataaatatatgtataggcgtgaacatcagagtggaaaaaaaaggtgtattcgaatcggcatgaacagaacatcagaaggaaaaaaaatgcgtattcctatcggcatgaacagaaatacgcttatcgatgtgaatataaggtaattaggaaataaaaataatacggacattggatcggggtattgaacccgacgtgaatcgaacacgcaaccttctgatctggagtcagacgcgctaccattgcgccacggatccgtttgtgttccaaacagcacataatgttatctgttttaacagttatcagatggctaattttaggtacaaaataagttcagtaagaacgtaaacagcaatagtgttggatcagtccttcttccagtttccaggatagaaaaggtgtttctggtcgacttggttttgtgtgattgagaaaaggagagaaaaaaatatactaccttcggagtcttcactgccctgcttagctctgttgttaaaaggaaagcgacttcttcctatcaaattttggcaacacttaaatatgtgttgttatagaagctagggaaattttgatcgttctcaggtgattggctcaatatgtgtgcgttgatcaaaagtgccaagtaaatcaagcaggaagaagtataaccagagtatcaaacggcagtactccagcaggggtggagctaccgcccgcgcggctccattaaattttaatattaatttttttgtcaaataaattgataagaattttacagcaaatattagttatagtaatttcaggctcaaaaatctttctaacttcgtcacggtacttcagtatattaccgaagaacttcatgatccaaacataaagactaaggctccgatcgtttccacttaaaaagtggattaagttttggatattcatggtacgttttttaaacggctaaactgtgtgttttgtgcaaaaattttctatataaaagttgttctaaaatatcatattaatctatttttcaagtttacaataattaaaactcaattaatcacatgttattaccaccccgttttgcataaaatacttaatctttatcttcaggagattcaaacaccacctaaagagggtgaggtaaaaacctaatctttttcatacttctggcttgtgaaaatctctataagtgaaagtataagtgaaaggtaaaactcaaaataaagcatcgttgaaccacgtcattagagaagcacgagccgtcggatgcaacagaaatacaatatgaaccgttggatcataaaaaaaccgttgtgaaaaaaatggtgaaaggttaaattcttcgggaatattcgacacgttctctagcgtaaaaagttaaattcttcgtgagtctccaacacttctccaggatatacaaagaaacacgagtcgggagagaaaggaacagagtggagattaagaaacgaaataaataatatgggagaattctacgctgtgtagctctcctcctccaactccaactccagccggggctgcgttccagaccaccagcccggcccggtaagaaacgatcagaacaccagagaaacacgataatggagttcggaaggtggttgacatatccggcgcttcactgtccaccaccaccaccaccacctgatgggaatggggaagcacggcagaggtaccttcctgcttcctccgccgtatccccaccagggttggaaatttcagatttcgttcacctccgttacgatattattttgaccgaaattttttattttttcattcatttgggtaatatttgttcaaatttaactaaattttacttaaaatttcggaccaaaattttcgaaatttcggtgaccccgatataaaggcctcaaccgatagagtgaacccttatccccaccgtaaccaccgtctccaaatcaagtagaccagagcatcgccatgaccagatcggtatctactacatcttgtccctcctcctgcaggtagccggagacgccaccgtgatcccagacacatcggtgggggaacgggcatagctcggcactccatggcacgctgctagaggccccgaacaggacagtcacgccgcctgcatctttgctgttctcaacggtgtggcgcgcacctccctctggcttcctccatgctagccgcacagatctgggttgcttctgctactgcggccatatcacagggagaaagtttttgagtgagcagcagcaccgtgtgagagctgattgagaaagaaatagataagggagtgag

SEQ ID NO: 65082 - DNA, 1600 bp, Oryza sativa
atcatggatggattaagtgagctttaaactattttttctcataaaatatttatccaaatcatgatccaattgcaccattaaatccgttgcaattaaatctttaaaacaagaccacacatgaatataacccgatgaaaaaaaagcttattattgaattgtttataaatgttgcatgatgttgcgccaagtatatcggaattgtttcactaggtagatcaaaaatgtttcatcggacgttgtttcaccttatatgaaaataatgtttcagcgaatagcgaaaggatgattcaattcactgcaacatttgatccatacatagtgaacgttacgagtacactaggtgaaacattttaaattgataaaaaaaaatcagatggtcaaatgttgcagttgaccaataagtgaaaaattaagttacatatggtgaaacaaaaaaatagcaactggaacatttaaatattttatgaaacatggtgaagatacacgttgaaacatgtcgctgatacatttgaaacaataagtattaacagactgaaacatatgcttttcttttatcaaaatataatcatacgatatcttgttgtaaagatttaattacaacgaatacaacggtgtgatcggatcatagattgaataagtaatttaagagaaaaatcattttaaagcttgctaaaatacatgcatatatgtatgaatgaggtggagagagagtagtagcaggtagtttcagaaattttgtgaaacacactgaagacgcacattgaaacatatccctatcacatatgaaacatttagttttagcggtttgaaacacatgtttttcttttgacataatataatcatatgataacttgttgtaatgatttaattacaacgaatacaacggtatgatcggttcgtagatcggataagtaatttaggaggaaaaatatttaaagagaggtggaaagaatgaaaagaaacagctaggcatgcatgttacggtaacatggttcgtccgattcatccggctgtcgatttgcagcatttttctgacgtcaacagagagaaaggagaaattagtaagtaaggagtgagctggtcgtagggtctaatattttttatctgatcggatgttcgaagagaagcattttcaaatttttaatcctactccagtaaataaaagtagcggggtgtcgctctacaggtaaatcatgtatgttagttgaggctgtgtttagttctacaccaaaattggaagtttgaagaaattggaatgatgtgagacggaaaaattgaaagtttgtgtgtgtagaaaagttcgatgtgacggaaaagttgaaagtttgaaaaaaaaagtaggaatctaaacagggcctgagttgaattgggagtgccagagtatacaattggcaaagaaaagaagtttacgctgcaccgcatctaccaaattaaaatatcctaaatttttgttttacctaactaaactaaaattgcctgctaatttcattctcaccattgacttttcaatttttattaatcgcaatttttcatttatgttattactaatttgaactaattatagttgttactgggaaactacagtcgcgcaaatgtgcga

SEQ ID NO: 65083 - DNA, 6621 bp, Oryza sativa
tgagaatattgcactaaaaatttaaattttgtttggcgcgcagctgatggggcgtggctaggggtgggcagaaaaagaccgaaccgaaaagattgagaccaagaccaaaaaaatcgagattgagaaattcagtactaggcagtgaaagaccgaattttgttcggtcaattcggttattctcctcgggtaactggatagaccgaaaagaccgaattatcaaaaaatgtctaaatacaacctacaatccactatatttaataggattaaactctaatttttatatcctacttgttctaggcatgcaacctaataagagtctttattcataagggcttacgaatttttttaggattttctgttgaaaatttccattatttctttgcatatatgaaaatgtcgttgaatttcggtcaggaccgagaccgagaccgaaaaaacctagatcgaatttgtcggtcctgatatttttacgctgaaattcgatcttcacttttcaaagaccgaaaaagctgaaattcgatcttcacttttcaaagaccgaaaaaaccgaaagatcgaagaccgagaccgaaattttcagttagaccgaatgcccacccctaggcgtggcgctgtggtctttatctatgttttcaccatctagtgtaaactttacaaataacttattcccctgcttaatataaacaccagattaatttggcttgtcttgttttttaaaaaaagggcccaactttttttttttcacaaaatagccaagctgttgttaaaaacgtggctgcagatttgacatttcaggcgcacaagattcagcaaatccgttttctgaaacatgtgattcatatgtggtgcgaatattggcccgtcaattgcatctcctagctgtaaaatgtacttagaccattcccaaaccagatattagacataattttcataatctctacatcataaaaaaaaacttatactagatactactattacaatgcaaacaacactatttcatatttaaatttaatgctacttatctcacatgatgtcttggatattgtgtagaaaccgtgtttcatgcaagacatgttttcttctatttcattatttattcacttgccacattatttttcattttagttggcagcttatttaatgctatagacaccattctagtcattgggttgggaatgatctttgtactccctctgtcccattttaagtacagtcatgattttccgtgcacaactttaaccgtccgtcttatttgatttgttttttaaaaaattaaaaatataagttaagtataaagtactaattataaaaatattttaaataagatagaagattaaaattaaacataaaaaacttatagttacacctagattgggattactagtcttgtgaaacaagaaaattaagttagaaactgtaattaatttcgttgctgcgacggtcgctggtatatattaccagcctgtggtctctctagctcatgcatgcatgcgaacactatggagctcacgcctttgctcgccgtcgtgctcttcctcccgccgccactcgcggtggcgcacatggcatggacggccgcctcccgccgccgcggcatgcggtgctacctcctggactacgtctgctacaagccggcggatgacctcacgctgacgacggagctggcatgcgcgattgtccagcgcaacgagcggcttgggataccggagtttcgcttcctcgtccgcctcatctcccgcacgggactcggcgaccggacctacgcgccgcggaacctcctcgacggccgcgaggagctcgccgcccagagggattcggtcgacgagatggacgcctgcttcgacggcgccgtcccggagctcctcgccaggacggggctccgggcccgcgacgtcgacgtgctcgtcgtcaacgtcaatggcttcttcccggagccctgcctcgcgtccagggtggtgcgccggtacggcatgcgcgaggacgtcgcggcgtacaacctctccgggatggggtgcagcgccacgctggtcgcggtggacgtcggccggaacgccatgcgcgctcggtcgccgcggcccgtggtggcgctggtggtatcgacggagtcgctggcgccgcactggtacgccgggaaggagaggaccatgatgctggcacagtgcctgttccggtgcggcggggcagccgtgctgctcagcaacgacccggcccaccgcggccgcgccaagatggagctccgccgcttgtgcgctccaccaccgcggccagcgacgacgcctactcctgcatcatgcagcgcgaggacgacgatggcctccgcggggtcagcatcagcaaggccctccccaaggccgcgctccgcgcgttcgccgccaacctgcagcgcctcctgccgcgcgtcctcccggccatggaaatcgcccggctcgccgccgacctggcatggcagaatctgttgcagcgccgccgccaccgagggcagaccaagctgaagatcaacctcaaggcaggggtggaccacatctgcctccacgccggcggggtggcggtgatcgacgcggtgaagaagagtttcgggctggaggagcgagacgtcgagccgttgaggatgacgttgcacaggtgggggaacacgtcggcgagcagcgtgtggtacgtgctgtcgtacatggaggcgaaggggaggttgaggcgaggcgacaaggtgctgatggtgacgttcgggtcggggttcaagtgcaacagctgcgtgtgggaggtggccggcgacatggccgacaagggcgcgtgggccgactgcatcgacgcgtacccaccggagagcaagcccagcccgttcttggagaagttcgcttggatcaacgacgaagcagccgatgaatcctcctcgccgttctagaggacgtgagacgcattaattggcagtaggagtaaagcgcaacccgcctcgagtatagtttcgctataaaagctcacaaacaatatattccaagataataagggtgtgtttagatcacaccaaacttcccccaaactctaaacttttcatcacatcaaaaacttttctactcacataaactcccaactttttttccaaactaccaactttctccaaacttatccctaaacttcggaactaaacacagcctaacttggagaagcaagctttgcccaaaaagccagcttgcaggggaagcaattttacagtggaaacctctgtcacagcctgattttccgtttcaggatttataaattatttaataaattattaatagaatttatattaaatgttcattaatttacaagtgaagttaaatgtgggaaataaaatttcctaaatttagagcatggatggatttaatttttattaaattctccatgattaattatactctctgaaattttctcggatttttcagagctcaattcctaaatgatacaaagaacagctcagtaattagttaatcaattaatgatctaattataattatgttaagtgcttttcttgtttaaaaatccttaaattataaattgttgtttaaaagaaattattagaaataatcttaaaagcctaaaagagaagatctaattttaatttaataaatctcaatataaaagtgagatagataaaattttgttaaatacttcttttgtttctatagtttctagatttttctaggatttatttgagcaaaggaagcatttttaataaacggaatatcatttcatgaataatttaaatagaaaaatgtttttaaatccttcttttggatttgggccgaaagtcggcccaagtctctcccttcccctcggcctgctcacgcccgacccaagccggcccagtccgccaccccagccttgccgcgcgccgccgatctccttccaaaatccggccgcccctatccttctccgatcaaattgatagaggggaaatgatcctcgggatctcctcttccttttcttttttggaaactttggctaatttcgtttggaaactgacggatttgagctcgattcggatcgatttttctcccttcaaccctagctttccatctccttgccaccgccgtgggcctagccgctgccccctagcccctataaaaggacccccgggacctcctcttttcgccgccaccttcgccctagcctgccaccttctctagcgtcgccttcgcgtggttctttgcgtcgctgccgccggcgggtgtccagtcgggcgccgccatcgcttcggtcgtcgccgtcagtcgccgtctccttcatcagtatcgcgaggtcgccgccgtcctcgtcccgtcctccgtttccgccgcagatcaccggagcgccgccgacaccatcgacccgaagctctcaccgtcgacgtcggtccagccacgccgcaccgccgttgcagccgccgccttcggttgccgttgccaccatcgggttcgcgaggaggagaagaacctcggccagccctccgttgccgctgtttcccgccggagcaccaccgtcatcgccgacccgaagaccgccgccgcctcgacctcgccgctgtcgtcatccgtcgtcgtttgccgtcgtccaagtgctcggtgagttcgccgcgtcgccctctacccgttggtgccctccgtttgcgccgcctcgccgccgttcaccgtcgagcatggtgccgagccgccggcgatgacatcatcactgatgtcagcgctttgtcagccgtagacccgtggtagtccggatcgatctcggtcgtccgattcggtcaattttaggtcaattagatcttgggcgttggatccgtggaccgcttctgtgaacccggtttaccgtggactgtccttgatgacgcaaaaatctcttttccttttaaaaataatactttattgcgtcataattcaattaaaatctatataaatgctttaattcggtttaatgtttaaaaattcataactaattcattgcaactcggtttaatgtggttcaagttgcaaaagttgtagaaaataaagatctatatagtaaaattatccataaattgtgttaaatttatttaatcctttaattaggtttaatcttgtaaaattggtaattaattcatatgaagtcagaatgaggccgttcaagtctcataattcatctaaaatcatgatctacatgtttgtttactttatatgtattgtttatttggagtttcttagtatttttcctcgttttgcgtgttagcttgtcgtttccgtcgtttcgaaggttcgcaagtgcgccggaagtgttcaagaagattaattgaagaccgaatgttgcaaggcaagtcacacagatcccaaacacaattcctttgagcatgttgatcctatatttaaattctctatttatttcaactgtacatttattttcgaatgtcaccgggtggtgtgaacccctattccctttgttatggccaatttgcattgattaccctatttcttgattacctcgggttataatttgactagttggatttatatattggttcaactagatgtattagatctaattgcttagccatgcttagaaacattagcacactattgggataactaatgtttcaccattacttaatgatgtacatggtaaaggtagctcacgatggtcaatcgtgattggttaattaattaatgtgccaactaaaacttgataatggtgggttgtgagcacatggttttgatggtcgtgctcataacaattaaggaccggttcacgagtttcggttgtgaaacattaaccgtgccaaccacaagccagagtgggcaacggctggacactttgtatagcaagactcattgtggtgtgccagactgagaagtggcggagataagcccacgggggtcgttggggagtctatgccttgttttatatgggggtgattatgatccaggaacggtgtattactttgagttgagttatgcgaggggtcttgtcacaatcactcgccatggtgacgtgtctgcgcggacacagtgacatgacagtgggttgtgtcttgtgggtacagtggtacatctctggccagagtaaaactattcgaatagccgtgcccgcggttatgggcgggtctaacaatgtctttcgtgattagtcccacaccactcattaataataatgtgataattgatggcaattaatttagctcctagtttggaatggtacattcctggtttggagatagatctgtacagccgggtatagttgttcaggatggttgggcctgtgcagcatgggtgtgttgttcagcgttgattaatattgatgattaattactctactgttttacaattattaactgtttgctaaatgttgcttttgcaaatgagccctatattatgctatcctttggtatccttgtgcacttgcatatttgctgtgtggcttgctgagtatgtcatatgctcaccttgtaataatcaatcaaacctcagttgaagttaagttgcgaaggagaagacgtttgacttataccccagttgagctacctgtgggagtggagccagagcttcgctagaccgttattccgctgctgttttcttttcatttgtaagtatgtaacgttgtattattgatgaatctgtatattaaattgtcagtttgtgtacctcg

SEQ ID NO: 65084 - DNA, 3320 bp, Oryza sativa
accccgaggtccaatacggtgacaaacactctccgacacctcctatcttccttcttgtagcttgttctcaaatcagaagaaataaagcttccactctcgcccatattttttgtgtttgcctgcttgtgtgctgatgagtagaatagaccgatttctcaacgtcatgagcatgagtctctaccgaccaaaataggtaaacatgtgagaaaatcagtttgttttgatcattttgttctttacatgcaaatcatcattctgctatagttgaaataagcataagaacatcatgataattgaagtaccatcctccgacattatcttagcaattaatacccagtggtggagctggagaggaattgaggggggtgcaccactttgttgtgcataaagcgggataaaaataatacttaagcaaatgaccatataacgagggattgcaatttcggtaattttggacacctcagcaagtgattatctcggccaaaatttttgtttttctcaaaattttatgaagttgattaaaatttagtcaaattcagttaaattatgttaaaatatgccaaaaatcctgaaatttcggtaaaaccaaaatgagtgaaattttagccgaaatcgaaatcgaaaaccctgcatataacacgaacaatttaactgttcataattacagcaccaaataagaagcaataacaaaatgcttaccaaaatatagcgaaagaagttaatatcatatacactcaaatcatcagcccacctgagtatacttaaatcacctacagcataaaagtgagtaaaatcatcaaaatttgcaactgaataaccgtcaaaaaataatttaatgttagatgcattttcctttctcgttgattagggtggtacttgtgaacatattattggtattttgtggtgatttgcttttgagaaatttctccaatacatccgcctgtcatttatagccatgatgcaaaaggagaatagcgatataataaagtcatagccccaaatatgttaatagtgctgtacagttttgcttcaaactgacaaatcctaaccctacaacctagaaaattaataacaacaaaataatttcaaatcttctattctaatttcactaaattcgcttgcaaagatcagattaattaatttatagaaaaaaaaatagagctgaggaaacaagacacaagaaaatttttgaggtcttgcctgttgcgctcaagatcttgaagggaaagaaacatgggtggaattaaatggcgtggcagctagcgagagagacggtcttgggcacagccagaagatgaaccactccggtggcgaaactcatggccggaggtgtccacaccagttcaccgagaggagagaaggaaaggggaaaaagatgcgaacaagaaccacttgccgtcgtgcggcatctgaaacgataaaaaggaaaccctccatccaggcgtgcaaacatttgctcttcctaaactctatgggcctgatctatttagaacgtcgttcatgggccagtaatgtcttcgttgttgttttgggctgatcgggggtacaccaactaggctcgaggggggtgcacatattgtcaaggtagggtggtaagcactaattttgtctttcggcccgggtgcctgggaaccccctctggcccattgggctccgcccctgttaatacccgataacatgaaggcggctctaacactattatcgtccaaaggcttgagatgatacatcctctcagtacttctcgataacacgatggcagctctaccaccgttattgttcaaatgctagagacgatatagatgcttgaagcactggcatggcaacttattggacggctctgctgccgttgccaccaaataacggaggcaaacaaaccttctgcatggccctgaagtgttgttatggatgtccttcgattctataggcatcactcatgtgggcccttgatgtcactaaggtcagctctgctgccaaggatcatgggcaaatagtatggaagtgttgcctggtactattcatttttaaaattttgcacaatatgcatggagtttgtgctcatgtatgctcctcattttgtgttatatgcttactatactgtttgcatgatcttttgtaacattttattttaattttataaaattaattgccaagcatgaaattaattttctagcatgattgataatctctaatcaagcaatatgtaatcttgaagattacttaaggtaatttgcttggaaagtttccatggaaaattatgtggtaatcctgaagattacacacactagtaattctgaagattacgcatgaccaaatttatgttgaccctgcacattgtatttacatgttgtaaataccaaatgatgtcgcagacatgtcagacatagtgaaaagtaattcgccacgcttaccttggatgacataactacctcacttgggcattggatgttgagattgaccacaactctatgggtctcggtcatactattatgttgcccgaggctggcacaaagtagcctaggaaggccattgcatttcttgcgccaccatctccaccaagaccggaagtctgagtatatgaccgagaaagatccattggtattatggcaatccatgaatgatcatttcgactagcaaggatcaattgtgccccaaaggcacaacatgactggatcaccctacgcttccaagactacaagtctatagtagcatataactctacatttatgtgaccagaagttcactgacgctaagatgatcgagaaaaccttatccaccttccacctaggggcagatctacagtagtatgagcggtgtcaggcaacatcaacgactttcagcaaaacctatagcaaaactgcttattcatatgttataacactatgacctaagcataattaacatactatatgacactaatagacacgttatgacaccaacgagtcgattttctggatccgccactgcttccaccccaacaacatggagttgcaataacaatataggaactcaaagtactctatgtactctgagcttatcttagtactacttcttagtattgctagttgtagaaatgtagaatgaggttcttttaatgaatcattccactcgacctactgggtctatggcagtgtctgaagtacaagccaatgatgatggggggacttaggtgaacgaatggggccacattgagaagagatgcagggtaagggaagtatcatgtccaagggtaagagtaagggtaagtcctaaggtaacgacgaactcaagaaggttataggtgacacatctgggggaaagcaggataactgctacagatgtgg

SEQ ID NO: 65085 - DNA, 10824 bp, Oryza sativa
atgacatgcttatcgatgctaaggatggtgcagacgtccatatggacgatgatgaggacaaaccttcttgaagaagagaatggcatatttaaggacctgaagtaatctcctatatgtctcttatatgtgccctacatgcgcagaacatgtagaacttagtcatgaataatgctcctaaagagcatgctaatacaatattaagaaaaactagatattttcataccttaactaagaaaactaaaaatattgtgaccattgcaggaagcaatgctcatatagtaggcactgtaagttctaatctagttctccctatggatactctagttcaaagcgtaccctcttaagctataatgatatctgtgcaaacgatttccatatagaaaccgaggttgagcaagatgttgaatatcttctcatatccaaaatagatggatatcaaaagcaagtcgtgtaaagactcccttcatcgccatcgggttttgaactacacgtacataaaacccactaaagaatatgatgaaaacaatattttgaaacccaaagttatttaaaatttggcatgacgggttgggtcatcctaggttgggtatgatgagaagaatcatcaacaattttgctggccacattgttgaaactagagacttccctaatcctgaagattttatttgctttgcttgtgaaaaaggaagttgatcactagaccatccctcctgaagattagggatgagtcaccttttcctggtaaggatacaaggtgacatatgtggacctatctagcccctgtcgggacagtttaggtattttatggttcatatgtatgcttcttctaggtggagccatgtggtcttgttgtccataggaaccatgctttttcaaaactaattacgcaaatcatcatgctagaagctagcttccctaataaccgcgtacaatccatttggatggataatactggtgggttgaggtcaaaggctttcgatgattattgttttgccatgagtattaaggtagaatattataccgcatgttcacactcaaaatggtctagctgagtcctgttggtaattcttatggtcgcagataaaatccgcaagacaataccgactaactcaagtagtaccagccaaaccgaacccctttttttttccaaaaaatcagaccggttttcttttacttagtcaagaacctgtcaacgcgtcaggaatccagatcaatccgctttccttgctccttctgcttgcctcttatcctcggctcgactgacgccgccgcccagtgcctaccatgccgctcttccttgctgaccagccggcctttagagctactccacctcaccacctcctccatgctgccaccaaagacgctttagtcttgatgccgccacagtcctggaggaccgccacgcaaaggtgtagagctcccgctacactgcctaaactcaggaccttgccagtgagggtcgcagctgccatgggcttcccaccatgcagtgaggatgttgatgaccacgggctgactctgacacagaagctgatgccatccctagctgttggaacccgccacctccacgacctggagatggccgcgccaaccctctccactacctacaccaccacttgccgaagccgtgcactgctacccgagctcgtcgcctacaaatcgaacgcactcggagaaaatcaggttcaactctctccctttgtcacgcccgaaatttctatccaaaactccaaacgcttacatgtgtgtaaaccctcatccagaaattagccaaggcacacaataacaaattgataatagagtgcaaatatttatctaattaataggcgaatataaagtcactacacaggtagatagttcctctcaaacaaaaagatctaagcagcggaaattaaaataaaatagcgtagacgactccatcccacaagcagcttgaccaaggctacgcctaatcctccacaccatcagcatcactgtagaactcctcctctgatgaatgattgcaaggtgagtatatgacatactcaacaagccacacagcaaatatgcaagtgtaggggataacaaaggatggataatagtctcatttgcataaatggcatttaataaatacttcagaatttagaaaaatagtaaagtatttcattaaataatattaatccaacgctatacagcatacccgttgcatagacccaaccattctgaacaaccattcccggctgtatagttctatctccaaaccaggaatataccattccaaaccagaagctaaacaagttattaccaattacagcatcatttattatggtgagaggtccgagactaatcatgaaagacattgttagacccgcccataaccacgggcacggctatttgaatagttttactcttgccagagttgtaccactatacccacaagacacaacctcaacatcatgtcaactatgcatcgcgtacttaacaagtacccgaatagagattgtgacaataccctccgcataacacaattcaaagcagtgcaccatttctggatcataatcacccccttataaaacaaggcatggactctccagcgacccccgtgggcttatctccgccacttctcagtctggtgccccacaatgaaccacactatacaaaaggtaaagctgttgcccacgctggcttgtggttggcacggttaatgtttcacaaccgaaaatcgtgaaccggtccttaattgtcatgagcacgactatcaaaaccatgtgctcacaacccaccattatcatgttttagttggcattttaattaaccatcctatcatgattaaccatcatgagctaccattaatccatcattaagtaatagtgaagcattaattatcccattcatatgagctagtgtctctaagcatggctaagcatcctaattaatttagctaaaaccatataatgttccagctaatccaattattaaccaggtgacaaagtataggtaatcaataacaaagggcgataacaaaggcaataggttgcttccacccggtgacattaaaaaataaatgcaatagttgaatagaaacaatagctttaaacgggatcaacatgctcaaaggggtatttaggatctgtgtgacttgtcttgctggccttggaactcttcaaagtcttctcctgcaaaatcggactctccgaaaacgtcagaatctaagtataaaagagaaaaaaatcaccaaaacagtacagaaacaatcataaacagtacatgtggatatttttaacatgtagatctcaattttagaaaaaattagagacttgaaccaactaaatccgagctaagatgaattagttatgaatttataaagtttaaatcggattaaagcatttatatggatttaattagattatggagcaataaagaattatttttgaaaaggaaaaatgatttattgcgtcaacagctcgggttcacggtggactgggttcacataagcagtctatggaacagacggccgagatctaatctaatcaaatcgaatggccgagatcttgttggctgcaaccctcaattctcactctaaactcactcttggctggaggtagaagatgatgaatagtgaaatcaccaagtgttcgacacaggaaaagtttttggtgctgcgtagaaacgttgtagctttttcgcggtttacttctgtaatataaagcaaattacatgcaaactgaaaaatagaaaaaaaaaaaaggcaaagaccgggaggtgccatagtggactccgccatgcgcgccagtactccatccaacgtgcgccatcccccacgtcgaagcaccagcgtgatatgcatcctaaagacacgttccagaccatcgaggccaagaactcgcacacgacgctcacgccgcgaacaagcaggcgcgctcatgcaaaaaccgaaaagaaatgacaagctacagtgacatacatgattttgtaggcgcaggattattcctcctaacaatctccccttaatcctgacgccgagtgacaatctggaccacgcccgccttgttgcgaaattcttgaaacttgatgcgcgcgagtggcttggtcagaatgtctgccacctgttcgtccgtggagatgaactcaacctcaacttttttctcctctatgcactgcctgataaagtgatatcgagtgtcgatatgtttgcttcgatcatggaacacaggattcttgcacacagaaatcgccgacttgttgtcaaccttgaggatggccatctccggttcggtgcccagcacttcagccagcaatcgtgcaagccacataccgaggcaagccgctcctgtggcggcaatatactatgcttcacaggaggaaagggccaccaccttctgtttctgagattgccacgcaattggactggagccgagaaagaacaaagcccctgaggtgctcttccgatcatcaacgtctccccccaaatcactgtctgataaacccagcaaatgtattcccttttcccctgatcttgcaaagcaacatccaaagttcagagtacctgctacatactgtaggatgtgcttcactgctgccatatgattatcatgtggtgtctccatgaatcggctcacatagctgacggcgaaggcgatgtttggccgcgcgtgcacgaggtaccgtaggctgcccaccaggctgcgatacagagtggagtcgacggccatcctgtcactgttcttggtcagcttcagtctaggctccatggggatgcaagtcgaattgcaatccgccaacccaccgatctttagtagcttctgtgcataggctgactgattaatagtgatgtcgtcgtcgctttgatgtacctcaatgccgaggtagtagctgagcaatccgaggtcgctgatgcagaagagagagtgcatctctcccttgaagtgccgaatttcttcagcgtgtgcaccggtgatgatgaggtcatcgacgtagacaccaacgatcagacgcttggtcccctcgccacgagtgtacaccgcgtgctcggtggtgctccgtttgaagcccagctcatgtagacaggtgtctagctttgcattctaggctcgtggagattgacgtagaccgtacagggctcggttcaggcacaaaacacgccttggatgcttgtcgtcgatgaagcccggcggctacgagacatcgacctcctcctccagctccctattgaggaacgccgatttgacgtccatgtgatgcacagtccactcgagatgagcagcgacagcgaggagaagccgcatggattccatctgcgcaaccggggcgaagacttcatcaaagttgattccatggcactggacatagccttttgccatgagccgcgcctcgtgccagatcacggcgccggtctcgttcttgttcaacttgaacacccacttgaggtcgattggacacttgccggccgggagctcagtgagtatccaagtgctgttctcctcaatggatttgatttcatcttgcatcgcttgccgccaatgttcatcctgctctgcttcagtgaggttcgccggctccttcgcgactgccaggtagagctcgtccgaatcgagctccaccagcgccgtcgtgtcgaggatgttcgccatgctccggtagcgacgcggcgcgccctggtcatcatcgacgtttggcgtcgagctcggcggcgacacgaactcaactgggggtgtgtcagaaggtgttgccggtgtcacagaaggcactggtgacgtggccccgacgctgggaggtgggcttgcaggcgcagtgcttgaggccacctcttaatggacggtgaacgagtcgtctgaggacgcctctccttgttcgacaggttctccccatggccacgacgctgcttcatcgaacacggcgtcgcgcgtgacggcgacgcggttggcctccgggtcgaagacacggtagcccttcgttcctggctcatagccgagaaaaaccatcaccttgttgcgatcgtcaagtttcttgagatgcggcttcacctccttgacgtggacgacgcacccgaatgtcctgaagtagtgcatgtcaggtgttcgtccgtgccacgcttcgtagggagtcttatctggtacggccttcgtgggcgaccggttgaggatgaagacggcggtcgtcaccgcctccccccagaacttcccgggcatttgcttcgccttcatcatgcacctcgccatggccataactgtttggttatggcgctcgacgacgccattttgctggggagagtacggcgccgtcagttgccgagtgacgccctcattcgcgcagtacaagctgaactcgatggaggtgaactctcccccacgatcagtgcggaggacacgcagcttgcagccagtctccatctccacccccgctttgaagcgcttgattgtcgccgaagcctcacttttgcatgtcagcggaaacagccacatatagcgagacatgtcaccgattagcaacaagaagtactttttaccgccatgggtggaagacgaaatagggccgcagatgtcgccgtgaacgaggtcgagccgactcgtggcccggaacatcgccattacggggaacggcgctcgacgctgcttgccgatgaggcattcatcgcagacttgcctgacatgctccagctccggcaacccgcgcgccatgccacgggtggagagcatgcgcagtgcatcaaagttaagatgcccgaatcgagcatgccagatccacgcgtctttagaactccttgccgcgagggacaccggctgggcgaggtcgacctggagcacatataggcgccacgttccgcgacgaacgcgacacaacggacgccgccgttggtcatgaagggtgaggattccgtcctcgatcaccatcttgcacccaacctcgtcgagttggccaagactggccatgttgttgtggaacttggggatgtagtaaacgccggtgagcacacaatagtcgccgttcttgcaggcgaacagcacggtgctgcgtccctcgatccgcatgcgcgaggcatcaccgaacttgaccgtgccgtgcacggtggtgtcgaggttggagaaggcatcccgcgccccagtcatgtggttggaggcgcccgtgtcaaggatccagtcggggtcgaccggctacccctcgtcacagagagaaacgagcacgcgttcctcgttcaggtgcacctcgccattggtcagctcgggttcatcgacgggagcaagcttgcagacctgagccatcagcaacgtgggctcctcatcaccaccagcctgctgtggttctgcaacaaggagattacctgggccagcttttcgcgatcccgctttgccttgcggcaatctttggcccagtggcctagcttgccgtagtagcgacactagtctttggagacgttgcggcttcccagttgtgatggcgtggacttggtgtcgccaccattgccgtcgtgcccttgctggcgtgatcccgcgttggcgcccccgattactagtgtcacgagacaactgcccggtctgcttggtgttgcgagcaggtgtctccgtttccccgagcagagcctggcccgcgtcttccccgtcggaatccggatggtcgtcgatggtgaggagccggccagtcaggtcctcgatggataaaatcgtgagatcaatcaatgtttcaattgacaaggccatctgacgatacctgcggggaacaacacaaagtaacttgcgaacgattttctcctcggtgatgtcatcaccaagaagacggaggtcgctgacaaccccctgaagccgaagtgaagtcctcgactgattcgccgggcttgcatcgcatggactcccacgcttggcgtagcttctgcgcatgggattctttcatgcgatccgcgcccactcgcatggacttgagcgcatcccaggtgtccttggcgcatctcagccggcacagctcgcaggatggccgaaagaacctgacgatcttcatgaaagggcacgtcgccggtgtcgacagcttcccacagaccctgagcctgcaggttcactcgcatcaacaccgcccaatcagagtaattggaacgagtaagcgtggggtaggtgacagagcccccttccttgactacccgctgcacgacaagctgctggccgcgagtgcgaggaggggacggcgaatgctgtcgcccacgccggtgtggcgtgcaggactgaccacccacaagagccgacatggctctgataccaaatgttggcggcaaccctcaattctcactctaaactcactcgtggctggaggtagaagatgataaacagtaaaatcaccaagtgttcgacacaggaaaagtttttggtgctgcgtagaaacgttgcaacattttcggggtttacttgtgtaatataaagcaaattacatgcaaactgaaaaacagaaaaaaaaaacgcaaagaccgggaggtgccgtagtggcctccgccatgcgcgccagtactccatccaatcgtggccaagaactcacacacgacgctcacgccgtgaacaagcaggctcgctcatgcaaaaaccgaaaagaaatgacaagctacagtgacatacatgattttgtaggcgttggataattcctcctaatagatctgaccgatctaccaccggtctagggctgacgtggcgctgacgtcgatgatgacatcatcgccggcggcggctcggcacaccatgctcgccggcgaacgacggcgcgacagcgcaaacgaagggcaccagcgggtagagcgcaacgcggcgaactcaccgaaggctcagatgacgacggacggcaatagatggcaacggcggcgaggtcgaggcggcggagaccttcgggacgacggcgacggcgatgatccggtggtcttcggtggaaacggaggatgggacggggacggcgatgacttggcgatcccgacggcggcggcttgcacgcggctagggcgcggctggcggctggaggtggaagacggccctgacaggtgggccccacctgttagtgggagagagggggagagaggggcggctcggcttggtgggctggctcgggccgcacgcgcacaggctgaaggaaggaagggagagagaagggaaggttttgggccgactttcggcgcaaagccaaaagaaagattttaaacctttttcttttttaaattattcatgaaatgcaattccatttattaaaaaatactttcttggctcaaataaatcctagaaaaatctaggaactatagaatcaagagaagtacttaataaaattttatctatcccacttttatataggaatttattacttaaaattagatcttttcttctaggcttttaaaatcatttctaataattccatttaaacaacaatttataaatttgggattttttgggtctgacacccttgctttgtgatttgcttgattgcaatcccatggaagcctcactatatttattggggaattttcagtctgattcaagaacaaattgtagtcatcgtatgattccctttcatgtccaacgtggtgtcttcttttgcatgtctttgtccgcagcgatgttttactcgagccaaagttggcctctgagttcaagtccattactacagcatgaaccataaagcacaccttacactacctcatggcatggctcctatatggttatcttctgcagcatggcctcgacgtggatagcacgcacaccgccgtgacacctgacttcccgagcctcctttaccttcacgatatcccgcagagccttgcaccattggccaacatcgtgataacgaccgccgctgatgaattgatgcgtgctattgtgccaagcttagcagatgaaaatggcgtatccatgatcaggccagctagggagtgatgaggatgctagttcatgatcttccgataggtaatgataactctcgatttggtggaaacttgacacacacgatccggcttccgatcaacacgatccgaaccttgcaatcgcaacaccacatctcctctggttatcaaccattctgaaacccgatcgacctcgtcgagaaggctaatccctgcatgcgaatcgaagaacaaaagcaagaacaagatagatagcaacaccgttgcatatgaatgattaaacacttgaatttggggttcaacaaaccgatctagcggcgaaactgtaatggcagaaataatctaagaaaaacccgattgtaaactatgatggctactgaataaaaatgatttaggacgtcctagggttgccctaggacgcacacccacttgggcttaacctacgacacaattacaaggcccaagacccaaatcagattcggattagatgaggtatgtggcttgttttgcagattcccaacagctcggtgggaattttgatgtgggaccaacaagtactcatgagccctaaaattcctattagattagcggctagatccgtttgaaactgatgctgttaggaggcccgaatccgaatccaaaacgtgtagaactttatatcttgtcttctatgaacctaaagtgatgtggtgagatagaagtggacttggagaaggtcttggtttggtccccaatcaacttctttgatcatccatgcattccttacgctatcgcgaccgagaaaattaccttttcccgaacgctagtgtactaatccccgtcctaggaaaagccggggtacaccgaacaaacatgatacaaaaggcacatctttattatatcgataatatttacattattacaaaggcacttaaggcctgacaatcaaaaataaacagcagcggactagcgggcctacggctccatcttcacaggcgctcaactggggtata

SEQ ID NO: 65086 - DNA, 14014 bp, Oryza sativa
aaaatcacaaacatggctactcattctattctggagagatatagctggcattgttctagtgactacatcatccttgattggttctgtgatgatgtgataggactgcatattgctatcattcacaggagaagcttccttctgattgctgtttgaagcagatgacagtcttctgcttggtatcgccctcctgaggttgattgccctttgctcggcctggagtaggtcggggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacactcccctggtggatggtcttcttcacaataagggcagagtgtgagacacatgctagcaatgtgtccaatttctccacaacgggtgcatgcctttgattccatctcttcctcgccgacatgtcggggagactcatcttcatcatccgaggagacttgatctgacccttcactatcagatactctgccaccatggcttagaaggtgctgggtcaactgtcgtgcacctcgaaaggtatttcctctttgatgtctaggaatagttatccctgctggaggccattcggtgctggtaatagtcatcttacgtacttcttcttcagttcgcatcggtgcttttctctgctgattcttactcttcttgcctttggcttgcttagtacgtgaccccacgtggtacgaaaggctaggaggaaagcaattctcgggattcaatggattctctccattgggctctctactttgcacactaggctgcaagcttgacttggtgcgaggaggctggtttagcgatgtctgccctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacatactgattttggtcttgacttccaaccaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacgtattctgcaagttgattaagcaaacaacctagcatggttacatcacaacccgctgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttctggagtttcggcagacaattgacgacatcttcttcttcacaaagctgaccaactagtactagttgaaatttgaagaaggaagaaagagtaaacattttgcaaatagcacaggggaaaggaggaaaaaggaactttcgcaaatagtttcatttataaaatatgtccttaggttttatccacttggcttatcctacagtcgagatggttctgataccagcttgtcgcgaccgagaaaattaccttttcccgaacgctagtgtactaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggggaaaagattgagcaagaatgagtacaaccacagtactcagcaagccacaccggagatgcgtaattaatgcaagggagtacaaggggataataataagggttaagttttgcagtaaaccgcatttaaaagtcacttagttgcccaaagccattttaaaaagacgatcctagagctacacagtgttattaatcaaggtcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgtggctattcgaatagattatactctgatcagaggtgtacatctttacccacaagacacatcttcctcacgtgtaaccacgtgccacataccaccacggtatacggacggaagacatgacatatttcccaacccatcctagccataaacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtgaaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcattaatttaaatcaacataattttataaactgggattcaatatgctcaaggatgatgtgacttgccttgctcgctttcccaaacgtcggcttcaacctccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatcggatttattgcgtcagccgaggagaggggcgcgcggaccgggtccatgggagtggggcccacgcggcagcctcacggtccacggtggaccgggtgcacgcggcttacgccggccggcgccgtgggtcccacgcgtcagccgcacccgagggcacgggcggctgacagccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaagcgaaacggcggtccacggctcaccccgggtcgacggcgacgacgggaacggctaccggagcggaggaaggcggcggcgcggctcgggtcgacggggacggcggcgttccggcggtcggcgggtgaaacggaggggtggacgaggtcggcgaggacgcggcgaagccgaaggaggcgacgccgaggcgggaggcggtccggggtgacgacggcggcggaccggagctcggcggcgacggcggagagagagagcgacgtcgcgagctcaaatccggcgaggaggaagggcggcgagaggcggaaccggacggaggaggtgcggggagggtttaaatagagccggggcgagagaggctggccggggaagggaggaaaccggcgcgggaggtcggccgccatcaatggcgccggcgagattaggggagcggtttccaaccgaatccgagggagagagggagggaaaaatggggggaaagagagagggaatcacggggagtgatttccccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcacgcgcgcggggaggaggccgattgggccgcgggggagaggagagagagggagggaggtgggccgagccggcccaagaggggaaggggggaaaaaggactttttagggcttttctttttataaaaccattttaactttgtttatttcttaataattattatttgtgctctgaaaattccactaaaatttgagggctccttttagaccaaggagaatttaacaaaaattctccgggccacattcgaatttttcttgtacgtattttaatgtttgccaatttcttttcgaattttaattaattctattattccttttagaaaatgaattttatttcggaatgaatttatcaggacgtgacatacgctcggtctcttttccttcacccaagtaagtacctctgcaaacgagaacacacaaaactcattgtgtagcaatgtttgttcaaatatataacaagtaaatctaatatagaacatatgcacctttggttgatgaatacataaggtagtcatggttatatccgagctagttgtgtcctcattagggaggctgtcctaaacgttctcggcccaatttgtatgcttgtcatccatacactgcctatgtagcaatccaacacgcaccatcttgtcaacacctcctaaagcaacctcaaggatccacccacattgaccttcaattgaatgacatcaatctatgcggaagcacgaagccgagaaattgccatgtcgtctccacagccatcgaacgacccgaaggccacgtctagccatctctctatcgaacgcagctcaccgaaacgcccgtgccaccatgccccaattgttcgattccacctgttgagaccaccgatcacctccagcttcaatcaacctgagcgtgcgaccacacgtcttcctattgaatcgcccgcctgaagtttctgacccaccggttggatcgccaatcgcttccatcgcatcaacccgaacaccatgtctggttgtctccctgttgaaaacaaccactgaacggttcataccgtcgcctgaagtgtccgatccacctgtcaaaatccgttgatcaccatcgtgcaccaccatgcacacatgtccttccatggacataaaccacgagcggtgcagtgtgggctaccccatcgcgcctctatccatggacctcctgcaggctttgataccacttgttataaaactggcttcaatagcacatcgagaaccaaacgtggaagaaacgccataggatatccaaacatgataacaacactgaggcacgatatttgttaacaaggttcagctgtagcctacatccctgtggcactgattacgggtgctactctccgatccagcatattagagcatatcagagttacaacgactcacggccggacaccgacgatagccgctccctcgctctatgttaaggcccagttctttcccccaactttcccaactcacctccctcgcacgcgcacacttttcaaacggctaaacggtgtgtttttttgccaaaaaaaagttgctttaaaaattatattaatccattttttaaagttttttatagttaatacttaattaaccatgcgttaatctatcgctccattttgcgtgtggaggggaggggttcccaacccctccaaaagaacacagcctaagtcaccatatggtttcaataggttggctcctctatttaagagagatcttatgatagagtccaactcttcctctattcctaacacctagtacaactccaagttctaaactggaactaactttgtagacatatttgatgcgaactataacatttataatttataatttactattttttatatgtaaacataataataaacactaaataatgaagaattcactagataaaaaatagtttggctgtaactaaaggactaaagaagcactaagtatatgaaaatatgttatctcttgtactaacgagctaaagagcagttcatgagtcagctcattaaagtcacaagctaaacgtttagcttggctcgatttattaagattacagttcgagtcaatccgaaccaaactcgctacgaatcaatcacaagctttgagtttcttttccacccctataccgtagtaaaaaaaaccggacctacccaacggttgaaccggaaaaccggaaccacaagctacgagttttttttttccaccatgcctatacctgagtgagacacaattgtaacaatcggtactataaattcaatggccaaccaaatcctactttcgggtaaatgattgtccacggatgatcatagctaccccagggatttttcttaaaacatactactcataatgtccaaatcaattaattaattagtaagatttctacttatgtatagtatacatactagaatatactacaattgtcgatggtaacctttggtcaaatataacaaaattaagttccattcataaaattaaagtaaatcgatcagtgtcacacacagacaggaccggatggttggtggttttgcagctgtgcgcattaaatggtccagtgcatgcacacagaaggcattataaatgtaacttttatcccatgatgaaagccttctcttctgctggttccatctggccctccctttcaaccttttttcagaatttaattgcagagatttatttgacttggaatggactatatatcaggttcatccaatcagaaaaccgcggcggagctgccgacccgttcgctgaaaaagaaccttcttagaattaaactgccttttgcctttcatctccacaccctgaatctcttgtaaaagatataaaataaaaaggaatatcaaatttgttaaaatgacttgtttttaccagtacttacgtgtagcaaaacttgaaacatatagccagcctagtatattattaagatcatgtgtcagaaaagagccattatattgccttcgttgctagaaattagggttaattggatcaatgccactagaaatatgttattttagataaatgacagtactattcatgatatcggctacatgtcactcgaatttatagaaattgggatcatgccactctgtcgtattttccatcaaaactctctgtaagcctcaattgcacgtgggtaagaaagaagagggggattgaaggaagatggaactgacatgtgggtccaacgtctaggggtctgacggaaaatacgacggagtggcacggttctaatttcccaaaatttcagtggcacatagctgatatcatgaatagaaatgttatttatctaaagtggtatatttgtagttgcatggatccaattaaccgtagaaattatcattttctttagagaaattataatatttattaatattaaaggaaaagagctgaacctacatcgaatatatggaaacataaataagctagacatgtatatacatgaaatcgctttttttaatatatctagttccacacaattgcgctgggaaacccactattttttaacttaaaatcacaaagaaaccagaacagatataccactgcgttgccacaataaacaggaagatatatagaggtgtacgtgcatgctatcctccgtacgctactttcccgtcataaaatgatgattggtttatcgaattaaatttgaaaatatactttttttaatattttacgttcatatacatgcatggaaaatatttgtacaaatatacctcctccagacaacggtgacgcgggaccgaggcagtgcggctctttcattccgcaggaccggcggtcgcgcaggacggccgtgtggtaccacctcgctcccacatcccgagagagcggtagcgtggtggagggcagtaccgcgtgcaaccggcgcggtcccacgcgatggtgctgcacgaccggctcggtcccacgccgtacgaccggctcggtcccgtgcaacggcgccgcgcgaatggcttggtcctgcgcaacggtgccgctcgatcacctcggaaccacgtgcgaccgccctccaccacgctgcctttctcccggactgcgggagtgaggcgttgtcgcacggccgtcatgcgcgaccgctcactacaagatatcttatgatagatgacgcttcatttacgtcacaaacattgaatttttcgtcacgtttcgtaatctgtgacgctcgcgtgacgaaaatttattcgtcacctatcatgcgtctctaatggcattctatgacgaaaccttattttttcgtcattaatctagtgacgatccttctgtcgtcataactttgtgactctcacattcgtcattatctagcctaaaaaacgtcacaaaatatcagatggcccattaaaatccatgtattgagcaccctgtttatgggcttagcccaatggcaagcccaactacattttagcctggcccatctatgatgtagcatattttcagcccaattttattatatccatttgctttaatatcaaataataaatgggccaagtccattgcaaaagcccatgtaagccaaaacattacaccacaccattttcagcccatcatattatattcatttatattagtatcaaataacaagtgggctaagcccacataggcccaacaatcaaccacaataacaacaacccatatagcacaaaggttacaacccatatagcaactggttcttctgataatgcaccagaagtcttacaaaccgaaaaaaaacaaaggtttcaacaaactgcatgcaccatcaacaatcacctacaaggatatgttgtatcaaactagcaaagatatctgattctaaggttgccaaatgttcatagcatgtatttctgagatatttcaccactccagatggcaaaatcttcagctgcctccatcctgtacatttcttctcttgaaaatcaaccaatggcatcaatgtatctttaccctttacaagatcctactcaacagacatcattgtaagtacagagaaatgcagtactgaaatgcagtatacagtagagagaaatctaatctagttctcaacaaactgacatagtatacagtagagagagaagtacagagaaatgcagtactgaatgcagcactacaggaaagaaactcttaagttaattaatttcaggctaagttaaaactactggtgcaactgggtaaatttggaccactcatccaaccaaggattggaatcaaaccagcaagctaaagtctaaagggtagcctctgatcaggatcagattcttcaccagctaattgaagcagaaatgctgaatgctaaattgcttgcttctgtaaagcgcactgaactgaactaaatgaattacagtgtgaaagaagatacagtagaagtagcagattacttctctgttttagcagattagctcatggcaagatgtttagataatggaatagatatctagtttgattgccagatgcaagttgatctctttgcctagaaattgagcataaacatgcacagtgcatgatgcactcactctcattcatcagtcatcacctacatgaatgtaatttttttacaggcggttcttaataactactaattaaagtattggtgtaagcatctaatgtatgcagactgcatgccaatattcttagggatcacatgaataaaaaatcattttgaggtagcaaatgtttgtgttcaagaataggaaaaggtagtaagaagaaggtgggaaaatgacacttatctttctagtcaatgggatctttgaacgcagtggcacacaaccctctgtagcttgcaattcatatctgcaacagagcaactgcaagcttgcatccttctcttttcatcagaaacttacagctccaaatgaatatgcaatgaaacaagttcagaatatttagtctctacctatgtagcgtggcaagaaagctctgctacataaattgatttactttctgtaggacaggggaataagacttaagtacacatgccaagaattaccattgctgagaggagttgcaactgtacttagatctaagtatcatcatacgcaagtaaatgcatccagaacttgcagatcgagggaacagtgctaccggatgaatcgtaggatcaaccatcattcaacagagacagacagagattaaagcttactgttgtggctcgatgatggcggatgagtgctcgacccatcggcgctccacgggaagccacttgagcaccctcctgcccagcggctcgccgcgacgccgccgctgattcaccgatgcggcaggggactgcgacgcggacgcactacctccggacctccctgctgcccccgaagagaaggcccgacctcgcctcctccagccaggagggcaggccggtgatgcggcagatgcggcgtggatcggggatgtggctgcagcgttgacgaggggggagggtcgccgccgccggccgtcgccgtgcccgccgcgcgccgagctcctccgtagggcggcggatccgggcctcccgaggacggcgccgccggatccgccgccgcaggccgtcgccgagcccgccgcccgccgctgtcggggaagggaggccaccgccgcgcatgggaggtcggggaacgaaggccgccgccggtgccgagcgagtcgccgccgagcccgccacgccgcacagctcccgtcggtgagagagagagagagagaggagaggaggaaagagtgagaggctgagaggagaggagaggataggataggataaggacggtggaagttaaaatatcaggagaggaggggggagagaagaggagaggaaaaattttgaatggaggaggagggaaaaaatttaattttaaaatattaaaatttctaatcgaattttatcatactaaataaacttatgtgaaaaatttttttttgtcatttcgccatccgattttgatttaactatataaaatttgaattttaaaatataagaaaatctttcaggtagtaaatgatttcaaatggaaaagttgttaacaacaaaattgtataacttatcaagatctataacttttattttcatcatttttctatatgactttgtatgcacagtttcaatttgaatttcatattatgataaattcaaacgacattttacaagtactaaatgatttcaactgaaaatgttatcaataacaaagttctataactcatcaagacctataacttttatttgggtcattctttcatccgacaaagtgatttataacattattcacaaaatgtacatatcccttatatagtttataaactataggagagatatgtaaattttgtgaacaatgttactattactttgtcggatgaagaaataaccaaaataaaagttatagatactgatgagttatacaactttgatgttgatgactttttcagttgaaatcatttagtatttaaaaatattgtttgaagttgtcataatttgaaattcaaattcaaattattgaaacagagtcatatagcaaaattaccaaaacaaaagttgtagatattgatgatttatataactttgttgttgatgacttttttagttgaaattatttaatatttgaaaatgttatttgaagttgtcataagtcaatcaaacttagatggataaataaccaaaataaaattggtagatctcaataaattatatacctttgtttttgacaatttttttacataagttcaattagtatgataaaattcgatttgatgttttaatattttgaaattaattgagaggagggaggcaatatgaacttctggttggagggaggaggggaaggggcagcttggcggctgggccggctagttcagtggcgcggcccatggaggagtagaggagggttgcacagcttgggccgaggtgggccgagggagaaaggagggagagggaagggaatgggaggaggaaaaaggccgagcgggctggcggggatttgaatcagactttagtacggatttggcccaaatgacaaaggaggattgtttttagtttttctttttaataaattctgttaattgtttttttgcttagtaaatatttcggtgctttgaaaattcaagtaaacatccaggacatattttaaaccgaggagaatttatgaaaaatactttgggtcacaatcaaattttttcttgcacgtattttagtgtttgccatttacttttaggattttagttaattatattattcattttagagaataatttttaatttgggtgaatttatcaggatgtgacaattattttagggcgttacaaagggcagttcaagcattcatcaattttaaaaagaaaaaaacttatgataaacgaacattgttaggaacttgtgacgtttgttggttggtctcttatgacaaaataataacagtcacaatacaccattagacaagtttatgacgatctgtatttgatcttagtgacgaccaccccatttttgtcactaaccagcaccgccccatattaaacgtcataaaacgaaatggcatagtgacgaaaagcaccatcgtcacaaggaattcgtcacagaagatcacatttcttgtagtggctggtcacgtggaatgggaaagcggcaccgcctcggtcccgcgcgtccccgttgtgcggaggaggtatatttgtgcaaatattttccatgcctgtatataaacaaaaaatattgaaacaaaatttatattttcaaatttaattcttggtttatccccagtacgtgcatgatattttttttaggtgagcacatgtattaagaaagtagatataaatgattaaagaaaagttgtgaatttgtgattggttgagaaaaaaagtgaataaattaattggtaatggttgtgattggttgagagaaggcgtggtagatggagaaataactttattcttattttaattatattttaagatggaggtagcagcatgctactgctggagaagcttggaagctagaaattggcatataaggccatcaccaatgcggtgcttcagcccgtccccttagcgccggctgtccccttttccgtccgcgtcgttccccttggacggaacgcgtccctcagctagggaacgcgttgctcgccgcacctcgccagcttttcgtggggagacgcagccaggcgccacactgtgcgcgtgtgcagctcatgggcacggtgtcgtctccccccccaaaatttccccttgcaccctcgcctttctcgctctcccctcggtctcatcgcgccgcgcccaccactgccaggaccgccactgtcggccttagagagagagaagacatcgacgacagtgacaatggatccgcgacggcgacgaccggatccgatcgccgtgcgccgcggcagcc

SEQ ID NO: 65087 - DNA, 3562 bp, Oryza sativa
ggaggggaggaggtgcgccggtaaatgaggagaagagagagagagagagggaggagagaagagaggggttgatgtgaccatggttaccacagatgcaaccattgctcacatcatggatgaacaagatgacatcaaggtcaaggcctccaagtgctggaatccgatccggccacctgctgcattgctgatttcaaacagccgccaaatctccatacgagctctgttttcggcccgtgagtacttgatggaaagctctcggagtcctctttccaacggatacagcctcattgcgaaattccatcttattgagccgcaattgaagcaacaaggtgctgcgtcacctatcatgggcctttgggcttgtaacttcgtttgggaccctggcccaagtggggcccatgtggggtgcgccctaatctggtggagcacgaccctaggatcctcatggtcgttctcccacccctataagtagctagataccccttcagggttgcttgggttttgattaattgtaagtttagccattgctacttcgcttgcagcgcgcgtgtcggctataccgtccgtctgcttgttcggaaccccactttatcatgtatcaatttatctttgtgcgtcttgtctatctagtaattcagttgctttatatcttgttcttgcttgttctcgattgcttgcaggaataaggttgatctgcaccggcaagatcaacaacccacggagaggtgtatcgatcgctaaggcgcaacgcaacgtcttgtacggttgtagtcggatcgtcaacgtttctcccaaatcgtagttatcatcaactcaccgaaagatcgggccaaacaactgccttgagtgtcgagtggaactcagggttcatcaggggtagtatagtaaaatacctacgtaggctttttaggttaggggcactcgttaggctactagggtatctttcattgtgtggggggtttcccagagagtgccctcagttagtgagggtactcttagagtgtccctgattgtagatgccctaagaaaaggcaagaaaaaggatttgtatcattagatgttactacctttatattttaatatatgacgtcgttgactttttgtccaacgtttgaccgtttgtcttattcaaaaaatttatgtaattatcatttattttattgtaacttgattcgtcatcaaatattctttaagcatgatataagtatttttatatttgcataaatattttgaataaaacgaatggtcaaacgttggtcgaatagtcaacagcgtcatacattaaaatacggagggagtagatattactgtataatgtatgtctaccctaagaaaaggatatgatactacataatgtatgtcttgttagatgtttctgtaatgcaataattactgacaggccccagtggtcgtcccctatacctgaggctttcgttccgattaacgttagtataggaacagaaatcaattaattaacttcctcttaaactctctagccagctagcttgtaccagaagccatgtacaaccagcacgtacaattaaatacactgttacgatacactgtcgtctcagcacgtgaacatgtgtccagcttcctttcggttaattagggataaaaatggtcacgaaaagtttcgattgacagatgctcgtttttttttcattgaccgaagcatctgaaaaaggtaaataaagacgaaaaggacaaatttaataaatttgaaaatggaaatggaacgattatactattttaccgattacttccatatatacccaacggaaattactatatttataagataataagtttaatttattgttgtaagattgaatatctatgatcatactccctctattttttaataaataataatgttaacttttaaacacatgtttgactattcgtcttattcaaaaattttattcaaatgtataaggtataatcacgcttaaaatattttaagtgataaaacaattcacaacaaaataaattagaattacgtaaatttttttattaaaaagaatggttaaacttgtgacaaaaaaactaacgatgtcatctattagaaaacaaagatagtattacatataatcatgttatgtgaaatatatatatggttttacagttattcaaacagtacttaccggttaccggattctaatcgataccggcacgttctcattcatataattccgttttcgattttctgatattattgcagcttttcattctcacctctacctttttattctatttttaagaaaaatatatatggtcacagaaatggttttgatggtgttctccaacccatttgttgtctggataaacattttacgtagaactgtgggagtgagcccaaaaaaaaaaaaaccgtacgtgtgtccgtgctgctgattttgtccgacatggatgcatgcgtgcacatgtattaagctaagctagtagtagtaggcagcacagatcgatcgagcacgtacgttatgtgtacagcccgaaactagctggagtagatcgatcgatcgatcgatcaggagcaaatcatatcctttgcttccagtaggaatgtgcgtacgtaggacgatatatgtgcaggttcgatctccgtcggtggcgttggccgtctccctcgatctctcaaccacgaccggccggtggcgtaattccttcgatagggttccataccctctctgcaagatagagctgctaattaacatggtcgacgatccaagaagctatcctttctaattcgtcactccgattccacaagcaattaaagtcggtttagagttctcaattacatctttttgctaaagtttggatttttagatatagtagaaaaaagtgccagtgcgttgcaacaggtaaatgctattttaattttattgttgttatacgatttaactagcgtaaaattaattcactatgggaatctgcttggatattctttttagaaaatcataagctacaattaggagtccgtagttaatctcaagttagcacgcgagtttttttaaagaaatttattgtacgactccttttgtattttccaaattaaatgagcttaaaatccaactcaaatatggatatatatttctaaaagtcaacaaatttaaaaaccaactcaaacacggatgacgtaccaaaataccggcaaaaacatcttcaatttttataacaatagagaagagatagataagagaaaagatatagattaaaaccgaaacataaaagtaaaaccgactcaaacacggatgatgaaccacggaaatatcttcaatttttataaccgattaaacacggatgacggaccacggaaatatttttaatttttataatagtagagattcgattcgatgactgtatatgtagcttattttaatcttttctttcatactatatatttatgtcaagttttcaaaatataaggattttaaatttatagcaatttcacaacctattcaattcaccttaaccattcaaccgcaaccagttttcatttaattttgtgtagctcaattttaatttctactaaaacggttaaaaatgcttatgttttaaa

SEQ ID NO: 65088 - DNA, 8769 bp, Oryza sativa
aatactagtaaagattatctgattttaatttgagacgggggaattatttaccccaaagcacacaaagtagctgcgagatgacactgaaacccacccaccaaccaacacgcttgtcccttttcggtcattattggaaattaatgtaggagtagctaagcttaagcttgcttgtactatatatctagctagatagcgtgtttgcacatgcatatgctccgtacatataccatgaatccaatcagtttctttctgttaagcgacgaccgccgccatgcatttgtctgctagctagctgtccggatcgatcttcgccggcgagcgatcgagctaggaacacgaaggccagctgctaattaccttttatgtagctgcgatctacttcactctccattctctccgtcttactttaatgatcataaaatatctctaagtgattatattatgatttaatgtaagttgtatagttatacttactacgctacatatacttttgataatatataacatattttgaggtattttaaaatcttatgaaaataaacaagagcgatcaaattttgagcttaaatataatatgttaacgtcaattgtttaattagtttttatatatagaaaggttccggtaattacctcgaaactttaatatctcagaacatgatcagcgtatatatatatatatatatatatagtcggaaagaacttcattattctttgcatatatatggaccactgaaacaacacatggccggcatccgagaagtctaattaagagctaatcaacaaaacacacacatgtttttcctaattaacaatcgttgaaacccgtaaatatggctactaatttgactttattacatagatgcaattatgcatgcatgacacttaatgacacacacacgctagtaagactgatttggtctgcacctacgtactcgatcctttctatttcagttccaattcagagatgaactagttggctagcacagatcaatatccttattaccaaatttcaacatatataatattgtgaatctgtgatatgtgtgtgtgtgtgtatatctccatgcatgtacacatatgtactccctctctgttcttttatgtacgacgttggttaattcatttttgaaataattaacgttatatattaaagaagggaatagagaggtgtaaacttttaatttgtggagatgggtgggaaatgaattaatccgttttaatttacttagatgatgaggctgtctccgtcgacgtcgttgatccacgaatacttctccatgtaggggttggccgtgttctccggcgggtaggcgtcgatgcagtcggcccacgcgcccttgtcggccatgtcgccggtcacctcccacacgcagctgttgcacttgaaccccgacccgaacgtcaccatcagcaccttgtcgccccgcctcagcctccccttcgcctccatgtacgacagcacgtaccacaggctgctcgccgacgtgttcccccaccggtgcagcgtcatcctcgccggctccacgtcgtcgtcgtcgaggcccaggctgcgcttcacggcctcgatcacggccgtgccgccggggtggaggcagaagtggtccacgcccgtcttgaagttgatcctgggcccgtcgccgccggtgtgcttggtggcggtggcggcggtggcgcggcggcggaggagcttcttggtgatgagcagctgggcggcgaagcgggcgagctcggtgatggggaggatgcgcggggcgaggcggcggaggttggcggcgaaggcgcggacggcggccttggggagcgccttgctgaggctgatcccgacggtgccgtcgtcgtcctcccgctgcagcgcgcaggcgtgggcgtcgtcgttggcggcgatgttggcgcgcacgaggcagccgagctccatcttggcgcgcccgcggagcaccgggtcgttggtgaccagcacggaggcgccgccgcagcggaacaggcagttagccagcatcatggacttgtcggtgccggtgtaccagttgggcgcgatggactccgtggacacgacgagcgccagcgcgcgcggccgcgtcgccagcgtgttccgcgccaggtccagcgagatcagccccgcgctgcaccccatcccggcgaggctgtaggcggcgacgtcctcgcgcatgccgtagcggtgcacgatcatggacgccagcgacgggtccggcgagaacatggaggcgttgacgacgagcacgtcgacgtcgcgcgggccgaaccccgtcctggcgaagagctcggcgatggagtcgccgaagaagtcctccatctcgccgagcgagtccccgtgcgtgggctcgccctcccggccgtcgagcacgttccgcggcgcgtacgtctcctcgccgatgccggagcggacgatgacgcggaggaggaacctgtactccggcaggctgagccgcttgctccgctcgatcaccgcgccggccgcctccgtgctcaccttgcggtcgtcggacggcttgtggcacacgtagtcgaggaggtagcaccgcgactgccgccgccgcgccgccgccgtccacgcgaggtacgccacggcgtgcgccaggaggagcacggtgaccaaggcaagcagctccattgctgatctctctctccttctacaagtagaaagctagtgatgatcagtggtggtgttttggttttagtggttttggtgcggagagagtgtgtgtgtgtttatataggccggtttggtttgcacgcaaattaaagcggtcagagttgagagaaggtggcggatagtattaattaattttggtcaaaaaactaaatttaccctaaatagaaatatggattactgtagatgtttcctttcgcaatttggaaaatgacacgtcatgtgtgcaacttgccgtgccctgtttgtacccttgtcgttgttttgggtaataaactcgtgcagcgctatttgctgtatcctgcagtcatactcccaaaattagcatctttccaaaattagcatataagttttttgacatggtctttagtatataactttcataagtaatcatttagtcaaaagttataaattactaatatttatttttccaaatacttgcaagtctatagaagaagtaatgattagtactccctccactaaggggaaacgattagtcccggttaacaactccctttctatcggttgtagcaaccgagatgaatgaatcgggactaaagatctcgacttaaagatgcatagcaagtgaaaaaaatatgaagatgcatagcaaatgaaaaaaaaagaatcggaacgaaagatctcgacctaaagatgcatagcaagtgaaaaaaatatgtgggatgtgggattttaactcaaaatctctcaccttagccctcatgcgtctaaccattgcatctaaccattccacctactacacacatctaactagaataaaaatgcttttcttttgaactaaccctgaagacatctttagcaccggttggtacaccaatcggtacttaaaaatacatttttagtatcaattagtaacaccaatccagactaaatatacatgtttctatggacttaaacttttagaaccgatactaaatcatctttagtatcagtttttaatctaaccgagatatttgtgatattggataccacgtcaaaagattcgctctagtagtgctccattcacaaataatcatcatatatggtatgtatagcgataccagtatatccccgcatgccacttaattaaattggcatggatcaacattgtgtccggcgcatgcatcaagggtagtgtgccggccaatgatattgcttgatgtatacatgcatcataattacaattagttgaatggtagatagaataatgcatgcaaatgatcatttagtactgcaagaaaaacaaaaggtcacgtaggagagagtaccaaatatggtgatcacttctgaataacacaaaaaaaattatatgatgattatttgtgatggagggagtataagatttggtaaaactttcaaaattttgatcacatatgcttattctaaaagaataaatgatattatagaattatcttaatataaaattgatggtcaaagttttaaaagagtgatcaaatcatatcctaatcaaatattaatgattgtgtttgcgtagaggtagatcaaaaactcgaaactagctcgtggctcagaccaacttgaactcatagtcataataagtcgagccctattagacttttagctcacattagtactccctccgtccttaaatataagggattttggttggaagtgacacattctaattcaacgaatatggacttctaatccaacgaatctggacagttctgtccagacttgttaaattaaaatgtgtcacttccaaccaaaatcccttatatctagggacggagagagtactacagatcaccacatctcttcatatatactccctctgtctcgattttggtttgatgtgatatatcctacaacacgaatctggatagaactagaatgtatcacgtcccaccaaaatttcttatatttggagactgagggagtattatgcttcttgagtgtaatgcttagtttttttagttacttaaactccttgtgtttagttttcattataattagttagtgtttattattatttatgatataatggtaaagttgaaattataaaagatggtataaatgtgttaacgagctagctcgtgagccaagctgagttaagcttttatctcagttaaggttaacggccgaagcctagctacctggttaaaatgataacagtcaaacgaaccgagccttgacaggttgagcgagctcggtatccccctaggaataaaaacgatcagaagaccgagagtattggaaaactgagaaaaccaaacaaattcaagcttactgtagataaaattacaaaatgtctctcttttagccatgcactgaagttatagatttatttgaggagtcgaggcctctaaactatatatggatgatatggacggtaattatcgtattatgaaagcggctgtttccccctaaaaaaacatcagcatatattaaaatcgttttcatttggtaaatcgggttgaaactcgctgttcacctgggaaatatattttcgcaggcctaccacttaagcggttcgcctataaaaataccctttatttttacaggtggacctcttatgtgatccacctacgaaaattggcgtggatataaatagatatgacatggcagcaagattttttctaagtctcagctctcctctccctcaaccctctcttcgtcagctccctcaacaacctgcggcgggaaccagcaacggcgacacgcagaggcggcggggtcagcgccggcgagggcggggtcagcggcgggaacggcgaggcagcggggtcggcggtggcaacggcaaggcgcggggtcagtggcagcagcggcgaggtggcggggtcggcagtggcaacggcgaggcgcggggtcggcggcgacaacgacgaggcccggggacggcgacgacaatgctcgaggacggcagcatccacacccagcgcggctcccctcccctccctcccagatccggccaaaggggaggagaggaaggagaggtggcggcggctgcccctggaggtggcggcaggcggtggcggcggcggcgccccccacccccgacggcggcggcacccctacgcagttcccctaaccctagatcggctagaggtgggtacgggtgtgggtggggtggcaccgatttttttttcgtcgagatgattttcacaggcgggggactgggccgcttttgaccgcctaaaaaaaggcatttttctagtagtgtttctcccttcttattcagcttatctttgtgcggacgatgaattaggatacagagtaggggtgaaggagaagattggagtaaaaccgggtgagatgttcctagatttggagagcgaggcaggccgtggtccgtaatatactagtttggctggcatgaaaaatactatgatactgtagtttatagaagctatatgtgttgtgattgttaattactgaagtgaccaacgattgcaaacttcaaactgcaatattgactattgagactaatcttatcctactgcatgtcaaaaggtggctgacatccttcgtctggaatgtctcaagacgacgattatatactcccttcattcaaaattatatgatgctgttaattaatttttcgcataacatttaaccatttattttattaaaaataaataaataaatattatttattttgttacgactggttttatcataaaagaaaatacaatctttatatgtatactaattttttctataatctttatttttaactaatttttttaataagacagatcgttaaatgttacgtgaaaagtaaacaacatcttttttttttgagaaaaaacaacatcatttatcttggaatggagcgagtatatatttcccattattcttttttactattttccatgttccgagctctttcgggccccttcactctacagtaaaatccataagcaccgattagggtgcatgaaaaagtggccgacatctcatttaaggtagaagtcaaaacaaatattagatgatcctccaacctagctaattaagtgatctggaatgtcaattagtactgtgcatgctatagtttggctgttaattactgatcggcagtgtagtgatgatcaaccaacagttgcccaactgcaatgaaacgaatgctatcctattgctacggtaattaagcatgttaaaagggtggatgcgtgtcatcattaatttaatttaacgcaaaaaagttgaaacgggtcttaatttaatttaatttaattttgccgctaaaaacccctagccaaccttggtctaaaatgtcaaacttcgattatttcctatcattatcttttggttgggcaaatgctcgatgatagaagttattgcaaagaaagatacatatatggggcacaacttgccatgtctcttttgacaccactatcataatattaattagtgatcactcggcgattgttcaactagttcctcactacttgtacctaccacttgaacctcgttgcctttatttggaagtcacttaattaattggagggacaccgtacgagaattgtagaaaatccaccactatagctactactaagcctatatcaagaacagcaaataatcaccccaaaaccctcgcaaaaaaaaaaaatcaccccaaaaatatatacccttgcacaaaaaaaaagtttcaaaaatgtatacggttcacctcttgtttgtaaaactattttaagctcgatcttaattaagaacatgtccgtcctcgatctacacataaattactagttaattaacagagtgcatatactgccaagacgacggcgcccgcgggacaaagtgatcgatttcgacgtgattttgactctaattttctgttcgtcggtgcttctcagcgtttgggtctatcaagcgggtggtggatataaagcatatgcatgcatatgttttgcatgccacttgagcggcgcaaataattcatggacaagtttgaagcgtatgttgaattgttagccgactttaaaaatctgtgagcgtgccttaatttgagatgcatagcagaattgcgaggattaactgccgtattaattaggacgtatatctacacatgattttgatggtttacaactgcaaagatatatgattataaaagaaaaaaaattggaataataatttaggtagatagcagaaagaacgaataaataatagacttgaagaaaagtttccaaaaggttaaagctttgagagtatgtagatcatatgtcgatacatttttaagtaaaaatgagtcgatgttttccactactataatagagaaggaatgtagtgatgattattactccatctgtcccaaaatatagcaacttttacatagatggtccagatatgtagtactagcatacatcccatctaacaaaaaattgatatattttgggacggagggagtattaatcaaccttggtggttcattaacgtgcacatcacttgttgtttcactactgaagaaaccatctttggtcggttgcccaaaatccacaatagtcccggttcattaaaaaaaggggactaaaaagtatttttagtctcggtttataagtgaaaagggactatgtgatctttagtcccagttgataacaccaatcgggactaaagaacaactcatatcagaggctgtcagatccccagagatctttagtcccggttggtggtattaccaaccaagactaaagatcctaactttagtcttggttgttgttcccaacgggactaaagtttatgtagatctttaatcccgattagtgttaccaaccgaggctaaaaatcaatataccgtatataatcccttacacttatcctcaaaaatttctatctcctattcctcctctctctcacactcttatcctctccttatattcctattcctcctcctctctctcacactcttatcctctccttatattcctattcctcctcctctctctctctctcacagtacgtcttatcctctcttgttgtttctctaggagcagcgccggcgaggagcaggcggggcatggcggcggcctgcgcgcggtagcggggccagtgcggcgcggtggcgtgggcccgcgtgtgcggaggtggatgccgggagggcaggcggcctgcgtgcatggaggacgagaccgggagggcgg

SEQ ID NO: 65089 - DNA, 1811 bp, Oryza sativa
ttttttagaatttgtaattcattggattgatttgtgatgtatttcgtttagaatttgtgatgttttttttttagaatttgtgatgccaatttgatttgggtatataattgaggatatctaaggagcaactcgatttggaaaatcaaaatgtagtgagcaaaggaacaatgaaaaaaaagaaaaaaataggaaaaaaaatagtgaccaactgagtctgctgctaccatcactaagatggatttttagtcccgattatttcacccgggactaaagacgggtatctaaccgggactaaagggggttgtgaaccgtgggtaaaaaccctttctccagcagtgtttactcattttatgcatgcttatttataatttagttgcactataataattatagttataacgcgattgtagtgtactccccctcaaaatctaaggcagttttttacattaagacacagaaaaattaactcatctctatataacaaaaccaagaaactatatgtatacatgcattattaagatgattgattagatttcgatcaaaaatttaatttagtacatggacacaacaaatatgaccatctcatttagaaaaacaaaaaataaaatgtacttaaaactattggactaagggagtatgtaaatatatatgatgtaactatagtcattataattccattatagttatactaacaaagtacccctgctttgttactgtaaaatgttcatactaattatttgaatatatgttatacatttgatttaaaaaatattagactattatataatatcagaaaatatcaggtgctaatttgaaaattgtgaaaattgtagtaatagtgagctggtgacagaaccagcaacattactattatcttatacattagtatagactatagattataatttcatcttagttacagtgcacgtaaggatctgattgaatctcgaacttgatttagttcttctgcggcatgtacaacgagttgagccattaacacttgaataattgaatattaataattacaaaattttaaaatgggtttatttgatttttaaagaaacttttgtataatttcttttgcaaaaaattcaccatctaacaatttaaaaagcatgctaatgaaaaacggggaaattatagtttggggttgatcgaaaaaagaactcgcctaagtaggatgtaactatggcatataaactagtagtatatataatttgtctgtttccccccacttcatgttaaacaaaatgaatcaactgggggttcactgcattgggcagagagaaacgactatcctttgctaattgctagtaggcctaaaatctgagggatcaagtggcccaataatcggtctgtatactgctggatatgttcattaagcagtctgtatcccacgttactcctgtataaatctcgaagatgatagagtggcctaaaaatcgactcaaactaggcaaagaaaaatgttgatagaattttagcaaaactgtaaagcttttgtcaacttttctctaaaatctcaattgaattgttcattctatatgaatttcaaaggaaacgacactggtggagaaagaggctttactcccggttggaaacccctctatagtcccggttatacaaccagtactacgaatccgggactaaaaatacacatctttagtcccgggtgaaataaccgggactaaagatccatctttagtcctggttggtgtaaagatggttgagccacgtgactgacgcagacatctttagtcccggttgatcttaccaaccgggactaaagacttttttttcctccttcggtt

SEQ ID NO: 65090 - DNA, 2210 bp, Oryza sativa
ctgagggatctcctccgtcctcagccgtcggggtttcgagtagacgatgcctgaatcgtccggtgtgatctgcctgtctgtgcttgagatgggcgcctgcccgtcaggttggtattctgttggtaattaattcatggtttgcaattcaatcagccaaagagaacaatttgcaagaaaccaaaaactcaacaaaaacctatgaatcaattgccagcagcttaactatgtgaaggagtacataccgttggtggagaccctgccgacgtgccagagctggcagatgaagagggcgcccttgcggtggacggcgtcgacgatgggcttccacgcctcgacctgctgctgcgtccagatgccgggggtgtccgggtagccctgcgcggtgtcggagacgccggtggcctccgtgacgaggaggccgccgctggtggcgcgctgcgtgtagtacagcaccgcgtgcggccgcggcacgttgccgtaggagcggttccgcgtgagcggcgcgagcaccacacggtgggagagctcgaaccgccccatcttgtacggcgtcagcagcgggatctccgccgccgccgccgcgtccttctccgcctcgcgcgccatctcaacgctagtgtggcctctgctactagctcactgtgctctgctctgctcctctattgtgttttgctccgagtccgatggtccaagggggttgatgatgctctttcatttatagcgtctgagtgggaccctggcggcttgacggaaatgtgcgcactgctattccatcggatctttcctgcgtcaccctctccgtcatcgtctggtcggtaggaaagtctctccttacctgggagagcgcactgattttcctcgtgtgggggaatgcgtggttctaattttctaaacattctttaatgcaacagccgtctggtgctgaactactgatgaccggtgtcaatcaacaagagtaagagatgcactgagctgttagttcttttttttttaacgtataggtttcttgcattatcggcttcaccttttcgcttatatttatatttattagtcaaaattaaaatttcaaccttaaatgtagagttgattttgagatttttttttgtcatcgcagtttattttttatcttttgcttgtttctcttagatcgttaagaacatgtatataaaatatatacaacactgcatctaatacaattttactagtagtagtaacccacgggctattattattgatagtataaataaaattttaattgtagcaggttatactaaagggaaattgctttgcgtacgataaaatttgtacgattttagtacgatcctaccatgcatgtcttttttttttattgggtggaaacatgttggaccccacatttgcatcacacacaagagactatgaagtatcgtagtctgatcgtatgaagttttatcgtacgtatagcaatgctcatactaaaggtagagtccacaccagttatgagttgctaattatgaatacgaatttttagaattaaatttcaagataggtacgtctttatatttattcaatttgaatttttgagttataaatattagaagaactaaaacttaagagttcatagtgataaacaattgaatgttttggttaacaggttctccatatatagaaatacaacctaagtaataaatgatcacatcctttgagttagaacactactacacgatagatttttgtggacactaccctcttttgtttccatgcggttcgtaagtggaaccgcacaaaaaaataggggaaccggggccgagctgtcgcccgcacgggaaaatcaattttctcgtgcggtcctcctaaatggaccgcacgggaaaatgagtcgattttccagtgcggatctattaagagagccgcacgcaaaaatagtattccttcttttccctcccacccacttcaaaatttcccctcatatatctcttttaatttctcctcacacccctcccctcttatctctcttctctctccccctctctctttcacgtctctcctcttgtctcctttcggcgcgcgggtgacggcgacggcggcgtgcggcgacagcgacagcggttcgcgtcggtgcgcagtgacagaggcggtgcggcggcggcctcagctccacacggcggcggtggaggcgcgggatccggcgggcggcggccatccccgctcggatccggcatgcggccggc

SEQ ID NO: 65091 - DNA, 4233 bp, Oryza sativa
ctaacaatgcccatcctgtctagctatatccaataatcgaaaacttggtaccatgagatactggtaccttaatatactttttgctgaaccggagcaaatctcctagttagaacatatatggatagattagtggtatgtcgaggacaggaaaatgacacatcttccgagacacccaagctactgaggtaaagattcacgcaccaacaaatttgacacacaaagtgccctgcgggaaccatttctcaagcaaaggtccgcaaggaatgggggaaacaggccaacaagacctcattaattaggataaggtggctcagggcgggggagaagtactgcatcagccaccaagacaagggtgatatgtgggtgtgatcttcaccccacgccagaatcgccgtaggcaacgacacggtgactccctcatcaaccacggtgtcatcaacctcgccggtgagccaggagaggctctcctgatagattgcgatatagactctcattgaagcgggggacgctactagacgatgtggtgggtggggcaggctagatccgacaaaggagagtagggttttgaaggcatggcgccaaggtggtagatatgaggagagaggaacaagatatggggccgacttgaaacgagggaggataggggagggcgggggaggtggatccatggaggtgatctcgatcaatagatttaatgtacacatttttaggtctctgatttgtcacatgatgatgatgatgatgatgatgatgattataatgggtaaaacaagtcaacgaaacatgtaacccatatatttggcagtatcaatacaataaatactcaacaaaagataaccttaattaaattacaaatatgcatgcacagaaatctactcatgcgtgtttcacaagtacacattattgatccataaaaaaaaactcggcgatttaggtgataatcaaacaattactgtagctgagtcctctttcttctcctcaaggaaagggtaatccgtgtagccaacgacgggatcatgtgtgtaaaatgtagatccatcatacttgtttaacggtgcattaagctcgaacctccttggcaagtcggggttggccaagaagagcctcccataggcgacgaggtcggcatagccatcatccaccaccttgttcccttcctcccggtcataccctccggaggcaatgaaagtgccattgaattgcttccgaaatggcaggaggccatggttgatcttcctccgtccttcgacggtggccatcctcggctccaccatgtggcagtagaggagctctgggtgcttgttgagttgccgcaccatgtatgagccgagagcttcggggttcgagtcgaagcagtccataaaatctatatatggcgacaatctgatcccaacacggtcagctcccacctcggcgacgacggcgtcgatcacctcgacggcgaagcggcaacggttctcgaggctgccaccgtactggtcggtccggccgttggcgctgtccttcatgaactgatcgatgaggtagccatgcgcgccgtggatctccacgccgtcgaaccccgcctcgatggcgttccgcgcagccaccctgaaatcgtcgacgacgtgagggatctcatccgtccgcagccgccggggcttggagtacaccgtgtgtgaatcgtccggtgtgatctgcttgtctgtgcttgagatcggcgcctgcccattcggctgttgatctgttggttcatgtcgcaattaatcgaatcaatcaacaaagcacaatttgcaaagaccttatattgatagatcaatcatcagcaatatagagtgagatttgctccggtcaaaaaaaaaaaaaaacctcgaggtaccggtacttcacaatactaaatcacctccgattgttggatctatttgagcatgatagatattgttagatccaacgatcaaaaaatgatttgatatcgtgaggtactgctaccttaagatattttttgttggactagagcaaatctcattttctctactacttaaaaaatctgtagtggtggtcttgatttctgacatagcagacgcatctaacaaacacgtctaatctcaaccatccgattttcatatccaatggcgtcaaatctcctcccatcgctcctctcctcatcacgcgccacgcccactcctttccccacgccgcgtccttcgccctcctccctgcgtcgcctcctcgtggtcttgaatccaacagatcagatcacaattcaatcttccgcacgcgccccacgcatcgtcgatcgcacgcggcgcgcacacacacccctttcccccgattttctctccctctcaacgccgtctcccatctctgtttccttcgcgtccgcctcctccgccccgcaccaaatcttcgcctcctcttctcccgcctcgccggcgcatggcggctgagggtgagggcaggctggcagctgatgaaggcacactacgacccaatctccggctcgtcgaccgcctccacgcacgccccgcccccgatctccgccgcctcttctcccgcctcgaccgccttcacgcgcgccgccggaagccaatctcctcggcgccaccccattctgtgagtagtccgcctcctccgtccggccccctgtctccgcagcctcttctcccgccttgcaggtgccctccaactcaagagggctgagggcgagcacggtggcgcatggcgactgagggtgagtgcagctgacgacgccacatgacgaacccaaccggctgcatgttatcttccccccaaaccctaaaatttccccatctctttctacaaatccatctacatgttttcagatcggggattttgtccttttgggcgtgttaaatttcaaacatgggaattagagatcggggattttgtctttgcctgccatgtttgtacaaattatgctaaatggacaaatgagaacactaggacagctgcttgtgtagagactgaatgacactgttgcataacactgttgctggatctcctctctcttgagacagggttatctttaaatcagtgcaagtacgtactgtgttctcaacaagaattgaaaacccaaatatggatttagttgggcatgatgtgtccattaaggtaagcgatcacccacataacccccacaaataatagcttcagaacaagtagattgttacatctgaagaaatatcatatcactcctgggcatatattccatatggacaatatgatcgaacttgtgaagcatcagacatgcagaattaatttttttccccttattttcttgattttgctgcaattataagtaagcattgttagtatgatcccatggcgtgtaatagcagttctgaactgatagatacctgcaccctcaagaaaatggtttctaccgtcagagtaacaggtcagggtcatgctaattaatactccttctcaaatgaatttttatctcaaacagtctcaattcaaaaaaaaatcagttcatcagtttgtcaaaaattgtcgctggatggatcggttttagcattaatattgaagcaataaatgcataggtgaattagattttttttttctctataaggatattttgtgccacttgctttggttgtcggttagttcatccatgaactcggtagggaacttgtctaagcaaccaatggtcaattttctcatgaagcagtctttttttcttaccagttaaaatgtttccagctacaacaaatactcaggtttcatttcattgctcaatttcagatcatttgtcgaggttggaattgctgcgggatcaagcgaagcctcgtcaggccatgccctcgtctcattcctcagtttatagagtccattccaagcaggtacaatatacatcctcggaacaaataaatgtatttggttttataagaaaaattagtttgcagtgcatcagtgatcctatattcctgcttattggagtacatacatatatgattattggcgttcatctgtgatcagttccctaggtttagatccattgtgttatttagaattagaatggtcatttattcagggggctttgacctgttagtaacccgagtcaagtcatggcctaattaactgaatgaatgatttcagactcaagaaaattgaaaataatctacgcatcttatcttatgaaaatagtatgggaaagagcacaggaaaataatctatctgaactataccagtttgtagcgtgggaatatgttatactcagttttgagggtg

SEQ ID NO: 65092 - DNA, 2371 bp, Oryza sativa
atcatcgcctaatttggtttggaaacttgtggattcgatctcgaatcggattcatctctctcctccaactccgaagtttccttctcgccgccggccgccgtgggccttcgccgccgcctccttgcacctatataaggacccccggtgtctcctctacccgccgccaccttttccttagctcgccgtcgtgtctagcgccgcctccgcgtagccctagtcgccgccgtcgttgccgtcggttcagccgcgccgcgccgccgttgcagtcgccgtcgtcggtcgccgtcgccaccatcgggatcgccaagtcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgttgaggtcatcatgacgtcatcatcgtttttctttttcatgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagtttgtcgtttccgtcattgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctatttctttgttatagcccttttgttcttgattactttattccttgataccttgggttattataacttgactagttgagctttatatattggttcagctagatattagatataattgcttagccatgcttagaaacattagcacactattgggataacttatgattcactattaattaattaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactattgtgaaatattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactatggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgttttcctgaactctaggagaagaaggggagaaagctctccggagttaaggaacccttgtaactgttaaccatcatctcaaacacaggagtagggtattacgctccacagcggcccgaacctgtataatccgattgtgtgcaagctagctagtagtattagaggcggatacgtgatttctaagaggcgagcctcttcccccggccgaactcacgaaaggggggtctcacgacctcccgctatcgagggacttccctcgacagctggcgcgccaggtagggggaaggtcgcgcgctttgaagtgaaggcgttttcttctgccccaagtttccctgggcccttgacgaccatggtcgaggtcctggaggtggaggaggcggtggcgtttacccccaccccgtccgggagtggggattctagtgggagccgcggccctcgtcaccgccaccgcaactccccaactcctccctgccgcgaaccctcgcggagggaggatgccacccgttcgggtggttcggccctctctccgctcccgggcagggggaggccacgacgcgtcggggcacgtcgccgcctcacttacggcgacggcgattcgccccgaggcgcacttcaggcggcgagtgcccttctgcggcatccccccgtaaactcggagccggagacccctgttcagcgttggctggacgacgtggctaacttggtcacctatgcccagcggcagttggccgcgggcggccgacctgccaccaccagtacgtcgcgtactcctattaccctctcctcgtcggcaacgaggagggcccgccgctcggccaccgcctcaaggcgg

SEQ ID NO: 65093 - DNA, 8753 bp, Oryza sativa
gcaacgcgccgacaacctggcagtggccacggagccgcaggccccggaggcctctgcgtcccgtgtctccaagaagcgcctcacctcggctgatgaggtgcccgtcaaggagatcccccttggcgatgatccgtccaagaccgccaaaattggcagaaacctagacgccaaataggaaggtgcgctcgtctccttcctgcgggcaaattctgacgtcttcgcatggaagccgtcggatatgcccggggtccccagggaggtgatcgagcaccgccttgccgtacggccggatgcgcgacccgtccggcaaaaagtgcggcgtcaagccccagagcgacaggccttcatccgagaggaagtggcgcggcttctggaggctgacttcatccgcgaggttatccatccggagtggctggcgaacccggtggtcgtcccgaaggccaacggcaagctccggatgtgcatcgactacacgaacctcaacaaggcatgccctaaagatcccttccctctaccacgcatagatcagatagtcgacccactgcggggtgcgaccttttgtgttttctagatgcctactctgggtagcaccagattcgcatggctagggaagatgaggaaaaaactgtcttcattactcctgtgggcaccttttgttatacacctatgccttttgggttaaaaaatgcaggccctacttttcagcgcatgactcgtattactttgagtaatcaaatagggcgcaatgtagaggcgtatgtcgatgacctggtggtaaagacgcgccaccaggacacattgctgcaggatttggctgagactttcgatagtcttaggtccacacgcgtgaaactgaaccccgataagtgtgtgttcggtgtgccggcgggcaaacttctcggttttctagtctcctcccgaggcatagaagcaaatcccgagaaaatacgcgcgatagagaggatgcgcccccccagcaaacttagggatgtgcagtgtgtcactggatgcatggccgccctaagtcgattcatatcaaggctgggagagagggcgctacccctattcaagctcctcaagcgctctgggccgtttgtgtagacggaggaagctgagcaagctctcaaccagttgaaagcttacctcaccttccccccccccatcttggtagccccggggccgaaggaaccgttgctactctacttggccacgaccccccatgtggtgagtgccgccctagtagtcgagcgcgaagagggcgaaccggaggcctctttaactcgagatgacccttcgtctcccgaaggcccggagcccgaagcccccagcccccgggaggaccccgaagcccccgtgggaggaagggaggctttggcaagtggtcccgaggcctatgatcccgacatgactcgagacccccccccccccggggccctcgagcaagggcaacccagatcacggcccctgacggtacgaaccggccccaccgaaaggtgcagcggcccgtctactttgtcagcgaggcgcttcgagatgcgaaaacctgatacccacaggccagaaaatgctttatgcagttttaatggcctcatggaaattgcgccactatttccaagcgcatcgggtttccgtagtgacatactaccctctcggtcaaatcttgcacaaccgagagggcactggacgggtggtgaagtgggccatcgagctggcagagttcgatctgtacttcgaaccacggaacgcaatcaaaagccaggtcctagctgactttatcgcggagtggaccccagtggacgaacctgttccacccaaggtcccctccctccccggagatgaagaggacccaaacgccgatattcgtggtgggcactaggttatgcattttgacggctccctcaaccttcaaggtgcgggcgccggagtcacgctgacttcgccaagcggggacgtcctcaaatacgtcgttcggctcgacttccgagccacgaacaacatggcggaatatgaaggactcctcgcgggattgagggtggcggccggaatgggcatccgccgtctcctggtcctgggtgactcccagctggtcgtgaaacaagtatccaaagagtaccggtgcaccgacccacaaatggacgcatatgtccgtgaagtgcagcgcatggaacttcacttcgacggactcgagctccggcacgtgccccgacgtgacaacacagtcgctgatgagttgtcgcgtatcgcgtcggcacaagccccactccccccgggaatattcgaagaaagactcgcgcagccatcggcgcaaccagacccctcgagggaccccgatgacacgccctccgccccgacccttggcgacccgtggccctcgaggcccgagggggtcaaccccgcccccccccccccccgtcaggtcgtttggatgaccgacatccgcgcgtatctcgacggcaatactcttcctgaggatcgcgcagaagctgagaagctcgcgcatatctccaagcggtacgtcctcgtagaagggaccctctaccggcgtgccgccaacgggatactcttgaagtgtgtttctcgagagcaaggcatcgagctcatagccgacacccattagggtgagtgcggggcccattcggcctcacgaactttggtcggtaaagccttccgacaaggtttttactggccgactgtattgcaagatgcccaagaatgggtccggcggtgcaaggcatgccaattccacgccaagcaaatccaccagccggcccaagccttacaggtcatcccactctcttggccttttgcggtctgggggctagacatccttggaccattcaaggcggctcgagggggtatcagcacctgtacgtcgccatcgacaagttcaccaagtggcccgaagcttacccggtcgtcaagatcgacaagcattccgccctcaagttcatcaggggcatcacatcacgattcggagtgcccaaccgcatcattacagataacggcacccagttcaccagtgagctgttcggcgactattgcgacgacatgggcatcaaattgtgctttgcctcacccgcccaccccaagagcaacggccaagtcgagcgagccaatgccgaaatcctcaaaggccttaaggccaagacgtacaacatcctgaagaaacacggggattcatggctcgaggagttgcccgctgtgttgtgggcaaatcggaccactccaagccgtgccacaggggaaacaccatttttcctggtctatggcgccgaagcggtcctaccctcggagatttccctaagatcgcctcgcgtcgcgctgtacaatgaggccaaccaggatgatcttcgccgcgacgatctcgattatcttgaagaacggagaaggcgtgcagccctgcgtgccgcgcgctaccaacaaagcctgcggcgctaccatcaacgccacgtccgggcccggtcactgcaagttggcgatctcgtcctacgccgcgtccaatcgcgtctggggctgagcaagctctcgccaatgtgggaggggccatacaaagtgatcggcgttctccggccaggctccgttcgactaaccacggaggatggcacggagttgcctaacccctggaatatcgaacacctccgtcgcttctatccatagcgtcgagattttttgctttccaggagctcggcccaaccctcgcacaacccctcggtttgtacgggcttggccgggggctaccactgtgtatcctcttccctttacaagcaatgaatttttctactcactgtgaagcccattatgcacccttttttctctctctttcctctggcttgtcctggttcaaaggatagttcgcggttactctgaaccctaagtgccgtggggcgacctgaaaaccgccgaaagggagcacaaacgcgggccgcgccccgggttgcaccgaaccccgggggctcggaagggcctacacacggccgtccccgacccccgatcgtcgtagccccggtctagccagtcccgctgggcggctccctcagggcgacggttttgcctttcaccacttaggtaccacggaccgagcgctggtttgccttttcgctagaacaagcccgggggggaggatggggtaaaagcggcatttcgatcacaggcagattaattatatactttcgctcttgttttttcttctttctatgccgcaggcattcaatggaaaaaagcaaaggaacaaaaaatgcgaaaaggaagttttaattgcagaacaagacaggaacggcacgatggcctaaatacaagaagtgtccgctacaggcacacaacaaagggaaattggaagcgcaggtaatcacggagtgcccgggcccccgaggctggcgccgctaacgacgttgtcccagtcctcgccgccgaagtcgtcatcatcgtccccgctgccgctctcctcgtctgaggcaagcccgaaggtgaaccgaggggccgacccctcgaagttagagacgatcgcgtcggccgcctcccggacttgctcccgagcccttgcctcggtccccgggggaaaatcctcgagtgcgcgccatgggacaaagtcggggtcacgaacttggtggctcacgagaaccagttccaccgcggcccgcgccaaggaagccgacgacgatttcacggtctcgctaacctcctcctccagcctctccagatccgcagccagcccgtccagccggagtgcgagtgccggcagtgtgggcggaagcttactatcccggcgcacggaaatgctgactcggcgccccgcgcgctccagtcggtcgacggcgtcggagagctgcccgggtccgatctcgttggtgaggcggagggccgcaatctccccggcttgatcttgcaccaagcgttctagatcggcgagagtgctctgagccgtggcaagctggctccccaactccgcgccgccgggctgcccgcccgccgccaggtccttctcacgggcctccagctcagaagccctcgccgcaatcgccgcgcgcttggcgcgagcactctccagatgccgagcctcacgcccagcaacggcctcctcgcgtttcgcgagctgctcgcccagctggcgcgaggccacctcacggcggttcacctcagcttcgcgctcggcgagtgcgacgtcccgttcccggcacgcctcttcccggagccgtagctcctccgcgcggcggtccgctgaagctttcacggcgagggtgatccggtcacgctcagctgcgacctcttcacgaaggcgaagggaggcctccacctccgccgctgttctctcgtgggcggccaaggtggactcccgctgatcgagcagacgcgctcgctcctccagcacctgagtccgcctttccagctcctgagctcgctgcgcctgctcctggtcgcgcgcgttttgctcacgctggctctgattgaggacctcgattcgttgacgaatcgtggtctcgaactcctgcgcggagcgggcacgctcatccaaggccctgcgttcggcctcgagcgccgctgtctgagcccgcagcgaggcattggcctccgatacccgccgctcttgggcaacagctgcgtcgaggataccgcgggcgtccttgatcctcttcgccaaatcctcggcatgggcctcgtactggaggcggatgtcacccagtgcttcgtccaggacgctcaaggcaaccagcgccgcctgccgctcttcctccacctctcgcatgatggagtccagcgactcctcacgcgcctggattttggctagttgggcttggcgcattttgtgtcccaccctcaccatgtcgtccatggcgtggcgcccctcgtcaactcgcgcgcggtccgcggcgagctgtgcccattcagcctccagggccgctcgctcttctgccagggcttgaacttgggcttgagcccctcccggacggtggaatcggcggcggcgagcacctgcaggagcggctccatacttgccggagtcggagaagaaaaagtcgcggcccgcccctgtgatgatggagtgctgctggatccccacgagactgggggctgctctcgcccccccccttctgcgcgaccagccccgagggcgtcccaagtgcaagggggagcggccgtccctctcgccccccgcctcgggtcctcgggtagattcggcctcggcctcaggctcgggcccgcccccaattttggcctcggcctcaggctcgggcccgcccccgatttcggcctcgacctcgggctcagggccgccctgtccctcggcatccgagccgcgacctccctcgccccccgatcccgggtggcgctccgcatgaaccctggtctcggagtcgcccccaggagggacgtcatcatcgctatcgcccacggcgggacgagtcccggctagggttcgctcgggtccggacccggtatgcggcccgtgggccccgccgaggggctgtgaaggccccgcggccttggatcggccaagcccgggccgctccgatcgttcggatttggtcgcccgcgaagggtcggaccccgagaccccctaggaaggaatctcgctacaagggaactcagatcgcgttaacaaagaaaaagaaaaggagggaacaagagatcgagctggataaaagcaccgaggtgggtgccggcgatcgtacctgcggggagggcggttgaaagtccacttcggaggctcaatgaagctcccccgacacggctccgtttgtcctatcttccggagccgtttctttttccgtccggcctcaggcccggcagggcgcttgtggcccgctggcggacgatccgccacgcgctcggcgccccctccacgcgggggagagggcggtcgagattcggacatcttccgcttctctttcaggtcgctggccgagtcgtccccgggtccgcggtttgggccgggagacctggagctcccacctccgccgggtccgcttgtccgactcccgcctgcggtcgcgccaccgccaccaacaccggcagtgctaccaccggtgccgccccggcaggaccggctcctgccggcgccaacaaccgacatcatggccaggatgctctcccggtcgcggtcgcagcagaggggaaggatcccgtctggaatcagagtttgctcggcggagtccaagcccagtactcgccgaatcaccatcttcgcgtcctcctccccccaatcccagcgctcacccacatgcgtgcgcatggggtcgttgggaccagtgtactcccacgcgccatgggatcgatcctggagaggtgcaatgcggcggcggaaatagtcaccaaagaccatcgcccctgtgaggcccaggcttcgcaggcccctaaggtgatcccacaccgcgtcgtactcttcgcccagttccgaaactgccagccatgcggcggatctttcgggaggaccgacgggaagccgaagtcgtggatggtccggcaatgcggtgtagaaccagtccttcttccagtcctcccatttcttgcgaagatgactctcgatgtattgccccgctgtgcctggccggggttggaagtaacatccccccaccaccgcaccttgcagcagctgcgggatgaagaaagactggaacagccgcatcgtcggccgcaccccgatgaacatctcacacagatgcgcgaagatggccagcgtcatcacgacgttgggtgcgagatgcaaggcatggatttcatagaaatccaaaacctcatggaagaatccagagaacggcggaatcaaccccgccatagcaaaggacaagagatgcacggatcgctccggataccgcggccgcggccgcaactcccccgccctcacgacggcgccttccggcatgatcttgcgggggaggctaaggtgtctatccgccgtaatgcgtgatgccgggagcaccgtgtcgccaacgtcttgagccatgatggccggcggagaagcggcggagggcttggcgcgcagaatagtgtgaagtggcgagaatgttagggcttaaggagcaagaagacgagtgggcagttggcgaaaggaaggaggcaaagtcctcgcctccatatccttttatcctcgcctcacccacgctcacctcctcgtttcacgccctcacggttgcccccacgattctcgcgcccgcggttgtctcttcgtttcccgtgtccactcatcacgtcgcccattgaatctgcgccctgcatttagtgcgcctatcagcggcacactcgaagtagggcgcacaacggtcacgggcacaacctgagcgaaccgtcgccactaccgccgcatgagtagcgggcaagggaatcgaggcgtggcctaaccgaccccctgattttcgcgccttaaacatcaccatcatcagcacggtcagtggtggcaaaccgctgccgtggttaatacgccaacctggccattcggcgacatttccttagattccctaccggacccacaaccccagcttgggaagtcgtgaggcaccacgtcagaaccgacctcaggaggtcagtgtccgatatggtgccgagggctactgacggagatatgggcccgggggtatgtgaagtgggggaaagttacctttccatccagccgcgtggctctacagcctggccctactcccgcgcctcgcgagtcacagaagcggccgggggggcctcagggtgccacgtcgtgcccctcgggctctcccgctgcctcgccctgaggccctcgcctagctgccatgtggcgggaggaggga

SEQ ID NO: 65094 - DNA, 1790 bp, Oryza sativa
atatatataatttttagaaatcccgtcaaacactgccactatactactctacgactcgtccgccgcatactctttactgtcattgggattgaaaaaaatccaacataactatcattgaaattcattttttactttctatgagacccaccaaccatcgacggctctgtcattgtactccaatacgacacacctgttgtctctcatttttattgtaattgagatttttaaaatcaaatatgattatcattatttttttttactttctagaagttccgccaaccgccttaactgattgcttcatgagctgcccgtcgtcctttccttttaatcgacattaggattttctatttggtgttttattaatagtttttagatgtccatcaaccgccaccactctactcctatatagatgtgttacttgattaatctcgtcatgtgttttagatggtcttttctttcaatagtctttattttttatcactaattttagttattcataaattgtattccgagttgaaatattatctttcttttttaatttcagaatttattttatttttcatattgtgtttttttatatttttatttttattttcaatttcagttgtttcaaaattgtatttctacttgaactctcttcttaatttgcctaatttcagattttattttattttttattccaaactttaattaatctactattatgttcttatatatactgttatttcaatattacttatatttaattccgaatttcagttaattctaaattatatttctactagaactcttcttttcttttctttttttctaattttgattttttattttttattctgaattttaattaatctcgtattggattcttgtatgaactcttctttcaatatttcttattttcaattctgaattttatttatttttaaattgtattcctactttaactcttcttcttttttttgctaatttcggattttattttatttttattcggaattttgattaatctcgtattagattcctacgtggactcttctttcaatattgcttatttttaattccgaatttcagctatagttttagattgtatttctacttggactcttcttttctttttctctgattaatgtgtgaatttctagtctccacagcgaacatggtgcctcctttcaaggctgttttaataatataatagaagatagattgagggttcgcaaaatattcccaagatcgttaggtctcgtgctttcaacataaagaattggcagcttgaacatgtcagtttttcacttagatgcccgtagtcttacaatataggaaaaaatacaaattacccccctccctcccacccctcccgaattgtcgcggtcgtccgaattacctccctgaaccacaaaaccggacattcttcactcccaactatgcaaaccggacgaattacccccctcaacctaatccgtggtggttttggtctacgtggcatacgcgtggtggtccagtcagcattttatttattaagaaaatgtgggacccacctatcatacactactctctcttttccctctcactctctctctctcacttctctctctcactcttcctctctctcaccgtctcccgggtcaacagcgacgagggacacggagcggcggcggcggtgagtgacgcagagtggcggcggcggggatgaggagctgggcgcggcttcccccctccctctcggatggagctcggagcaggatgcgatccgaccgcctcgccatcgtcgccttctctggcatgccgcgcgg

SEQ ID NO: 65095 - DNA, 4445 bp, Oryza sativa
ggccccccacgcgtacgccacgtagaccaaaccccccgcgaattaggtcaagggggtaattcgtccggtttgcatagttgggggtgaagaatgtccggttttgtggttcaggggagtaatcaggacgaccgcgataattcggggggggggagggaggggggttattcgtactttttcatatattgtaatcgtagtagtatggtaatcttctttaaacttttatagccatattactaattttgtatgttttaatatgctttattattagtatattatgttatacttttgatctattttattatctataattgcattgtatatattagcatctttagatttactatgtttagaaagaaaattggattggaccacccgtatcttaaatcctaaatccgccatggagttccatactccgacaatcatgatgtgggcagtaagtacaaaatatttttttaagattttcctaaaatatattattcacgtgggtagtaattattatatatgggccttgccccccacattataattccaacataaccatggtgattgttatgggttaggatttatagcgggtaaacaccgcctaccaagttgttataggttagggttcatagggggtaaacaccaccgggaggatagccaggcgatgacagctggtagggatgagagggggacttaggttggagaagactaattctgattcattgcttaatcctatatacctatacaattcatccccactaactgcaattaaaactattttccttgcttctcagtgagccacgtcacatctatcagtttcagccgttcgattcagccacacatcgatctcagacactgatctcatacactcatgatctatcaaccattcaacaagcccataattaccgagctcttacaggcacgttggcttcctcgctccagtatggtcctataggctcttgctatcctgtaaccgctggtgtattaatcgccaaggaacttgagcaggctgtaacggcaaaggtagtgcacattgtgaggagttttaatcattcatcttccatacacatcacctacttgacgtcttcctctatgtatgcttgcctttctcccgcggaagcatagcacgtcgccggcaacccgcatcatccaccaagggcggcctgatgtgtccaacgccataatgcatacacatacacgagttgtcatcccatcaaatactctaatcctccgataatcataggttacaagactcatctcatcccgcttacctatgcttcctcccgttgaatagtctatggattttatttgttctgccaaccagccacagctgaacggcgatgatggcacctttaatttgcattgttcatttccctgtcttcattttccacttctacatgttatttaaatttgagatgatcaatttccgtccatctgctcacttctcaatgtaattggggattgtttgaagaggagaatatcgatgacttctgtttttcttttactgtgattgtgttctccctagcttcatgcagacttggcaaaaattggtgagtcagtgataaaaaatgaaactacactcaactgtataggtctgaatattttgtttcacttgcaggtatttgggttaagcaattgcaggagttcaacgagtcactttggttcgtagttcgtggagtatttatgttcctacggaatcacacaatttctgctgcgcagtgaagctattcgatgagtttcagcctattggtctgcatcaagacattcaggtaaggctatttgttaacgtagtaacttcattcagcctgaaaaggtgctaactacacattgctgtgtgtcggagatatgggcccgggggtatgtgaagtgggggaaagttacctttccatccagccatgtggctctacagcctggccctactcccgcgcctcgtgagtcacagaagcggccgggggggcctcggggtgccacatcgtgcccctcgggctctcccgctgcctcgccccgaggccctcgcctagctgccatgtggcgggaggagggagcaggaagggggcccaggctgaacagccatcaatgcgcagcgccccaactgtccctcgtcacatttaatgcggtaagggcagacgtgcggtgccgcctagttgacccacatcaatcgaacgtgaccagtctgtgaccggcctgttgccggtcacatccgattgaacgggcggccgtgcccccacgtcgcctctgtaacaggcggagtggaagtaggtatgacccgtcccatcaaggcgtcattcagggtttcctccatgagaaaaggaccaccacaagtcttcacccatttatgagggaatgacagggctgtcccccgtgtcaggcggggggtggcgctgggtcccactcaaggacgggctgctgcttagcttccgagcgaaggcacggctcgtggcccggtcaaggtaaggtgggtccccctcccaaggaaggataggtagaggcggtgcatgtggtatccccttgaactataaaaggaggaccttgcccaccgagcaaaaggatgactcccagaaaacctgaactctaggagaagaaggggagaaagctctccggagttaaagaacccttgtaactcttaaccataatctcaaacacaggagtagggtattacgctccacagcggcccaaacctgtataatccgattgtgtgcaagctagctagtagtcttaggggcggatacgcgatttctaagaggcgagcctcttcccccggccaaactcacgaaaggggggtctcacgacctcccgctatcgagggacttccctcgacagtgtgcaagatcactgatttaaaatttagtatgatcataaagtttttcattttaaaggttcactctgggaacattaatgatttgctactcaactaaggcaagagagttacttcactatcacattcttaacactaacagaaactagattgagctgtaactctttaagttgtttcactgtaacgataaggaatcaaggcacgagatgtgatgagtttgttactttcgagaataaactaatttggttagttttatttccacatctgtttatttaaaaagaagcatgtaattttgacaatattaccaaccagcaataacaataataaaccttttcattatatagccttccctttgtttcatttgatatttggacaataagcaatttcatcaaaaaaacgatgcatatttaatcatatttttttagcaatgctacaagattatgtgagcacattagataattgcacttgcattatatgtgggcaagataccttttgtatttttcacattgcacttacaataatcattgagtcccgcaacaacacgcggggtattatcagttagaatgatgatacaatccatccttatatagatggagagaggacccagtctaattctatccaacaaactctatccttatccttagggcctcgatccctcggcccactacccatgacatatacttgtagttggctctctgaacttgattagattcacaaagtcaacaattggtagtagtactccctccgtcccataatataagggattttggacagatgtgagacgtccagattcattgtattaggatgtgtcacatctacccataatcccttgtattatgggactgagggagtactagcaggcaatagcgaccacctgctcaaccagttttttcccctgctcaactccatgtctccatcatctattcatctatcgcaaattcaaatcatagccaaatcactcggcatttggagtgcatcgattttatagaaattcattccatcacatcgctactcgatcctaagccaacgacaaagcccccgcattggcaatggcaatggcgccatcattttatttgcttgtttatttcatcaatttcacgcaacagtgacacgagtacccgatcgacgcgaaggtcgcagcaccaagtcatcaatcaacgagtgacgaaatccacgacgaggtccatcatcttcgccgccgccgccgtgccgggacgcgtgaggtggaacaagtggtcttcccccggcgtgtccaccagctcggcctccccgtgccaccggctcgccacgagcgccgcgtggtacgccctccctttccccgccaggaagtcgtccccggccacggccaccatcaccctcctgcacggcagcgccgccagcgacggcgcgccctgctgcaccgtcgggctcagccgcgggtcgtcgacgcggacgtcggggctcccgcacatgaaccgccactcgcggcggatccggtcctcgagcgccgggcccatggtgttcgacgcgtcccagaagtaggggtgcatcaggagcacgccggtgatccccgcgccgcccgggagcggggcggcggcggcccgcatggcgacgttgtgcgcgatgttcgcgccggcgctgtcccccgcgatgaacacccgcgacgcgt

SEQ ID NO: 65096 - DNA, 3179 bp, Oryza sativa
  unsure (1)..(3179): unsure at all n locations
ccaccgggatgaggcaacagtcgacggctgatgagcatggtgtggagcgcaatgtggctggcgctccagcccatgagcttaatgaggccgacgccgtttgccgcgctctcggcctccacgtgccagacagtgatggcctcctgcgtcaccttcaccgctgtgtggaacccgaacaaccggttgataacgccaacgtgttttccaccgtcttggggatccccgccaccaccacggcaagccgctgctgctggacctcatggtggatcgtcaccgcaccgcgcatgatgttgtccgcgccgacgtcatacacttggttgaacctgtgccactcgatggcgtccacgatcctggtgaggtcgaacccgccgcgcgacgtgccgagcaccatcccgcaggccttgttctagtgctccaccgtcgccggatcgagcgggacaaactcctcgaaaatgaccgtaggcggcagcaacagcgctgtcgccgctggggtgggacagaggaggagcagaggcggcggagggggaggaggatggaggtagtggcgcgcgagggaggagcctggaagggaaggtagcggtggcgcgcaaggtcgccgagggtgccacctgctacccgcctcgctcgtctgcaggaagggaagatgaagagggggagagagaagagagagaggggagagggaagaagggaggtgaggtgacatgtggggcataggttttattatttttccaatatcgaattgccacgtaagtgccacgttaaatgccacgtgggacaaagacgaagtcaaaccagccacattgccatcacatcagctaaaaccaccttccaaaccgtcgagggacctcgtttacactgattttgatagctcggggaccgccggaccagttgtatctggtttttggtttttgggttcaaggacgtgtaaagttaagggaccctcaaatgaacttaatccatcacaccataacccataaatagattaggcctgtctaagacgatagacagattaggtccatctaaggccagaaatgattgaaatggcatggctaaattatggcgtaaagaattaaatggcccaatttcattcacgttaaacgtggcgcaaatttgtttggctaatgttgaacgtagtggaagagtacttgatatacttccaaaatgtggcgactggttggtttgtaatcgtgatagagaatggaaaatgaatgttaggaaaatgtgcaacaaatcattttctgggaaaagatgtccagcttacctagttgttgagtaaacgagtgaacggatgaatttagggatggcaattttgcccatgggtttggttatccgcgaatacccgacccattgggcacgggcgtgggtgtgattttttatccgtgggtacgcccgcccaagactcgtagacatcgtgggcaacagccgggtttcattttttacctgtgggtaacccatgcccaacccgatacatatgtattagctaattttgatttatctcttaattcttatacccctttctcttattcatttgtgatactaactaataataagttgtgatgtaattcaaattattgttgataactgataatttggtaaattattgattttatttttctttattaaattatatatctttcgagttattattcacaaagttttacccgctaaccctagtgggtagggtttgggcgggcgacgatgggcatagggtcgggcatggtttnactcnacccatgnccgacccaacccgttgccatccctagatgaattgatgcacaccctttaaaacactattcaaatcaaattggactattggagtagtggagtgccaaaatttgtcaccaccatcacccagcgcatcaacacagctgtaacataagtaccgggcaggcaaacacaatgatttcaacttgaatcatttgtactctttttctactttttctactttttcttcttcgaaaaagagttcgccaccaaccgtccatccaaaaaatacaccagctatctcacatgaactctagctaaccgtctagactaatctaaagactacaaaagccaagaagaattttgataattggtatatgagttcgtggaactgtaccaaatttgatgtggcgttgcacatccgaacggagttcctgtctcctgcaggcagtagatactagatagcctgtaggcagctcatacagtgatgacacctgacatccatggcacaacaacgggagcagatggatgagcatccctgtacgactcagaatacctgtctttgaagttcaatttagggtgatcagcctgcaagcatgcaaacaatgaattcaaagttacttcgctattctttggcagtatgaggcccaatctttaggatcaacatcaaatgcaggttcatctgaaaggaattgtcagtgaaataatccacagaaatattacagttaaatacagtactttaagataatcggattgcatttctataacctttattggcaaagatatgataaaattgcataaaaaatagtacaatattccccgcaaaaaaaaatagtacaacgcattaaaacttccatgttgcaaaacaagattctcctacaaccgcaagtaactaaatgttgaatagcatcatgaattcagtattggagaattcaacataccaaccttgccactttaagtattgaattcgctactaaattaaaggcagcaaaagtactgtgccatactttaccttgtgatctaaaagttacaacttatgcaccagcctgtccagccatgttccaatattcaggaactggaaactgcttagcttaccaaattttgctaatgtgagattttgctgttaccaaattgatttggtttgtttggcaaacaaaacaagcatgtcctccaagccaccacaaccaagttacaagcagggccatgccctaagatatgcatgataacttctaatatatccaccaattagattcaatgtatgcagtcatttttaaatatagaggacaaaatagttatatggaaagaacataacaggaactgatgagtccctctatttttaggtataattttcagaatcattatctccaaagcagaataggaagtacccaactaccccgtcatcaaatataaaagaagacaacatgatgatacctgtttcaaccagcactcttgatgtttgtgttcatatttatctggcg

SEQ ID NO: 65097 - DNA, 1878 bp, Oryza sativa
ggctcgtacatggtgcagcagctcaacaagcacccgggttttctctactgccacatggtgagcccaagaatggccatcgtggaaggacgcaggaagatcacccatggcctcctgccattccggaagctgttcaatggcactttcatcgctgccggaggatacgatcgggaggaaggaaacaaggtgatagccgatggatatgctgacctcgtcgcctacgggaggcacttcttggccaatccggacttgcccaagaggttcgcgatcaacgcaccattgaacaagtataataggtccaccttttacatacaggatcctgttgttggctacacggactatcctttccttgatgagaaagacgagggcgctgctacttatgcttaatcctcaattaaattgtcaaattgaaatgttcggtttagtaatgtgcactatatttgtgatacactcataagtgaccctcacttccatccatcccccttttttttttatgtttgcgtatatcaattttttgcacctcgaggtgaattttgtttacgtaggtatgtaaccatgggcatgatgggctgttgtcaagcctgttgtggtttgatgccaaaacttacccaaccaaataattggcactttaaataataccttataaatatttagattaatgccaaatttaccaaatgtaatgcaactcctataacccaactctactaaaccattagaagtgtcaaaatttacccatgatttgacactgttagagtttgtgtcgaatatgtgtatgtagtcggttacagtttaggacttggagttgtaataggtattaggactagagtatgagtcggactctatcctaggatctctcataaatagaggggcgtgcctgttgtaaccgcatggcgacttagcatagcgtgagggagcggctgccggcggcgaccggctgtgagtcgttgtaactctgatacgttgtatatgctggatcggggaggagcgtccgtaatcagtgccccaaagatgtaggctacggcaaggtataacctttcgctccccggggcaaagctgcttcgcaccactgatagactacttaattaagattccatttcaaaggcactactttgtttctcaagcctttgtcattgtcagtcaactaaggttgggcctcggccccctgcgaatccgtaaatcagagagcatgccgcaaaaaaaaggatgtaccaaatatcatgtctcggtgtcgctatcattttggatctcctatggcgttttcttccgcgtttagctaccgatgtcgatttcggggctggttttataacaagtggtatcagagcttgcgggaggtccatggtagaggcgcgatggaggtgcttcacaccgcgccgctcgtggtttatgtccagggagggacatgtgcgcaaggtagagcacggcggcgatcaacggaatttgatcggtggatcgaacacttcaggcggcggtctgaaccgttcgatggctgctttcaacagggagatgactagacgtggtgctctggttgatggcggcagaagcgattggtgatccaattggtgggtcggacacttcgagcgggtggctcggactttccggtgagctactctcaatagggagacgtgcggccgcacgctcgggttgattgaagctggaggcgatcggcgttctcggtgggtggatcgatcactctgggcggggtggcctgggcctttcgatgagttgcgttcgacagggagacggctaaacatagcactcgggtcgttcgcggctgagaagacggcatgcaacttgtcggcttcggctcgcgactagattgatggtgtttaatcggaagtcggagcgggtggttcctagaggcagcttttgaaggtgttgatg

SEQ ID NO: 65098 - DNA, 1725 bp, Oryza sativa
tggtgctcggctggtcagtggggagagaggcacggcaggcgctgggcggcggcgccaatcgggccgagaggagtcgggcagaaggagcaagaaacgggattcgatttggatctgtaaccctttgaccgcatcaactgattctttgaccgagtaaaggacacctgttccggttttttggagagagaaaaaaaaacggttcggtccggctggtactgttcgagttagtcggtggggtcaattaatcagggcagatcaatttaatagggcaacatctgttgagttgattatcatcgatggcggcgacggtggtttccaaatttgaggtggtgaagttcgatggcaccgggaatttcgttctctggcagatgaggctgaagaatctattggctcaacaggggatatccaaggctcttgaggagacgatgccagaaaagatggatgctagcaagtgagaggagatgaaggcgcaggcagctgcaacaatacgcttgagtctctcggattctgtcatgtaccaggtcatggacgaaaaatcaccgaaggaaatttgggacaagttggcaaacctgtatatgtccaagtcgctaacgagtaaattgtatctcaaacaacagctgtatggtttgcagatgcaagaggagtcagatcttaggatgcacgtggacgtcttcaatcagttgattgtggatctaagtaagttagatgtgaaactggatgatgaagacaaggccataattcttctgtgctcgcttccaccgtcttatgaacatgtgtgactaccctgacgacggcaaggatactgtcaaaactgaggagataattttgtcgttgcttgcacgagacttgagaagatcaaagaaaacgaggcaatggaggcttctcaggctgagagtttgctggtcaaggcaaagcatgatcatgaagcgggggtgtcgaagagcaaggagcatgatcatgtttgctataagtgtcatgagtttggacatataaggaggaattgcccattactgaagaagaggagaagtgcgagtgcaagtttagtagcccatagtgatgattcagagagcagcagtcatgagattctcacagtgtctaacgagaagtctggagaagcgtggatgttggactcagctagttcctatcatgtgacatcgaagcgggagtggttctcttcatacaaatctggtgattttggtgctgtttacttaggtgatgacacgagttatcgtgttgttggagtgggcgatgtcaaattcaagatgtatgatggaaatgaggtgctactttcatatgtgagacacgtgctgggactaaggaagagtttgatttcgcttggaagcctacatgagacgggttggttgtatcaggtggattctgataggaagcccatgaatatcatgaaggatggcaagactgttatgactggtgagaggacaagctcatgtttgtacaagttacaagggagtgctgttgcaggtggagtcatggaaaatggttatgctggtgttgctgtgcacgatcctgaaaaaagtgagcctggcgtaggctcgtcgggcgactcggcgtgagcggcggaagaaccaactcaagtcctggtacacggaggttcgagcaagtaacagattcggattggcgtggcatatttgccaaggtggagtttgttagagtttgtgtcgaatatgtgtacgtagtcggttacagtttaggacttggagttgtaatagg

SEQ ID NO: 65099 - DNA, 759 bp, Oryza sativa
catctgcttcaattcattttcattccaggtagtcccaccagatcaggcacgcaaaatatacaaggccttaaaagagaaaggtttgcctgttgccttggtggaatacgaaggagagcagcatggtttccgcaaggtaccaaactgtatcacttgtctctctatagtctcaagtctctttacaccctaaaccctgcgataaggttgtgatggagtatgctcttccatttgaacaggctgagaacatcaagtttactttggagcagcagatggtgttctttgctcgattagtcgggaattttaaggtggcagatgatataactccaatcaagatcgaaaactttgactgatcgctcgaagaaagtgtagcagtagcttacatttcgtggaacatgacctcttacagtttgcatctgtttgaattgtccatgtactccgactaaatgttcattaaaatcaatcaatgttggagtctggggcaatggaatcgcatatttgagtttcggaaactccagaaatcgcccatattaggcaacaggagacacatccatacctaactttattttaatagaccattatttcttctgagacaagagtcatctataacacaaacattcggccgggttttttttttttttttttttttttgagaaataatagcctgggatggacttgaaacaagttcggaatgcaggaaaatttttaattaaactgaagtctgcatgttagcttaaatataagccttagccaaaattttaattt

SEQ ID NO: 65100 - DNA, 1045 bp, Oryza sativa
tactgcatggatccgcgctgcgagagagcgcgggagatgcaggcgcgcatcctcagcttcctccgcaagtgaagctcctccacgacgcgaaggcttcgccatgatggaataattctggcgctttgtgatgccgccattgttgagctcgagggctcctgtagcttgtcgctcgtcagttcaggcatcttttgtgccaattgacgatcttattcttcaagagttggaaatcatcgaacaaattggaaatttctattcgaatcatcaatcagttatcatataagaataagttgcattttgcaccagcacaacgcacatatttagcaaataattttcactttacactgggttgtattaaaataagttccatttaacatcatggtatatcaacaaacaataggatgcaacatagtgcaaagtgaaatcttgatgtaaaatggatgtactacacttgttacaaagcaaaacaagatacactctacctagtgcaaagtgtaatttacccatcaattaatcaatcacaaccttgcacaaattatagctgaagtttagggtcaattatttgcaaatgattcccttccaattgatttggagggaatatgattgcttgccactctgtggaggtgcatttgatcatttctcatcctgctcactgtaacaaattattcactagaggttattaatgtcatggtttattccaaataacacccttaccctctttgtgccgtcatggaatacgagacagcatttctgcatttgtagggacaaaaatgtctataacgccaaacgatcatatttcgaatcaaattagtataaattccacaggtattacaaattacttcgtggcaaataatggtagaagccaccacaacaatatggcaaaagaaaaggaaaaagaaaaatttccccatcttatttagattagactaaacacgctccaaatctgactccgccgccggcgatcttcatttcttgatgaattcgacgttgcgctccagcagctcgacggcctggtcggagcccgccatgccgacgaagtggaacgcgt

SEQ ID NO: 65101 - DNA, 2523 bp, Oryza sativa
acgacggggagtttctcggtggacacggcggccccgggcgggaggtacacgcgcgccctggcggcgccggcgtgaatgtcgcgggagacgacgcgggtgacggggtcggtgccggcggggacggtggggtccccgccgaggcggaagacgcgcccgctcttgtactggcagaggtagggctggaagtcgaaggcgacctcggagtcgggatccatggcggatggggagcggttggtggccggatcgggagacggaaatgagttggccacctgcaacaaatcgagctggaaacttaaaaagaagtctagttcacttcaagaagttcaacgcgggggagagagagatagtgggagcgtggttggtgagggtagagacttgcggcgagtggcaacgccgctttctcaactttttatttccccatttggtgatcggtgaacaacttttataattattttccccatagtatgacccgctcaaaaactaattactgctccctccctttcatattataaatcattttgattttttttcataattaatttttttaaaaatttatagaaaaataattaatttttttaaaaatttatagaaaaaactagtactccctcaatactcataaaggaagtcgtttaggacaatgtttaaatcaaaccttaggaatataaatcataaataactctcaagttgttaagtttgaaaatataaaaattatatgtatagatttttcttgaaaaatactttcataaaaatatacatatatcacttttcaatatatttttatagaaataagaaatcaaagttgtattttagagaccgtgtcactatcctaaacgatttcctttacgagtatgaagggagtatcatttacaataccaaattagtttcattaaatatactagtaatatgtttgtgttgaaaatattactatatttttctataaacttgatcaagtttgattagaagaaaaactaaagtggcttacaatataaaacaaaggaagtactagtattaataaagactatttcttctcgtgtttatttagatgatgtgagaaccgattacgatcgacttctgttcagtgaggtcgccgcaactcttaagagctgaacaaatacaaaggcattcaccgaataaatcggtgcaagttggtgacagttcttgaagatgggtgggcgatggcactagttgcaggcttgcagctatccttggacttttttttttgcatgaagttcacagccagccctgtctggatccccgaccgactatccagcatggtacacaaagacaacagtattttgacggtaaggagattgattaactgataaaaacggttggtgaacttggcatcatccatttggtcagactgccaacgacccaaaagccaacagagcaaaaaggaacggctagaagttgaaacttaggctgtgtttagttccacgtcaaaattagaagtttaaagaaattggaacgatgtgatagaaaagttggaagtttgtgtgtataagaaaacttgatgtgacggaaaagttagaagtttaaagaaaaaagttgggaactaaacaatgccttagtggttttggtggttgggggcttaagggaagacagccacaacaccgccagttaactgaggcgggttaaagggctcaaaccagagattttataggattttcataggaatttatccaaactcccctaaaaatccttataaattcctcacttccaaaggatatattagttccaggctacccccttagagaccaccatatggaaatccttgtactaccaatgagtaatttaagcacacgtagcaactgaagagcgtgaaaactcaattcaagagatgtaaagtatggaaaaaaaaaacccgctacctgatatgattttcaaattcatacacagtattgatctcaaaatgttctccagatcatttgactcagaggttgatactttcccagtttccatacatagtgtaacatagacaatgttattgtcatgggcttgttagcatgctacttactgcgttttgcagggaggcaagtgaatcaactgcagtctttgtgaaccaactgattccaaccttcactcgatgttcatctgtgggcatcctaaggcagtatacaatcttcctagctgcagaaccaagttgaatgttattcttaaacgtaaaattatgcaaaaacaggaaaagaacatgccggtgaggattcataccagcatgccctaaaggtccttccaaggtcaggccctcaataaagcttgctgttatcgcagcatcacttctaccaagtgtcatcatctcaccaagattttgaaacctgaaaagttacacaggatatttagctcttctatgaagttcaactattcctacagacatgacagaacattagcattaaaaaagaaatgaaaatccttagtaatcctgaatacgtcaacatagacagttcagctagatttaaacctgaatggcagaagaggtcggtcattgattgctgcccagagattccatccagcaaaatctgcttg

SEQ ID NO: 65102 - DNA, 816 bp, Oryza sativa
ttagagaagatcgcctccaaggagcccaagaccaccgccgagctttttgagctggcggacaaggtggctcggaaggaggaggctgggcctggaactctcccggcaccggtgcggcggccacagctgcccccgagtctgccccccgctctaagcggcgagataggaggcaaaagaaagccggcccgctctgatgacgagggccatgtccttgcggcagatgggcccgcacgggccccgcgcaagggaaaggccaccgatgacaagccgagctccactgctccacccagcgagggccggtcggcagacaagtggtgctcggtgcacaacacttatcggcacagtctcaccgactgccgctcggtcaagaatttggccgagcgattccaaaaggccgatgaggagaagcggtagggtcgacgggagggcaaggcccccgcgacctcaaccggtgatcggcgagaagaggccaagaacaaggcccccgcagatgatggcggtgacaatgaggatctggatttccagatacctcagggaaccatcgccacgctcgaccgggggggggggggcgtgcgctcacacctctcgccggagcttcaaggccatgaggcaagagcttttggctgctgttcccacgcacgaggtggctcggaaggcgcgctggtcggaggtgaagctcacctttgaccagagcgaccatccgacagtgctcgctcgaggagggaagttggcccttgtggcctccccgaccattcacaacgtcaggatgaagcgtgtcctggttgatgggggagccagcctgagcatcatttccccagc

SEQ ID NO: 65103 - DNA, 2243 bp, Oryza sativa
cctgcgaaagaggcgatcccgctgctgacgccgtacaagatggggcagctggagctgtcccaccgggtggtgctcgcgccgctgacgcggtgccgctcctacggccacgtgccgcagccgcacgccgcggtgtactactcgcagcgcgccaccaacggcggactcctcatcgcggaggccactgtcatctcccccaccgcgcagggctacccggacacccccggcatctacacgcagcagcagatcgaagcgtggaaacccatcgtcgacgccgtccaccgcaagggcgccctcttcttcctacagatatggcacgtcggcagggtctccaccacaggttcgtccacttgctggtggttggttgattttttttcaaaggtcattgcaaattgtgctcgttggttgattaattaaatttcgaaatgaaatcgacagatttccagccaaatggacaggcgccgatctcaagcaccgacatgcagatcacaccggacgattcagggatggtgtactccaagccccggcggctgcgggccgacgagatccctcagatcgtcgacgacttcaggctcgccgcgcggaacgccatcgaggccgggttcgacggcgtggagatccacggcgccaacggctacctcctcgagcagttcatgaaggacagctccaacgaccgcaccgacgagtacggcggcagcctcgagaaccggtgccgcttcgccgtcgaggtgatcgacgccgtcgtcggcgagatcggcgcccaccgcgtcggcatcaggctgtcgccgttcctggacttcatggactgcgtcgactccgacccggaggctctcggctcgtacatggtggagcagctcaacaagcacgagggtttcctctactgccacatggtggagcctcgcatggccatcgtcgacggccgccggcagattcagcacggcctgctgccattcaggaaagctttcaagggcacgttcatcgccgccggtgggtatgaccgggaggaaggcaacaaggtgatcgaaaatggctacactgatcttgtctcctttggaaggcttttcttggcgaaccctgacttgcctaagaggttcgagcttgatgcgccattgaacaagtatgatcgcaacaccttctacactcaagacccaattgttggatacacggactaccctttcctcgatgaggatcagaacaactcggttgctgatgcttagattttgtgctattttagttgttggttctatatatccacaataaatatgtgcacgattcatgtaaacagtgttagtatatgcctgcgtgcaagatgtcattttcttctctcttttttgatggtttatgtctgcaactaattcattttgatatttgattagttatgcatccaaatatattgggattaataaacgcagatgtattcacaccacatgagaaatatatgtgttcttttgtaattttataagttgatgtgctgtccttttttttacatcccagcatgggtcccttttgaattatcttgttaaaaaaaacttttctctctttgaatttacttagcatataaatccaaattaattccaaacaatggtttccatcacttgtgcaaatttttttttgtcacaattccaaattaaataccttaacttttatttttgataatggctagaaatccatcctctaaaacctaaactgacaatgccgatcgtacgaattatttttgggcaagcccttaagacactttagcatacatgcacacaaaaaaattatacaattatgggcctctttatagatgatattatgggcttctgttgaaatattttagagggtgtatgtgctctctggtcgagatgaaaagaagacatgctcatgattaaatcatttgagaagttcttatcatttaacatcagattgccttttatggttttattaatgttgtccatcatatatgtatattttttagagcttctatgttttcttcttgccccagcaattgtatcatatatttttgcttaggaaaaagtacgaatccctccccaactatcaggtgagtacgaattatccccctaaacccgaaaccagatatttttcacccctcaactatcgataccatataaaaaaaaccccgaccagctttgtaagcggttttggtctatgtagcagtctagtcagtaatttttttattaaagaaacaatgggccctacctgtcggatatctctccactccatgtcttcccctctcacccacctct

SEQ ID NO: 65104 - DNA, 1923 bp, Oryza sativa
tatttcgtattaatctatgttgtcaatttttttaaaaaaatttgataactatttagaagacatgcgaataacgagggatgtcgctggatgaaaatccacatccgaatttgccgtgtgtttctcatcctgcatgctctgctacaggtttccagcctgacggattggctcccatctcaagcaccgacaaggcgatcacaccggacggctatgggatggtgtactccaagccgcgacggcttcggacagacgagatcccgcaaatcgtcgacgatttcaggctcgctgccaggaacgcagtcgaggccgggttcgacggtgttgagatccacggcgcgaacggctacctcctcgagcaattcatgaaggacagctccaacgaccgcaccgacgagtacggcggcagcctcgagaaccggtgccgcttcgccgtcgaggtgatcgacgccgtcgtcggcgagatcggcgcccacagcgtcggcatcaggctgtcgccgttcctggactacatggactgcgtcgactccgacccggaggcactcggctcgtacatggtggagcagctgaacaagcacgaggatttcctctactgccacatggtggagcctcgcatggccatcgtcgacggccgccggcaaattcagcacggcctcttgcccttcaggaagcagttcaatggcacgttcatcgccgccggagggtacgaccgggaagaagggaacaaggcggttgccgatggctatgccgacctcgtcgcctatgggaggctcttcttggcgaatcctgatctgcccaagaggttcgagctcgatgcgcccatgaataactacgatcgcaacaccttctacacgcaggatcctgtggttgggtacaccgactatcctttccttgacgagcatcaccatgacgacgacgatgactctaatgctccttctgcttaaaaccagtcatgcaactcttcaaatcgatcggcatcaataatcaataatgcaggcacccgtgctatcgatttcactatttaccgctacattttctttaagtgatttatgtactcttgtactattgtttatgtttagtgtgagaagacatcaagacatgcatcatgcgtgtatatatttactggaataaaacacgagttatatgaacaatgattttgttttatggacacttctattatgcgaaagtttgctactccctgcgtttcaaattgcaagactttctagctcattaatatgtactctccctccgtattttaatgtatgacgacgttgactttttgagcaatgtttgaccatttgttttattcaatttttttgtgaaaatatgaaaatgtttatgttatgcttagaaaacatttgatgatgaatcaagtcacaataaaataaatgataattatataaaacttttgaataagacgaacggtcaaacgttaaaaaaaagtcaacggtgtcatacattaaaatatggaggtagtatatgaatgtggccaattctacgaagttttacattgtgaaatggagaacatgcctttggtctttggtcttcccatcctagaattaatcttcttctcgttctgtccatcctttatttgaaatgttttagtttcaaatgtactagcgtttcaaaatctttatcgattagaaagtttgaaagacgtgctcatgataaacgagagaattataaaagctgaacgggctctcaagcaaagtcttagcttaagtctcgtttgcatagccatagttaaaaaaaaaatagaggtactctagtaaatcaaagttgtgctgagcaggcctggattcggctcctctgactttaggagcaaacggcaaaggtgcacagtaaaatgagtctagtgccgtagttaagaacgagaaaacggacaatgtacacttaatagattgggttcagatgaaatgccacttaata

SEQ ID NO: 65105 - DNA, 2098 bp, Oryza sativa
gggaagcggcaacggcgggggcagggggaggaggccggcgcggcgagcagcagtgcctaggcggcgagggctccgcagtgctccccggcgctcccctctcccctccccgtccagccctccccagcgctcccctcttcctctctctcagggacattttgggcacaaaaatctttaaagtggcatttcatccggtaggcaacgtattgggtggcattttatctggtgcattgtattgagtggcattttatcttaacacaacctatagagtggcatattgtccgctttctcgttaagaacagtgatatgcagtttttactgtagaaagtgttaaggccctctttgtttaggcttaggcttatcggcctagacttttaagtcagcttattggcttatatgatttataagccaatggatttaatgtcctaagtttagtggtggagtcatacatctatctcatataagctaaaaaagcttctccaacctagcttttggcttaatagtgttatagtggcttatggcttaaaaaagccaaataaaaaagctgcttgtttgttttggcttagacttttcaacttataagttggcttataagcctaaataaagagggcctaagtatactgtcaatatactgtttatggtgcactgtagagattagtcttgtccgttcgctgtctatcggacggctgagaatacctcaaagtcgtaccaccgagcttctctaacttcactggatcccaaattcccaatcgaggaggcctagcgtggcctccatcgtttcgctttttttttaataagccaaaacggcttattagtgaataaaattgtatttgtaggtaaaacttttatatacgtgttctcggtgacttaaaagccaatgcttaaaaagaaatcacgttgaaaatatcttaaaataatctcaaaattaagtttgaaaattcaaaatttgcctttttttttcttattaggccatccgataggagtcgttgttaccgaagtactgttctagtaatacagaaatttatcagtatcctattcattcttaagttcttaatgatacccgagttggaccgatgagccggtggcggtgaggtacagaagactagaagagtagtggagtttacccgcggtcttgacagcaacgccgctcacctcacctctgctctcctccaccccgcaactcccggcagccgccacgcgcgcgcacgcacgccctgtcgcgatgcactcgcaggcttccgccgcggccgagaaggcggtggtggcgccgtacgggtcatgggagtcgccgatcagcgccgccgccgtctccgccgccgggaggaccgtcgaggggctcgccgtcgccggcgacggccgactcctctgggtcgagacgcgccccgaggagggagggtacgcgacgcgcgccgacgccatccacccccttctcgcgtggtcagattgctctcctgatgctgcattttttcttcttcttcagacgagcggtcctagtgaaggaagcggcggagccgggcggcgatgccgtggatgtgacgccggaggggttcgcggtgaggtccctggcgcaggagtacggcggcggggcgttcgcggtgcaaggggatgtggtggtcttctccaactacagcgaccagcgcctttacaagcagaccattggaggtacaccgaacaagccgcgccattgcagcataccgtactctttactgtggataatagttggtgaactcgactactcgagctcgcattgcaccaagtcttaggccttcgaatggaagtcaacggaccaggtctggtgcagttgctgttcttctgctgtttcacaaggactgcaccggttctcagttgtagccttgtaggttggtacattgcccacgcagcctatgatggactacctccgtctcaaaatatatcaacctaatactggctttgtccagatttactatgttatatcctatccaacgctaggttgctatattttgagacagaggggtagtagctttgaggaaaatggatcagaaatggtacgattgagtggaaaacctgagcaggtctaatgtctgcaattcgtgaggcaccgctgaaaatttagttgaaatgt

SEQ ID NO: 65106 - DNA, 1556 bp, Oryza sativa
catttgtgaggactgctttttataagaggttttgtggggtttttgcggtttatagaacagtggaggatacgctccattgttccactctagcattcgcagcgagatccgctattgcgctttgttaaatttttttagttgttcatttttattgcgctttgttaaattttcttagttgttcatttttagtgcatttgatcaatgctactcaatttgtttctaaagaaatatatcaacacaatggatgcctcgctatcaacaatacatcacctatcatcgaaagaataatatattataaatataagcatctatgataagtctagagcttaatccgaatagataggttgcaccataaaaaactaccagctacgctcacttcgcaatgttactcaaccattactctgtttcgaatcatatcatcctacacagaagtacttgaaatatgcttcatgaaaacccttaaccccagccaaaatagcaaataggcgaaggcctctttcggaatgctgaaattttccccaattcctactagaattataccaaatttcgtaaaagtcatataaaattcctgcaaatgtgctacaatgtgaaaacgtgggagaaattctagctaacggaagcatttattccattatattgaccagagtcgtatgcaaagcttcaagagattatttcaaactacagctaggacagcgttgctccagagttccctcgagttgttcccagaagttgattaggtgacgaataacttcttaacgcttacaaggagggttcatcaaaattgtcgatcttgattggagtgatgccatcagccaccttgaagtgccccactaatctagcgaagaacaccatctgctgctccaaggtaaacttgatgttctcggcctgctccagaaatgcaagtcagatatgtgcctatgtaaaattgtctatttactggtctaaaagtttcatatactgaaaaataatatatacagttagccttcaatccttcatggtaaaaaaaaaaaaaacaattcggtaggaaatactcaacctgatacattactaactaatatataagtttggtgttgcaaagataaagacaagaggtactcgtcagaccttgcggaaaccatgttgttccccttcatactcgaccaaagcaacaggaaggcctttgtcctttatggccttatatatcgtcgttgcctgaactggtgacacaacctgaagatcatcaaagaggtgaaaagctggtaaggagaaacagaatgtgggaaatgcacccgctgctaagtcactcttagccgattttcgttccctctgttctgggttaacagattacatttgatttatcgataggtaactctatctgtaagtgcacttcctagccatatacatattgatcatgggacacgaggactaaagtgcatcagtgataattaaatacccttcatttttgtttatatgatgttattgctttttgtaactttgtactagtacagaccgattatattataatgatttggaagtttctttaaagacaaatcagccaaataggtttcatactgaataat

SEQ ID NO: 65107 - DNA, 1303 bp, Oryza sativa
ttgggttgaaaatgttactacttttttctataaacttagttaaactttaaacagtttgactttgaccaaaatcaaaacgtgttataacctaaaacggagggagtaggagtttctttcaaagagtacatgggcgataccacaagggaaagataagtttcatgtaggtgactatgcaagtaaaatcatttctcacataatttctcttgtgctcgatgtagctacattatcactatttcaaaggtgatcgtaaatagtatccaactattggagtataagtgaattgtccatctttcttcatcaacttaggctgttggagtataagtgaattgtctatttttcttcatcaatttagccacatgatcacaattaatcagtgcatataacttcatatggtatgaaagccacatatcttgagcttgttggacagttggagtatatattcattcctgcctttcctcatcagcaaacactctcactcatcagtttatactctcatgatctgcttgttagcttattaatagcagccaaaaatatttagcatttaattttggatgtgattttgggatgttttcgttgtagtttatttccaagcattgagttttaaaccgctaagaatagaaatataaatattttatctttgttggctcgtttatttttatatggattatcagttggagctcaaatgatcatatgcttaattttttggttgaattggttgctgtatgcaactcaatattaacaatattttagaagtaactataaaacatttttcctactgggtatcatcctcttctgcagcatgtagtgttttttcctggtaaaacaggcacgccgcagtccaataatttaagcatttgcgtggatgcacaatctaactttagaacaaacgtccgatatgctggactgcgacaatgatcaagcgcacattagcaaataattaaccatttgtcattttatatttcttctattatgtatagccatataaactatatctaaaaaaaattcacataaagtacatgtgtatgataatacggtcaagctcgagaaagagaaggaaaccaaacaccaaaaacaaaaatgttcggcacattttacatggtttcaactttcaaataagttttacaaaattatttccaagaaaagaaaaaataagaagaaaaatgaaaaaaccaccacctcttgtatggacaatggcgagcaatgaagctaccgatcgccatggatttccttcaccctttggtcccaagcttcgccatgccgccatggccgtggtaccacgagcttcctctgagccctctcgcca

SEQ ID NO: 65108 - DNA, 2363 bp, Oryza sativa
gcacataagttccttttttgaatagctgaatgaattaaatattgtaatgttaaaatgaatttaaaataatattgtaagaaattcatatatagaaaatttttagtaccgattacagctcgaaaaatatgcacattcatccgatccatctttaattaatcggaaaagttatcgtgcaagtattttgtgcttgccagggctctaaggagcagataaagaaaagttttggcgatagtgatatgttaatatgatactgtcaactataaacaatggtttagacagcgtggttttcatggactaattcgcttcttttataaaagctttgattggtgatgacacgggtgggaaatcgattaaaaatcagcaaagaaacggattgccactttctcatgctcctctgactcgcatgctcctagtgatcccaaatgccatgcctacttgattgcatagatgttttattatgcttgaagcatactggagtctggatgcacctttactttaagaaaaatcaatggctgaattattatatatacagttgctcaaaaggtattagaagagtttgtgagtgatcaataactggtatctttaattttcaagtggatttaattacgcctagcaaagagctgatcattttagactttatcgacattaaccacatcacaagttgcatctccttttattggggtgaaaatgaaacagtagtagtagatatcactgtgcagttgaaacggtaataggtcagctctttggctatcctctcgggtcaactggaaaatttctgaattttgacaaaatctcgaatgcgaacatcacaaaattcagtggcaagcatcgattcattgacatgcaaagattgaaaagttcagagtgtgaagactctgaagttcttgagcttgttgtgctaaataaaaatgtccactctaccttgtgtcgtaatttccagcttttctgtaatcctctgatgcatccttttttttattcagactacgagatcacaaaaaacttctgctagaaggcatctgggaaatgttatttaagtttgtggtttgaaaaagcaattgtttgtatttcagtgaacttcttggaaacgtttttttgcttgtttagactgaactctgaatatactacgtggcaaatattagagccaattgcatgctgatcaatttaatctgaggaaaaaaaaaagaagtatgcatgttgactaaacatttttatgttctagctgtcttacaagaacaggtattccttgtcctagaacgccactaacacggggtaaattcattgacgggtaagcttgtactgaaaacgctgacaaaatagaacgttctttaggcagttttgcagtaccatgccgctgacgaacgaagacctcttcaagagaatttcccttccgtggtttgatgcactctaaatataaactacaactctttctgaatttttctcattcactgtttcaaacaaattattaacctgaaaaaaatatcgtgaaaatttagaaagagttaattttcacgatattttttcagctggtggtgagcaagttgcttcaccatagcggtgagcaaaaagaacacgaacttgtcaagatcatgtctgtcccttcgccgtttgtcaggcaaggaaaatctgtagctactgatcatcctcaacagatgtctgctctcctaaacaccgaaaaaacgaatccaaattgctgcagaattaaattcgccggcgccgtgtctggcctttaatttgcttccttgcacgtagcagacgatttcgctcgagtcggcaaaggaaagttcttcgcgcgcctaactgaaaccaaccccatcgtcgtgaattcacgatcgcgtagtgcgtgtcgtgagcgtgtgaaacggcttagttttttcagctcggaaacggaccaatcgcctttgacgtgtcgttgtctgtctcgatctctctcttgtttggtgtttctgaacttgtgctccctgcattgacaagtctattttgactggaaagacgctaaccgctcgaggaagcatcaagcatggctgcatgggttgtgactagaatactagtatgaggagcataaaatatttatcatcggttttgcgaatatttgacgtgtgaagaaatcaacgacaattgcacatgcacacatacaaatcatgtcaaatactcgaccgattttgggggccttcatatcttcttacatgatttgtgctccatgacctctttcttctattatctaaaaaaaatgacctctttctctactccggtggtgaattaccatctgattaggttttgggtttaagtaggagagggttgtgaattgggttgatgggaggtgtttctcggcttaaagggatggcgaggaaatggtggcgtcacct

SEQ ID NO: 65109 - DNA, 1576 bp, Oryza sativa
gaagcccattaaggcccatcgcaaaaaccagaagcccattaaagcatcagctaatcttcccggagaggcagagacggctccacggcctccgctcgctgtcttcccggagacgcctcctcctcctcgcttctcttcccctctatcgtcgggagctgcgaccggaggcgcgccacgtgtccctctcccctccccgccgatgagctgccgcgcggcgccgtgggggcgcccgtcgctccccggcggccggccctcccccggctcggcgcggcaacgcggtccattcggtgagattcacgagcttagctcgtcgcgcctactacttctctgtactttacgctgctgtggactgcggggatgtgttgtgatgctgggttagggtttacgtcggatgcttcaaatcttacagtagatggagcagttcccgcgcgcggatgtaccatttttagaacagaagttcaaaacattgggttttgatgtttctgaactactcacaagtgatttcccaaatatgaactcaaattgatttttgagccccagagtagttacataagttgcgggagcattcgtaggacagcaccatttgttggtcaaatgtatcgcagtttccagtgatttcatattccaatttgaaagggggtgattaggttaatgtatccgtcaatctaatgggttagcactttgttcctgacaggaggtttgaatgtatggaggaattcaatcctcaacaattcatggaggcttggtggtacgccaatgaagtttggactaccatctagattgttcagactcatggcttcaagtagctcaggagatggtggtttttcacggccttcatcaactgatgaagggccaatgccaatatactcttggccggataagcaggtgattctttactgtagatatccgtagttgagaaccccctgttatttggtggttttccttttcattttctttgcgagttggttttgttttatatgtttagttgttcgccaaattctctatttcatgatgaagcataattcagtatatggaaatcccaaggggacatacttcggtacacttgattcagagcttatgacatgcattaaaatacagtgtgtagatactcacggaatatagttcaatttattataactataaatcaattggcctatactgatggtgtcttaagtgcatgttttttgactcatgagttaatttttttcatatttttgttttgtctatgcatgccaggctgtgaggataaatgtttgaggaaaagttagatttacagcgtgcttatgctataaccactatatttgtataattgtattactgaatatgccctcttccttattttcagcgtccacgagtgtgcatcttgggtggtggatttggtggcctgtacactgctcttagattagaatctcttgtatggcccaatgataagaagcctcaggtaaaatgatcatgctcttatgctggaaattccatttagatttgcagagtgctatacctgtttttatatatcttgatacataacggtcatagtggtgttcgcaatttgacaattttatcagtgactcatgtgcactcg

SEQ ID NO: 65110 - DNA, 760 bp, Oryza sativa
ttaaaaacaaacactaaaaaaaattatgttgaaaatatcagtgacagtcacatatctgggcgaactcctcctgcggctttctttctctgggcctaattctctaggctgcgtacgtgagttaggacactcgtgggctccgttacggcccaacttaaccacgtgaaaactcctcccacaaaacagaaaaaaaaaagagtaagaacaggaatgtgaatgcgacgactgcctgctgtcaactgaccacctggcagtgcaacgggtggcgcacagccgagcatgctccaagcggctattaattccgtgtttaaatcttttaatccgcgtgtttaaagctttaaattcgacagctggtgagttgttaataaagccttctgccatagcgatagaactctccaggctccatctcagtagctgacgtcaccaccccagcgtccacacgcgcaccgcatggcttctaccgacgccgacgccgacgcggtcgccgtggagctcctcccgttcatccgcgtctacgtgagcggccgcgtggagcgcctgctcggcaccgacacggtcgcggcgtccctcgacgagcccacgggcgtggcttccaaggacgtcaccgttgacccggcgaccaacctctccgtgcgcctctacctcccgccggcggtcgccgccggcgagaggctgccgatcctcgtgtacttccacggcggcggcttcatggtcgagtcggccacgtccccgacgtaccaccgctacctcaacgcgctcgcct

SEQ ID NO: 65111 - DNA, 13788 bp, Oryza sativa
acggcgccataagcgggatcgctgccgccgccgcctctttcgccgctgcttgcgcttgcaccatgttaactactcctagcttgattcttgctggtttttcggtgtggatctcgcgatgccaaaaacgcccaaaatgctctggatttctctcggtttgtttcttcctgctgctctgtttttagtttttgctgtgtttccaaccgggttggtgcccgatagtacttataggtgtcggaatgggagcatggtacgggcggcggcggcggccaagatggccaattatggcaagtgtacgcacgcaagttcgtcagctcttgactgcactggtgactggtcacgctttctgtttatgctgtcgtcaccctctctgtcatcgacttggtggtcagaaaaggtttctgtctgctcccgtcggaacagattcaggccttgtttaggccgtgtttagtagttttggcaaaaaaaaaattaacgtatacatacatatatatatatatatatatatatatatatatatatatatatttaaagtattaaacgtagactaataacgaaacaaattacagatttcgtctgtaaactgcaagataaatctattaattctaattaattcgtcattagtaaatatttattgtagaaccatattgtcaaatcatggtgtaattaggctcagaagattcgtctggcaatttacatgcaaactatgcaattatttttttttgtccatatttaatgctccatgcatgtgttcaaacatttgatgtgacggaaaagttggaagtttgaatggaactaaacacagccttaatttttttttccaaaaacgccacatcgaattttgatcacatgcatagagcattaaatatagatactacctccgtttcaggttataagactttctagcattgcccacatttatatagatgttaatgaatctacacacatatatgtctagattcattaacatatatatgaatgtgggcaatgatagaagtcttataatatgaaacggaggaagtagaaaaaaactaattgcacagtttgtatggaaatcgcgagacgaatcttttgagcctaattaatccatgattagccataaatgttacagtaacccacatgtgctaatgatggattaattacgcttaataaattcgtctcgcgattttcaggcgagttatgaaattagttttttcattcgtgttccaaaaccccttccgacatccggtcaaacatccgatttgacacctaaaaattttcttttcgcgaactaaacagggtctgagaaaataatagaaaaagaagcctctacgtttgctctcatagcctagaaaatcccacattaattggtgaaaaataataaaaaaattaaaaaacaatttgagacaatatcacattaacagcataaaaaaaaagaaaaacaaaaagaatcaatcggacaccctgcttacgtagtaaaatcaggactctttattcaatttggaaacactattttaatttagaaaacaacagtcatacatggtctatcaaagtgaaaccaatcagaaacagaaatagaataatgcatgtatttgtttcatattgtactcactgcattaatggcaaaaaaatacacagacttagcaaccaaagcaaaatacaaatacacaaaacaatcatagctggtacgcgggaaatcatctcgccaaaattagcttcgtcaacaaattagataatagaaaaacaaatcaccacgtttgctctcataacctaaaaattcacacattaattaaaaataaaaaacagagtcatatttttaaaatttatgttattcagataaaaaagtaaaacaaataaaaggtgagtccatataaaaaacaattttcaaaaatatgaaatttggattaaatgtataaaaaataaatattgaaataagagtaaatgtaaaaatataatttataaaaagaaaatctaaaatcggattaaattagaaaataattaatatcgataaaatactccatgtagaaatacagtttatgttgccatttttaatacattttataataaaatataaaaacatatatgctactataatgaaatataaaagaattttataataatactagccgcgcaatctgcgtgggcaaataattattggagtaagcaatgcatgggaacaaggaagatagactgatgttatagtacaactaaacccaccttctttacatcaacatgtgatgcacgtagatattgcgacatgaattacagcacagagacaaattcccccggcaaatagtcttagctggaaggaactggggcggcagtattgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcggccacagtgcgtcaagaaggcgcccaccgcggcgtgcgccagtatggtgatctgcggaacccaccccatggcaacatgtccatggctcttcgtccgttcttggtaacccggaggaaggacatctgaaagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcggcggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggtgaaacaatggtcttacctatcgatcgattttttatgtgaaacaggactcaatagctagtggttcttaaatttttattattttctgtaggtacttgttgacagtgaaatttggtaagcccaaagtcatcatcggcttagagtcaatatcggcttcagagtcctgaaatcagccgatgggagtcgacaaatcgccaacaaccgtgttctcgatggaatcggatcaattaaagggaatttatccagaagagtccgagttcaagaagaatgcggcatggcagtttatctattaattaggaatagtttgttagtttcctttttatttttaggaaagtgtgtttagtgtcctataaggactttatgttttccttttatctttagtaaagtttctttcttgtcccataaggactagtatctacccatgggtataaatatgtacactcggggtcattgtaatctatctctacgatcaacacaattcggcgcatcgccaccctttttacttttacttttgtttctacgttccggtggaacttggcacccgacgcggggctgcatcggtgttcgatctccggctaaggggtaagtccaatgttccatcggcccaggcaattgtcttatctacatcggcgtcgttcaaggctgcatcagtacatttgacctcttggattgcactggtttggatgatatatttgcctacctacttatcatatgtctctgttaatctagtcgtagcatatcgatttagctctatcggctgtctctcgctttagagtttctgccggtatcggctaaatcgcgttgctagattagattagtttagacatctaccaccctgaaaactcagtcaacggcttgattgtctagatattatgtttcttttcatacttagtgctgcatcagttaagtttgatctactaagtcgtgcttagaaccataatccctagcctgcttcttgattgccaataagggtttcatcggggtttcagccggtgagttatctggacgttgcatcggcttgtaaggattgcatatacatacatattggatttagccgatgacaacaaaggtttcactgtttaatctaatcttgtagatttcatggcatcggaccgctagccgatgtgtgctttaaccttcggatcagtgcttgttctactatatcatattgttagccgattggtttctactggatattattgttatattttattaccatcagccgattgcctttatatcattatctacattggacatatagccgattgcttaaaccctatcgctatcggctggtaccggcatcggctattatcggctatcggctggaactgctccatcggcttgtcagccgatcggttgttttgatctactatttacatatcttgtcagtggcaggatcaaactgactggcatgcctgtatctcatcatatttggacctgcactggagctaagcagatctcctaggccgacgtgttcaattttttcgtcaacggtattgcaggtctcgatggttcttaattataatatatatatcgtatgcgtgcaacacatgttgtgaataataaataaataatctcaacccaataaagtctgtttctgccatttcactttcgatagattttaggtctatgtctttcatttttctttcgtaagatcttgcatcaaaatttgtgtttatttagatctaacatgtagttacactagttacagtaaacttactaggttacgttgcaccaaaattagattcttttttttacaactgttttgtttctatatttacgatttttggcatgtttgttcctttttatttcatttaaaacgggttgtatatattggatgaaaattatgtaagatttgaagctccaagtctatcaatctattgataggtagtaccataacagtttacttcggaagatcatcagtggacgacactttctactgatatgaattaagagccatagtgctccaaacaccaacaagtagtagacaagcagctcttttacaacatatgtgggaaaaagaatttatttcttaatttaatttgatagttcgtgtacaacaccattgttattcatgcttggcgcccaattcagggaatgacaaggataagatagaagtgataatttctttttaagttttgaatcgatttatggtatagagttgacacaatttgcttatggcgttaattggtctactaaattttagcggtacagatagatacactagcgaggagggaaggaggattggggaggagagggatgccaggaaggagggagagaggtaggggagaagaggagcactgagagaagagggctgccgagctgggaggagggccagcatgaacgaggggcgctaacatgaattttcttagtccgccactagctacaatatctcagcgccagtaagtttggcgttgagctcttattcaaggtggcgcaaatttgccaagatgtcgaagcgcagtaccactccactgacactgagctctctactgctaaaaacagtgtgcattccctcttttatagcaaagcaaggctagtgcagtggtggaggtcttcagtctcgagacgacggtttgattctgccatccttcatgcttgcttttttttttcccatttcactcaacactttttaatcagtagagtgcctagcgccaatgatattgatgctaaactctgatgatatggtatactcatgccactactagtagagagctcaacacaatggcattggcactaaactccgatgacatcacaaactcgtgccaccttggacaatgtgctcatcttcgatgacattgtaaacttgtgccaccttggacaagagctcagcactaggcattggtattgagatgttatacctcaacacagtggcgaatatagaatataaactatgaagatgcgggtgtaaaaatatagtatgactgaaacaacccagtgtgatcataggtgctccatgataggtgtgttgagctgcattagataatgcaataggattttgatagtattagcactataatgatcataggaaagggaatacatatttctcgaacaatattattacattagctcgttaatttcgaaccaccagctacaaactttcaagaaaaaaaatgtattcatgcttgtccgtatcacatgagaagcgttactccctccgtattttaatgtatgacgctgttaactttttaaccaacgtttgatcattcgttttattcaattttttttgcaaatatgaaaatagttatgtcatgcttaaagaatatttgatggtgaatcaagtcacaataaaataaatgataattatataaattttttgaataagacgaatggttaaacgttggataaaaagtcaacggcgtcatacattaaaatatggaggtagtacattattaatccaaataataggctaaaattggattatttaggtgccaattaagcataggtagttgttgactcctcatcaatctcctcaagaaaagggtaatctgtataaccaacaacgggatcctgtgtataaaaggtagacctgtcatacctgttcaatggtgcgtcaagctcaaacctcctcggcaagtcagggttagccaagaagagcctcccataggcgacgagatcggcatagccatcagccaccaccttgttcccttcctcccggtcatacccgccagcagcgatgaaagtgccattgaactgcttcctgaatggtaggagaccatgggcgatcttccttcgtccttcgattatggccattcttggctccaccatgtggcagtagagaaaccctgggtgcttgttgagttgctgcaccatgtatgagccgagagccaccgggtcggagtcgaagcagtccatgaagtcgacgaacggcgataatctgattccgacacggtgagctcccacctcggcgacgacggcgtcgatcacctcgacggcgaagcggcaccggttctcgaggctgccaccgtactcgtcggtgcggtcgttggcgctgtccttcatgaactgctccaggaggtagccgtgcgcgccatgaatctccacgccgtcgaaccccgcctcgatggcgttccgcgcggctcgcctgaagtcgtcgatgatctgagggatctcatccgtccggagccgccggggcttggagtacaccatgcctgaatcgtccggtgtgatctgcttgtcggtgcttgagatcggcgcctgtccattcggctggaaatctgtcgatttcatttggaaatttaatcaatcaaagagcacaatgacctttgattcttcgaatcaatcagtaaccaagtagtaacaactagcaagtaaataatctggcagatggacgaacctgtggtggagaccctgccgacgtgccatatctgcaggaagaagagggcgcccttgcggtggacggcgtcgacgatgggcttccacgcctcgatctgctgctgcgtgtagatgccgggggtctccgggtagccctgcgcggtgggggagatgtcggtggcctccgcgatgaggaggccgcccctggtcgcccgctgcgagtagtacaccgccgcgtgcggctgcggcacgttgccgtaggagcggcaccgcgtgagcggcgcgagcaccacacggtgggagagctccagctgccccatcttgtacggcgtcagcagcgggatcgccgccgcagctgccactttcgccggtgcgtgcaccatctttggcttaggagtagctttggttcttctcgatcgaaattgctctgcttctctctctgtttcttgctgctgctgctctgctctgctctgttctttgttgctctacttccatttttgttggtgcctgcctctacttataggtgttggtggtcgccgagacgccaagtgttcccaactgctgttgtcaccctctccgtcatcacaacttgtcgttagaaaaaaggtttccatttgttcccgtgggaacagattcattgcatgtggccgttttttagttcgcgtactcctgtggttctgatcaagacatcgaggtagcaggagtttggtgccgaggacggtgccaatcaacgcgatggtgtgtttggtgtgtacgtttgattctgaattcaaacatgaccctatttgtttatggttccgatttccattgcttgttctagtgcgtgtggattcccggagtgctttgagtaaataaacaacttgtttgtagttactctgtatactactactagtattttacgtttcaatactgacgcggttgacaatgccaggtatttataaaatttaaaacaaccaagttgagataagtaggagtatgattttaaaggaacactctatatctttcgaattgcatgttactgtagtattttgtggttaaatttatcatgtgcccgccaaggataaagtgaaatgtttagctcttaaaacataaagttcgaaatacgtaggattctcaaacactacaaacagaccaaacataaacagaataaggcgaattctggtaagtcaacaaaaggggattgttgcatcgaaagaaagcgacgcgaacgttgggccgcacgcgtgcttacgtcctgcgacgtcattgcaaacgacagcacgttagaaatcagtggctacgcgtttgatactaggccctatttaaatttcaactttttttttcttcaaactttcaacttttccgtcacatcgaactttcctacacgtacaaatgtcaaatttttttgttatatcgttccaatttcttcaaacttctaattttagcgtggaactaaacacagcctagacaccttgatactaagattaaaaatataattaaaaaaacttaaattctaagcatgaatctagatatccctagtatttttatttctttgagacggaggaagtaataacttttagaggaaggctgccgatggatgcagtgcggtctaaaacgcacgaaggctagccggcagggggcgatggtgcagtggacccacatgtcggcagaggttggactgtggtggagcatcggggcgagtggcgggtgaaaacccaacccggcctcagctgggccggcaatgatgacgctcaaagcgtcattcccctcctaagggcattgccgtgccgtctcatccctcatgtgtggatgccgggcaaaagcaaagtcttagttctctttgggaccttgacggacggcggcggcagtgttttccgttgcttctctccttagagatgtcgtttaggtatcccctagccaaaaccccaaaccaattggtgcaagctccctctagatttcatcctcttgtagcggcatcctagtctctacaagttggccacgttggagggcctaagggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacggcgtcctcgccgcggccgttcatgcctagccccgcgatcaccgtgttccagcagaagaggttggggccgtcgggcatggtggcgaagacgtcgagcgcgcggtccacgctcccgcacttgaagtacatgtcgatgagggcgttgcttagcacggcgtcgatccttgtcccgagctgacggatgtagtgatggactcgccggccaaaggcaaagtcccctgcctgcgtgcacgcggtcaccacggtggctatggtgaccgtggtgggcatcatgagcgtctgttgctgcactgtctgtcgcatcaaccggcggaacatggcgatggcggtagcggggtcacctcggcgcaaatacccggccatcatcgtgttccatgtgacaacgtccggcgacggggaagaggagaaagagcagcccatacaatcgaaaagctcctgcgcagcgtccattctcccggccttgcagtacccatcgatcatcgtgttccacgacacgacattgctcgccgtcgccccgaggctcgcctcgaacacctccctggcggagccgaggtcgccggccttgcagtaacacgtaaccatggtgttccacgaggcgggggtcctgtccggcatccgctcgaacagctcccgtgcgtcggccatcctccgggacgcgacgagcgcggccagcatggcgttgaacgcgaccgcatccctgcgaggcatttcgtcgaacagcctccgggcgggatccaggaggccgcgcctggcgtagcgggtgagcagtgcggtggccagcaccgcatcgccggcgaggcccagcttgcaggcgaggcagtggagggcctgctcctcgcggcggccgggggcatccgccaccgcgcggatgagggccgcgcgggcgttcgggagcacccgaagctgcatcagatcagataggcggcgcctgtgaacaactcgttgctcctccgaacggctgctcctcggcgccccgagcgctgatggtggtggccttcctcccaacgtggtctccgtccatgggggtgggtgctcgtgtggccgtgcctcaccggctcacccgtagagctcggctttagcagcagacaatgccgcggggtgggctcgtcggggtggagctccaccgccggccgccgggtgcccgggtgtagggagaggaatgagatcccctcctcaggtcaggtgactttacagcatatggttcatgtaaagatggctactatacgtcagtgactcaaagttatcatgtgacttaatatactttaattttgtgctgtcggtataattcacgtatcagtgcgacagctacaaattacataaagttactgcacaaagttaagggacttgtttctgagaaggggatataagaagatttttcttttgggcacatagaagatttggaggtgaagaaagtggaaatgggaagggttaattggaccataccattataaataaatttgctcttttttaaaatatcattagtcccttcgtttcaggttataagactttctagcattacccatattcatatagatgttagtaaatctaggcatacatatatatctagatttattaacatatatatgaatgtggcaatgctagaaagtcttgtaatatgaaacggaggaagtactgtttatctaaccgatatcatatcatcatctacatcggcatccacatccaccaaatagctataccaatatccttggacggattcaaagtgaagcggattacataatatcatatccgttttcatctctgaagcgattggttgaaacgatacaggtagtaaattttatttttacttttaaatataagtaacataattgtattaatccaatacaacacgcaatgtcatacaacaatttgttattccccatcgtttcaaaagaaaaccaacccttttggcctctcaccaaaagcaaaaccaagttattcccttcatctcacaatattactacctaatatataattggatattttctagtacaatgatatattaggtggcaaaattttaaaacagaacagtatactacttataactgtcgtagtggtcgccgttgccatcgcgaccgaacgcgatttgaatcagttggagagcaggaggcggcgcacgtccccgttcgggggtttggccagctggcggcagcaacagatggggtaatattgtcccggcttgcagtacgtggtatacgggtacacgtagcccctcttctggcagtactccgggcatgtcaccgaatcacatggcacgatcgcatggcaccaatcatctgtgcacaaatattcgattaagggtcagaacgtttggttgaaaaaaccgataataaatatacaaagaaaaaaaattcgataaattttgataggaatacaaacaca

SEQ ID NO: 65112 - DNA, 1418 bp, Oryza sativa
ataatagatgaagtactacgtaagagataaatgttgcgcaacaaactatagtgatctaatttatgtatatgatagaaacaaccataacatcacatgaatacactcgtaaatgtgtcttgtgtctcttaaagtttaaaagacgaagaccagcgatacatcatttgcctccctaaaaccctatttataaccggagatagtacaattacataggagggatgcaatttagctagccctaattagccaccccaagtacaagtgctcaccacctcctttctactccctccgtcctataatataagggattttaagtttttacttacaatgtttaatcactcgtcttattaaaaaaatttgtgcaaatataaaaaaaaagttgtacttaaagtactttagataataaagtaagtcagaaataaaataaataataattctaatttttttgaataagacaaatagttaaacaatacaagaaaaaattaaaatcccttatattatgggacggaggggagtactactatcaaacatgaccatgaccatttactaatagtctagccctaaggccctgtgagtctgtgatgtgttgggcaccaccaaccattgccatgatttattcctcttctttctttctctaactttaattttatttattcttcttgtgaggcccaagcggccaagccgggagcccgggagtgtgcagcagtagactagttagtagctgttccacggtcccgaccgccgcacgcttagtttgaccggagccgtccacccgtgaatgtgatccatccggttccacggccaactttcccggtcaaacacgacgtgacgttccccgtaatcccccacacgatccacgggagaaacgcccaccaaacaaccacaaattcttccagaaaaaaaataaacgaggagcagtgacgttctcgcgaccatcatccgaacgtgccaagcatcttctctcaaacaaaatcgtgtcttaaaaagttaaattaaactacttttatactgagccgtttatttactgtgcgacaatgcgatattatattatcgtaatcctagtcgtgatcgcgatcctgacacgaacaaaaaaacgggccgtgtctaggattgtgacgctgacgacgttttgccaagggcgacaccagtaacagcactgtactagcagcggctatcagctcacatgggcatggccgctcgctccgttcaacgccggggaccgttcgtttcaactgcttctgccttgccgaccgccagtgacgaagcggaggtccgctgaaacaggttggcagttggtggcaactctgctgcagaattatttgcagcatgacaggtgaagttctaggcatctagctgcaagtcgtattcctttgtctaaaaaaaaaaatctagaacttaatatgacaacgaatctgaatagaatt

SEQ ID NO: 65113 - DNA, 1241 bp, Oryza sativa
acatgaagattctgattctcttttgtgtcttggtggcctcgagctattgtgattgttggtctcgagctgttgtgatgtttgttactagtttcttagtaagtgtgcgtatctagattctggaattgttttagtagcatgttggcacatatttgcgtggagattgtatcatagaaactggaaggaataatgtgatttcgtttcactatgtttttttttttaattattggaattttagtttctcagcagattactggtatgatttttctgcatataaatgaaagcaagttacagctttgcactagaatacatggtcaaatgaatgattggcttatgggctttgacaattagagttgattgaatatgcaaatttgagaaacccagaatgtattttatatgcatttgctgtgtgtgcattactgcactagagacaacatgatgccagaagattaatgtaatataataaattctttctgcctggcaattgctaattccatgaatttctagcagtgtgcaattaaataattgatggttgcaataactgtgttaagtttgttaatgtctgttattagtgtaccatgtcatgttcaacttttaatagttccctgttatgctgtgtcactcggaattaatttatcttcaaccatattggacacaggcgtatggttatagtcaaggaggatgataagcctgtggatatcatacctcaagaatttgcagcacgtactctagctcaagaatatggaggtggtgcattttcagtcaaagataatgttgttgtgttctcaaactacaaggatcaacgtctgtacaagcaaagtactaaaagtgagtcatttgctatggttgtaggactaaggagttaggtgaacctaactgaattagcatgtcaataaagaaatataatttagttggaaggatgtgtttttactttccttacttatggtaattctttgtctagtacttcattgaaaaatatttcattgtgtatatgcatttataggttactgtatagcatgctcattcaaataagtagaattggtggagcatgtcttaacaagcgaaaagacttgcgtttataatgaaatgacagccagtgaaatgataggttgtgtttgacaggattaaaaaggaaatctaatcacactattcagctgttaaatatttagaaccacttaatgcttgatgatcaatatgcatattaaataatgatatttttttctgctgaaatatttcacatgatg

SEQ ID NO: 65114 - DNA, 4521 bp, Oryza sativa
  unsure (1)..(4521): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaggaaagaacacccagcattgaaaaaaaaaatcaataacttgatagcctcaccttgatcgaacctggagggatcacaatgtaaatctgctcaacgatttcaagacagtgctcaacctaaggcacttcaccctcccactagacttcacactctgatacaagaacgttcgtataatgattaaattaaataaaatgagcaatactccaatataggatccaatacttcctactctctgccagttatcacacaattattttttacagttactaggggaccaattaattaataccaccaagaggcagctgtaagttattacttttttttagaatggacaactgtaagttacttttatactactatatagaatgttcatttgtattagccatagcttgtttctacgattgtaacaataggaacggctatatatttattttaattgaatgtttacaggagtaagatattgttgttggtatatgttcctcaaattaacaagagttggctgtgggttttgctgttgcaaatcacgatcgatgaaggaagagtatataacgagtaacaatactattaccattattcaagaaaaaacaatactattaccatgtgcaatcaaattgccctaacaagcatgacgaagcactgtttttctgaggcacatcagtacactaccaccatgcacaaccagcagcacttgctttggcatacttttcagtgacactacatctgagaatatcaaattgtaagccaaagaaaactaaaaggggagcccttctcggagcaagaggtgcatagggccattaaggagatgcccaccgacaaagccccaaggctagatggcttcactgggatcttcttcaaagtctgctgggaaatcatcaaagaagacattcttctggtcttagactcaatctataatctcatatgtgcacatctaaatctgctcaactccgcgaacatcgtcctaatacctaagaaagaaggggctgagggggtcgcggactacaggccaattagcctcattcacagtatcgccaagattttctccaagatgcttgcgctgcggctaaggccacacatgcatacgttgatttcggtcaatcaaagtgccttcataaaaggaagaagcattcatgacaacttccttttcgtaagaaacatagctagaagataccaccgcttgaagcgagcaatgttgctattcaagctagacataactaaggccttcgattccgttcgctgggactaccttcttgccttgctacagcgaaggggtttcccaacaagatggagagattggttgggggctattttctcaacgtcaacttcgcaagtactcctcaatggttcgccagggcagcgaattaagcatggcagaggcctcagacaaggggaccccctttcaccactgatattcatacttgcaattgaccccctgcaacgaatcctctcaaaggcaacagagctcagtgcaatctcaaagttgcgagggagaacgacccgtctgaggacctcgatgtatgcggacgacgcaatcatcttcattaaccccactcgaggcgatgtcacggcttttgcagacatcctacatcgctttggcactgccactggactcgtcaccaaccttcaaaaatcccaagtggcggccatcagatgtgacaccattgagttgacggaggttcttgagggcgttccggtggtaagagcaaacttccccataaagtacttgggcctccccttggtactgggtagactacgaaaggcggatttgcaacctatctttgacaaaatctcaggaaggataacaaactggacagggaagaacatggcagcagctgggagaaccacgctcgtcaaatctgtgcttacgacacaacctatctatctcctgactgccttgaaaaccatgaaggaatcccttgagcaaatagacaagcagcgccatcgctttctctaggccagaacgggagatatcaccggaggaaaatgtaaagtcaactggaaaaagacgtgcttgccaaccagtcagggaggattgggagtcctagatctagagaaattcacgagggccttgaggctgcgacggttatggcacgagtggaaggatccgaccaagccttgggtgggactggaaacgccctgcgatgaaattgacaggagtcttttcgccgcctcaacaaagataacaattggagatgagaacacgacgcacttatgggattttgcctggatcgagggacaaagacccagagacctcatgccactggtctatgtgatctctaaaaacagagggaggtctcttcgaaatggaaaggaggaggatgcctgggttcaggacctagctctggaatcacactcgcctattatagtagaactagttgaacaactggttgtcctgtgggaagcggtccggaatgtccacttaggcattggagaaccggaccagattacctggaaattcacaagtagcggacgctacacgacctccttggcctaccatgcgtaatgtcaaggaacaccgagcacaagtttcaactccttaatctggaaagcctaggcgccggggaaatgcaaatttcatgcttggctcatcattcaaaatggagtatggacttcagatcgacttgcgacaaggggatggcaaaacaatgggtgtttgtcctctgtgccgctgcgaggctgagacggcgctgcatctcattgccacttgatatactaaaaggatatggggcctcgttgctggatgggtgggctaccagcagattgagccggctcaatgggaggaggcactgtcagtgcaacagtggtgggagaaccttgcaaacacgccaaatgctccgaaaaaagggctccgatcactcataatgctaattgtataggaaatctggaaagagagaaatcggcgaatctttgaccataaagaggtggcaacaagtttcctcatgtcgagaatcaaagaagaggctaacctttgggctttagcaggggtaaagtggctgcgcgagttaatcccgcattttgtatagtgtatagctacaggctccagattttttttttcttttgtccctaggggttgtattttctcctgctctattcaataaaaaggcactctagtactgttttccgttaaaaaaaagagctaacagattgttttgtgtgtggattagagtacatgatctgcaatttgaaaagcacagctgtctcaaaagaagtctagaactctatatcagttcagtaattaaacttgataattctttggttttttagataatggaaatggtatataatgattctttgttcaccaagagatgaatttttttgaaagtattcaccaagagatgaattaatctgcttttgacaaaatcaatgaattgggagcgaaaataaaagtaaaaaaataacagaagcacgttggctatgttttcaagcttcatgtaaagttttaatttaatctagggatgatgtcttaaaaaaatgagcctttgggcttgtaagtcaagaaaggtgttttatttggtcgctacataaaaatggctatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttacacgttttgcttggcaatgtgtcttctttgccttcaacatccccctccccacaatgcaaaagatatttttggtgactggctaaggggagtgcctagacccacaaaaaaatgattttatttggagctagtgctttatgttggtcaatttggtgttgccgtaacgatatagtttttaaccataaaaaaatgcctaacatcatgcaggttatcttcatgtgttccaattggctccactcttggtgtatgatgctttcacaggaacaacaggatactatgcgcaatggtgctacacgcttggaattagtagccaaggaacttttattccattttggatggcgtagtacctacagaatttcgtgatagaatctacgtgattttgaaaaaaaatattattttagtagattatatcatcggcagaagttgggggtttgtcccatctcgccttttttaacttttctgttcacgtctgaattttttggctgtgtgcctacgggcagaggccggagatgtaacacatttccattattaaaaaaaaagtcaagaaaggtgcagtcaatgcagctatggaacttataggtacatctgtaagcaaggtgggtactcaacaaagtc

SEQ ID NO: 65115 - DNA, 5916 bp, Oryza sativa
tgtctatatcgaagtgtgatgtgtcagaatagtttgtttaaagaaatcatttgtcagaatgttgtggcatcctactggatggttctttagatgagaccaattttaatacgaaaaggaaagggaaatcattttggtaacagtaaataaatgctggacatgatttttatgaacttcccctatccctagatagggggaacactaaaatgaagatggaatgaatggttttaccatattggtagtaagaggtgcacttaatctgattctttggtatttcagaacggaggtcagcctaataaccatgaagcactgagcaatgagtggctggaaatgggtcaatgccccctggcaaagtcgtacagggcattaagtggtgtcgtgcccctcgtcgcaaagatgatgacacccccggctggtatgaaactgagatgcccacctgcagtagttgccgcccgtgcagcactatcacgcacagcctttgccaaggggcttcgtcctcagcccctaccgacgaaaatactggtgatggcgttgcttggtatggcagcaaacgttccccttggcatctggagggagcacacggagaaattctcagtgcagtggtttgccgcagtccatgcggcggcacctttcataggcatgctcaggaagtctgtgctgatgccaaagacagccatggcgcttaccatagctgcctcaatattgggtcagacaataggtacgagagctgagcgtatcagattgaagagggcagcaaaggttgctgctggtagccagggtgatgctagcaccagaatgagcctgaaaaccgggagatacactgatgatgtccagttctgggatccgcttgccctcagagttgagagtaccataggaacaggaactccggttcttgttccaactttccattgatgatgttgccttgggtttgtttcttcggtcgattattgttgtattcattgtgttgtgccttagtctttatactaaatattacgttggatgcttctcccatgaatctggggtccaaatttcagtgtacaataaattgcacgtgtacatttccgaaaacaagtgttactagtgcgctaagaaatacgcttagagctgagaactaagatgatgtccttgaattcgaccgatttgcatctgcaactggctgatcttgcagtcgttgtacaacttttcttacaagagctattcggatggcgtgaaaactgaaggaactttgtgcgtgcgtgtgtgtatagagtactagagtttatttggtcaattaagcaccggggcgtagctacagcctacatgagctgccacgcactttggtcaaattgcccagtacacaaaccacctcatcaatccatccacattcgcacaccaaacgcatgcaatttcaacgacaaacacaaccaataagtctaactgcgtgctcaacaatcgtaatatggcactagttggttaacatgtgacaggaaaaatcaactagtgctaggactaggagcatcgtctttgattgcaagcagcccccttgccgtgcgaaatgcaaacgacaggcaggcaggctcattacctagtatatctcatcatctgggacatcaggtgtaaggaacttctgtggatccttgtacagttcctcgtagttgtatttcggcttcaccctctccgggacaggctcaagtgggatgatactgtctccgtcgattacactgtcgatgagcccgtaatcaacagcctcaagaggacccatatatctgtctctatcaatgtctttctcaacctgctccggagtgcgtcctgtgaaacctgatataagccggatgacattcctcttgttagtcaatatctccttggcctggacctcgacatccaaggcctgcccacttgcgcctccaacgggctgatggatcattatcctggtgttgggcatggcgaatcgcttgccctttgtgccaccaccaaggattatagaagcagtggaaccagctatgcccaatccaatagtggaaacatctgccctcacgagctgcattacatcatagatggccattgttgcgctgagagagaagcaggaatcagtcagaaaacacaaagatatttgcatcaacagatttaccagactgccaagaacccaagagctatttaacgtaatgacctgcctacagctacttgctcttggttgatgaactagtatctcctacttgtattgcaatacataatcaatcttgtaccagtgctattaaggtacattgcaaacaaaacaaagagaaggcattcctacactaacttaataaacaaaaaaaaaggcaatatcctgcaagggaaacataaaattaagcatcactctgaacaggacgtgcatcatttataaaatgccaaaaacatcattaccaactccgaactgcggcaagatctttttacagaaaggaaggaagcaaggtttacattcacataatattgcctcatcagcccatctctttctttcttgtggtgtgtgggatagcctctatcggatcaaatagtgttgttgatttagaatctactccctccgtcccaaaatataagagattttgtgtgcatgtgacacatcctaagactatgaatctggacagtcacgtccaccaaaaatcccttatattttaggacgaggggagcaaatacactatcaattcaaaacaaatggttggttgatccataagattcatagcaggagctctgatattcattataactggaacctggaaggactgtttatttacaaagggaaaaaagaaaaggatatagtctgattgatgttattcatcatatagtaagtagctcaagacttgtcttttacccacaatttgcgttatcagaaaataactaccctataagtagcatacttgtatgattcctaatgcgcttaattaatttcgtgctccaaggttaaagcaattcaaagcaaaaggagaaataaatttaggatgcgcgacctgagtgatcccccaggggagttgacgaagaggcggatgtcagagttggggtcgacggcgtcgaggaggaggagctggctgacgactgcgtcggcgaggaagtcctctatctcgttgccgaggaagacgatgcgctcccggaggaggaggcccatgacgtcacccccggctccggctccgggcgagtcggacgactcagctcggacgccggcctcccacagaggagtagagggggcggaagccgcgcgaggggggttgagactggtgagcctgagggggcgcggtggcgcgacaacgcgcaggcgtcgctgctgcgtggggcggagagcggccgccgccaccgccaccgccgccgccgcggagagggaggcagtggcactcgcactcgcagccgacatcgctcgcaattatctctatcctgccctcggctaacctacttcttggttgggttgcccttgtctcttgccctttctctttgtctcttgacgggggtttggggtggattttcttataaattactatatattacattcgtcctataatataaaaaaagttttatagttgaatacgtttattaaaaaaaactagtaatatatccatgctaaacactacaatataattatatttgttttaataattcttaaaattttatgttagtaaaaatatttttatatggtttgtgcacgtgaacttaaaatcaatttatgccgtacatcaaatcaaatatatttcacgtaaatttgaatttgtttccttgcacaatattcacgctgttttttattcctcaactgtcgatcttcaccattaattttacctgtgaatatttttgcaaaataaaacggagaacgattcatatctcacttttatactccctcgggattaaccaaaaaaatccccttccgagacgttcccatgtccgaagggcctgagacacgatgcatcgaattaccccctggttaattggtaaacgaatgtactagtggaaagaaggaaaaaaaggcagcagcagagttagaggtcgaggtgaatggtcttccctccgtttgcctgccaccttcggagtttttttttcttttgagaaaaggagacaaaaacaccatcgagtactcaagctggtaatcagttatacttactgctagttcagtaagaaacacagttagtatcacgctcatacagttctgtccacatcccagcttgccatacgagaacaaaggatatataacaaaacgtagagggtgccatcaaattgcattctcgcgtcctacattagtctagtcagcttcttcctcttcctccatgtcatttgcacttattagatgcccaagtgaaactttggcttttttcagttccggtgacctcagtgcagcagcaatgccatcgcttttcctcttctcgccaaaccccgcttcatcttcgtcttttgtagcctcacccgaggacttgtcatcgtcaggcttctcagcaatcgttgacacagaatcatccttcttctccgatggaagctcacctcccttcttcaatgactgctcacattctttcaggaaatcacgaacatcatccttctctgcaacatgtagagccgtctgacccccttttgtctttgcggcgatgtctgcacctttcttgactaaatacttcacaagctccaggtgggagttctgcgaagcaaagtgcaacgcagtgaagcctttcctgttctttgctttcacagaggcaccagatgccagcagctcacggacaacctctacatggcctttctgagaggcaaaatggatcgcagcggtgtcatccatagctgcagctccaacatcagctttgtgcttgcaaaggcacttcacaagctcaacatgccagcccatgctgccaaatggagtctaaatgaacaaagaaacaccacatcaaggagataaccaaaaccgagaaaattgatagagcttgagcaagcttatcatatctcataatatgatacactcataaggcagaagcacaagtgataatactgatgcagcagtaatggattctgctcaagaaaatcaacataaacacaagtgatgcagtcagttgtttctagttgttgaaaaagcaagtgacagatgaaacaaaatggcctagtaaccccccctgtagagatagtggaatagatgcctcacacccaatgtggggaggtgatctctcatatatagctgagttacaatcaatgctagtgagatacacaagaccaaaggtctaggagataaacagcctatagactaataaataattctaatacccccaaatcagaagaaaacttgaggaacaaccatgtagtagtagcctagtaggaggaaagtatgaaaagtatgaatggagagatagacagcacaacagctgtaaattaacgcaagcttaaactatcttacacacaggagaaaaaatgttggacaccagaccaggtgaaacaatgtgtggccgaggagaattgaacactgcctgatggagtggcatgacaacaaccacagtgctatgtgcaattctttacatttggagtaaattgcagattggtccagcttttattaccaaagtgtcactttgggctacctctaattcaatcttttcacttaaagccaactattgttaccaattctttgcaatttgggctagtggcccacctgtcaataggcttatgagcttttctgtttctccttcttccttcttccttctctctttcggtttcttcttctccaggtcgagcaacaacagagagggagagggatagggcgtcggtgctccggaggaaggggaatgatggcgttggcggcggagtgtgttcccgagtaacgcgcaaccgaagagggtggtggaaagcaaagggagtgagggagatggccggaacggcgcagaaatagctcagctccggccggcatggatggtggcggtggctaaaggggaggggaaataggaaaaataggttcacctc

SEQ ID NO: 65116 - DNA, 3100 bp, Oryza sativa
attcctgcagcccatcaatatgcaatttactcttacatttgagacaaagatagttttaactgtgtagtggggctgcttttaggaagtttaagctatggcaaggaaaaacaaattccacaaaaatgaacctgatattagtctaacataaatcatggggatacattacagcaggccttgcaagttgcaacggcagttgatgggctgccaaataaaaagtactagtactagtatactggcgataagttgtaaggatcaagcgcatgatgaatcagcagagtagatacacagagtatgatgaatcagcagagcagatagacggagttatgaattattcgcagcaacaacagcaagtaataatacacagagtggtgtatagcttccatcccaaagacctaggtttcgctaaaattaactcaggcgacagaggggaaaataagtactccgtgcgctaggtcggaggaagggaagggaagggaagggaatcttcttcttacggggtgcgagagaggcgatctctggaattgagggcgagagggttggcctcgcacagagactccgccgccgccaaatctcccgaccgcgcggccttgtgcagatgcaagtcatcctcctcgcctcctccgcggcctcggcctccacggccacgaccgccgccgccgccgccgccgccgccgtgacgcctccccatctctacgctgcagccgctccggatcagagaggaagaaggatgggaattggatcgaacaaatgatgggctgctgctctgcctcaattgctgcccaggctggcggcccattaagacagggaatcttaacctttatccttatctatatatctcgtgtctatctctatctttaatattataaaaattagaaatatttttgtcaaaattttaatatgccatccgtctttgaattgaattttaattttatcatcagactcttatatatcctcccatatccggccttcatcaccacgtagtgggcactgtgagtccaactttatcgttgcaaccatgtatataacatctcctccatctttaaaaaccggtgcaaatcgccttctttaatggattggaaagcggtttatactgatatgacaggttgacttggtccaaacatactgatgtgacagcccagtcatcaaaagggttaaaaatagaagtgggtccctaatctaagtggcaaaggataaaataaaaaaatatgggcccacttgttagtcccacttttcctattcttcttcctctcttctatctctctctctctttctcagccgccgccgcaaatgctgcacacacgccaagaatgaatcggctgcgcacggcagctgtgctgaggccggcgcggacatcccatatgtgaagggtgcagccatggacggcagcgagccatggtgttagtgcttgccctttttcagttgcctatgtgcaggtctgcacgagaggcccaacagagtcgccagcggcgagaaggaggagtgggccgtggcgtatgtgcggttgtcgttgtcgtcggacgccatctcctactcctccagcatctccacggacatgccgctctatgagccccccgaggtaaaccacatccttctcgatctctgcactgccatgggttgatgcgacgagatgaccggaattcatgcgcgtcgctcgtgcgcgtgtgtgtgcaggtgtcgttcgacgagtacctcctcgactgcgcgcgcatgttccacgccatgttccccgacgagagcaggagccagcgccccagcgacgtaagcaaaccaaaaaccaaaaccactcccgaagtcctgttcgctctgctccggcaacgacgctaaagcttagctgatcctgtgtatgcgtgcaggaggagtggagagtctagatgctgtcgctgcatgtgtttgtttgtttgtctatttgggcacgtagacgaagtgggagctacgtgggctggagcgcggctacgcatcggcgagcttcgaccttggcatccgcgggtcgctctacaccgatagaagagtgcgcgactaagactgatgggagaaaagagtgcgcggccggccggtgaccctttcccccgcacgcgtcacgacctgcgacccctcctaggcgcgtcggttggccactccgcccccacgtgctgctgtaaggtgagagaagaggtagaggaaagagagaggtggagaggtaaggaagaatatagatggaggaggttgctgacaggtgggaggtggggcacacaagctgattcagtcaacggggtcaaaactgccacgtcgacgaaaccacctttctaaccgctgaaagaggcgatttgcactggtttttaaagatgggggagtcgctatacccggttttatgattgagggaagttatttaactagagcaagagttgagggaagcagtatggacttattctacttagaaaagagccacatatagcccccagcccaactaactaatccctagctcggtagctcccgaccccggcggccgccggcgctcctgtctccggcaggtagcaggccgcaggtggaagcgcgcggcgctggcggcggtgagcaggcaagcagcggagtacgggacggcgtgtccgcgcgacttcgcgagcgcgagcagcagcagcagcaggccagcagtcagcagaggccagcgcgagcaggagggagctgagcaggttgcagacaggcggcccgcggccggccgccggcgccagcgacgccacgggaggtcgggtgcgtgcatactgcctgcagtctgcagcagaccagcagcaggccggcggctgcaacctgccaatctgcaaaacaactaaacaaggtatgcttatcacttatcagtttatgcaaatatgcaattgtgattacctaagtggaaatttggaatggctcaatccattagcaatttagcacagtttcatcttgtgaagttgtgatgtatttctcattatttctctatttctatatgaaacttctttagaatacaacataatactatggtattataatattgtatgagacatgatgtgtttatgccgacgtttccctcaatttttcattcctggattcacccctgcttttcaagatgcattcatttggccatttaggccca

SEQ ID NO: 65117 - DNA, 4843 bp, Oryza sativa
ctcatcagtttcccatttttaagttttaacaatgcaaaagtgccttactgtcatgcgggagtctccttgattcaatatacgcatcacatacttgataggtgtatactggcagcaaaacttttagctatttactccaagagctgatgataaaccaacaatggtcatggaattttagctctcttcttcagattcttccacttatcctactccaaccacagcacgtagatcgatgcggtggcactaccttctatgtgtgttaggctcccatctttttgccaaatatggaaaatacgtcatatggcgtattagcaaaataataataatttgtaggtaaaacatatatatatatatatatatatatatatatatatatatatatatatatatatatatatatatatatatatatgttcttagcgacttaaacgacaatcttcgacgaaaaaaaacttcaaaaccaagttttaaaatttaaattttggcatcggttgatgctgaatagagtaaacgatgggcgcgagggagagatggctgcgccgccgccgtgcacggatgggaggcggccatggtgtgattcgaaccggattctagcaggaggaagacgaaatgggccgatacgaaatttcggcaataataaaagggggtggctatcaagctaggaaagtggatgggtttggagacaaggaattttatacaggttcatgccttcttattcaagaagtaataccctactcctgtccggggatgattccgccgagtgtgttattgattgtatgattgggagaaaaagaatcgtcccgagaggaacccggacccctccttatataggggaaggggtccgtattacaaagtacagtccatatcctaacggaatatgggattacagataaaatacaatcgtaaccgactaggatcccgggtattttcttgacatacaagtttagaatctaacccaagtcctcataaagatattctatctatatttggtaccatatatccaactggaatataacctccatgtagatatggggtaaccataatctccacagtggcccccgagaccttcgcagttgaccaaaataatctccaaaaaacaataatccaagtgcttcaattcaacttgctccggcttgccgagtgctaaaagactgtgaagggcgaaaataaaacatggtgcatcgagtagatgcacctaattaggtgtagccctcgactatgtgattagttgaaaaactaaacatatagtcaagaaccgagtgattttatatcgaagcatgcatggtactcaataaaatacccagccgactgcttctcacttgaatatatcaaggataaaaaatatgaaaagggccgaatgataaacactcaaaaggtctaaaaatagatatatttggtaggaatccgagtaagaaactcttaaaatgatcctaggccataacccttaccataatcaaaataagcatataacatgctaggagaatgactactaataaaccagtcatctcaaattaacccaacagcttttgcagcctaaaaaagcttacaaaaatggtataacacctctctgtcgggcaccttttcatgtgcatcataataattccaaagaattattaaatcgcgttaaaaagaattttaacagcatcgggccgcatcattgtgagcacatattgccaaagcaaaaagcgcctaagtccctagggatcacaacgggccacgctgaaaacataattgggctgaagtactgtacaggcccaggcccattagtactcccgataccctaaaaataccgaagtccaaacgtcgtttcgtcttccccgccgagactctcgccattccccactccatgctacagtacagaaccgcgccgacgaagctagggttcatcaatctgctccaacccaccctcaaaaacttcacaaaatttctccccgcgtccaccgctccgattccccattcctctccagccatatctcggaccaaatttaaccatccagttcacattcatggcggaagaaagagaaagcttcgagagtcagtgggcgccctccgatgtgacagaagataatctgaaggagatggtggcgcacggcgttctcccagcgaaggagattatcgggtggcgaccggcgtccggcgaagcattcccgaccccggacacacacgaaatcatggtatttgctcatttcttctatggcggattttctcttccaaccttaagattcttccgggggattctgaacttctacaggattagcttgcatcacttgaatccaaactccatagtgcatattgccaatttcatccatgcctgcgaagcttttctgggcattaggcctcatttcgccttgttccgccgcatcttcttcctcaagccccagccaaacaaaagcaaaccatgcgtcgttgcgggagctggtttccaactcagaggaaccttgagccaaaaatatttctccatgcccttcaaaacctcaaacaaaggctggcatgcaaactggttctatgttcagaatcctgagcccgcagtccccgagtactgctgtcttcctccggtttaccaggatacatggaactcattgcctatgggagatgaagctgctcaagcagtagaactgatggagaggatgataaagctgaaagaatagggccttcaaggagaacagatcacccggcactttaccaagtgtcggttagctccaatcaaagaaagatctcgcacagccttcgaatttgacggcaagcatgacccaaaccgtgaagatccggattctcttgacttcaaggtcatgaaggaaaggatgtataagatcttctcaaacgccatcgttgtcagctactcacacttgctgccagtcgtaccgttcaatgcattcaatcctcctccaccggtgcgtattcatatacttcaacctttctcaaaatatgatcttgttttcttgttgaatcatttaacaatgaaggatattacacccaggaatttgctttgatgaagtcggatcccccaatcgctcaacgccgatctccccgccaccaaactgggcaagggagcggaagaccaagaattcggtatgaaactcaaccaagtgcttctgatccagtcggccagtcagattctcgaaagaggaagctggttctaagtgacgacgaagccgatgataccaccaggaggcctgtagaccgagagacgaccaagaaactaccaaaacaggctactccaaggaagaaaacatccagtcgtcctgtgccaaagatcaggaagtcttctaggtgcaactcatataacgatctctcttgtattgatgcgcacccattgcggcaataatactgataatcaaatttgcaggaaaccatctgatatagacccgtctgggaaagactctgacccaactaacatggacacaagtttttccaaagaaaccgggccaacagcagagaatcgtccgagtgacaaacaaccggcaaccgataatgtagaacccagcaacgagcccccgactgggaaccagtcgactgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccaggtctcctgtgaagacaccaaagtctactcgtccccgaccgggaatcatcacaggtagacacgctatctgaaatcgttttgatccaacagactttatttggctgcttcatcttcattcatggatacactagggccaataattggtgatgaagaagaaatcctccggatacaagcagctgaggattcactccctccgattctggtcaagtggtgggatgacaacatgcagcctcaagggatcgtgataaataagcaaaaagaggacgaggagctatgtctactgaagaaggcactaggtcaggcaacccgcattgtaaatgtaagccctctggtacctgatctcaaccatcttgtttgccatttaattcatgcgctaattaaactgttttgtagaggatttgtaacaccctgaaaattctcccaacgaaatcaaaacaccaaaaatacagattttcaaaaactttttaagtaataaattgcatcatgccgattttattcgcctatttcattggattttgatctcggaatttattaatcgcgaataatgaataactaactaggaataaaccttaaaaatcaagctggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttagtataaaacaaatatggagtaaacttcatttatgcaaaagttagaatttataggactatatttaaatagaaaatgggctaaaatcgggataaataggaaaagttactgttcattgcgtcataggtgttcgatcgtggtccccctggccccgcccccttccctgccgcgtgcgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggccgtcccctcgccgtcaccctgcgccgctgccgcgccgcccattccatcgcgccgagccctatgccgccgcgcgcgtcgcgtcgccccgcctgtcacgccgctcgctcgccacctgccgcgtc

SEQ ID NO: 65118 - DNA, 10735 bp, Oryza sativa
tgctcgtcaccccccctctctccattttcccccaccccatctcacccttcctcccctcttccctctccactgcgccgccgctctcgtgccgccgcgccgccgctcccgtgccgctgcgccgccgctcccgtgccgccgcgcgccgttcccgtgccgccgtgcgccaccgtcgctgccgccgtcgtcgccgccgctgccgccggtgagccgccctccttccccctcgtgtccaccgccgccgccgctcgggtgggtgagagccgagagagagagggagaggaaaacagaggccggcagagagaaagagagaaagagagaaaagaaagaaaaagagagagagagaaaagaaggaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtactagtttaaatgtaattaagaactaaacgattagatgaattcttatagactattatagattattttgggtaatctctataagtaattgattcatggtagaaattcggacttaatcactaggaattttagacgtatattatatttagtcgtttagtcctagactaaaattaaatcgtataatattataagataatttttggattccgtccgatatttagcttgcaatagaaatttccaacctattatatggatataacgctcgggtagattaaattaaaaacttatgataacaaaatatttatacccacaaaatagtttaggatatataaatcgaaattgggtttgccctagtacgcgaatagtaaagttaatataaaagaatcgactttcgtgtttgacttccatttggatttatttggatttttattttgaattctaatcgaatccaaatcaattttcgcacgtaactatagagcccgagggagttgcggatccaagtgaaggccaagacccccaagaccttgagcaaggcaagtcatcactattccttgaacatgttgatcccaattgagaaattattttgtttataaataaaattgcatgcaatgatgaatatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcgccacattgccatgaaattgataacatgatttgtgaaaggaaaataaagcgaaaacaactgttttcgactggggcggacggatgatttgggtggtatctggaaaaggctagtagcgtccccagtcaattaaggaccgagccatgaagttaagcttgaaacgacccccgtacaaccgtacttctcaaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatctgcattgttgctgtggtggcttgctgagtacggttggtactcacccttgcaaatataaaattaatcagaagcgggagatgaagcttcggaggatccctatgcctactaccaggagggagatgaagacgatgacgctcagtaggtcttagtacggtcgttgcctgtggcaatggcatgccgctgccttatctatttctgtttttggatgtattccggaccgctcggtccgattatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccacaggattcatcttaggaacgaagccaaaacgacaaccttagagaggttagtccctcatctcggaaccctcgaaaccaccaggaatcaactgcacgaagcgaaagaacttgccaggaagaatgaacatgatctgagggatcggatcgctgagctcaaggaatcaaattttgaactgagtggctcatcaaaaggtacgcacaaactctgctcaactgactcatactgttatctttgcaatcttgattaaccgtaatcaatgaagtgcaagctgccaagatatctcagttggagaagcagattcaaattctggaaaatgacaaggcagaactggcaagacaaagagacctggctttaaaggaagttgaaggtatcaacaatcaatacctcaaaagccattatcctccatatgttgacttattaatgtgaatctgttgatgcagaccgcaagatcaaatctcaagctcaattcgacgtccttgttggcaagatcaaaaaacttgaaggagcccgggatgaggttgctaacgctgctgccccaattgttcaagcaatgttctttaataacaacggcccgagtgcacttgatgcttctgaaattttcgataagctgagagttgctccggatacatatttcaagaacatcaaataagctggaagtatgggagcaagtctggcgttggcgatgaccaaatctctttatccaagggttgatatagatgccattgatggctttgcagacgggacgagcgaagaagctgctcttgacctcatcagcgatgcgcaaaaagccgctgacaagattgctgctgatgtagttgagagattccaggacaccgatcttcgaccgactggtcctgataattctgatgatgaaaagactgactgactaatgtaccaatgattttgatgattaatgatgatggaggcacaatttgtacaatactgatgaatttatgcggtgcttgatatcttaacttagttcctgatttcttaaaagtttttgtcaaaccttgttgagcctaaaacctgcaaaagttgttaaaaaactttcagtcctcattgactaagccaagaaatcaaacaaggcaatgatacatcaagtaaacaaattgaattgataaaaatcacactccattattattatagtagccccctgactgaaaacttcaaagaaaaacttaaagttagcagtcaaagaggaaagatacaaacgaaatgcctaagcgtaaaatcggcgaaggtgttcaatattccaagaattgttgatgagagtaccgtcttcgcgcttgagtcggtaagaacccggccgagtgacttcagcaattatgaacggtccttcccataagggagataatttatgccgatcctgtgttgtttgaattttcctcagaaccaggtcaccgactaaaaaggcttgtgatcgaacattccgattatgataacggcacaacccttgcaaatatcgagtcgactgaattagagctgcttctcgggattcttctagtcggttgatgtcgtctactcggccctcttcatagccctcctcgttgaagttccgaaatagtagtgattcaaattccacttcactcggcaacattgcttctgcgccgtaaaccaaaaagaacggcgactggccggtagcccgactaggagtagtgcgtaaagtcaaagtacggacggcagctgatctacccacttaccagcatagggacgtagtcggtcaaaaacgcgtgctttgatcccttgaagtatcatgccgttagcgcgctcgacttgtccgttactcatagggtgtgccacggaggcgtaacaaatgccgaagtcttcacaaaagtctttaaatgctccgccagtgaattgagtgccattatcagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtaaccgccgactgcccttttaaacgggccgaccatgtcaagcccccagaccgcaaatggccaggacaacgggatggtttgcaactcttgggctggcaaatgagtttgtctggcaaaaaattgacaaccttcgcatgtccgctcaatcttgtccgcttcggacacagttgtaggccagaaaaaaccttgccagtaagctttgccgacaatagtccgtgcagcagcatgattaccacaaataccagaatgtatatccttcagcaattgtctcccttcctccaaagatacacagcgctgcagtattcctgacggacttttcttatacagttcagcttcatgaataatgtaaagtctgctgcgtctggaaatccgctcggcttcatttttgtcttgagggagttcttgtttgctcaaaaattttataaacggttctctccagtcagcttcaatcatgcttacgccttgagcatccatggcttcgactgtctcttttctaggcacggtcggttcataaagatgttcgacgaacacaactgaaggagctgcttcccgttttgaaccaaaattggccagtctatcggctgcctcattgttatgtcgaaggacatgggtgagctcgagtccatcgaatttatcttccagcttgcgtacctcttgtcggtaagcggtcatattatcatctagacatgaccactctttcatgacttgattaacaaccaactgagaatctccacggacgattaatcggcgaatgcctaaagagattgcaatccttaatccatggagtagcgcctcgtattccgccacgttatgggacgcagaaaaatgtttccacaatacatagctcaatctttctccagtcggggaaatcaagacgaccccagctccagtgcctgtgagcctcttcgacccatcaaaatgcatagtccaatactccatcttttcctctggcatgtcttcttggcactcggtccactcggcaaggaaatcagctaaagcttgtgatttgatcgaagttcgtggcttgaacgatatatccaaagacatcaactctaaggcccaattcgcaatccgtccatttgcttcgcgattgtgaagtatatctccgagtggaaacgatgtgtccaccgtgaccgagttactttgaaagtagtgagataatttcctgacggtaattaagacaccatataataacttttgaacctgaggatatcttgtcttggagtcggctaaaacttcgctaacgaaataaattggacgttggacttttttaatatggccttcctcttcatgctcgacaaccaggaccgtactcacaacttgggaggttgccgacacatttaacagtagcggctcttgtggatgtggcgaggccaaaactggtggagtggtgagaagtttcttgaagtcttcaaaggctttctgtgcttcgggtccccactagaaattgtcagtcttcttcagcaacttgaagaagggcatcccccgctcgccgagtcgtgagacgaaccggctgagtgccgccatgcaaccagtcagcttttggacgtctttttgggagcttggcggtttcatgttgaggatggcgttgattttcttcgggttgggctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactatatcatcaacataagcttcgacattgcgaccgatctgaattgaaaaacatctttgaatcatgcgctgataggttgctcctgcgttcttcaatccaaagggcattgtgatgtagcagtaggccccaaagggcgtaataaacgaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaagatttgttgaggtcggtataatcgacacacatgcgccattgccccgtctttttccgaaccagaactgggttagccagccagtcgggatgaaggacttccttaataaagcctgctgctaacagcttggttaattcctccttgatcgcatcctttctgtcctgtgcaaaacggcggagtcgttgcttgatgggtttggcgtcttccttaacatgtaaagagtgctcaatcacctctctggggataccaggcatatcggatggtttccacacaaaaatatctttattatcctcaacatgatccgagaggtcgaacttaattgctatctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctccgcgaactgtttgtagacgaagcaatctttggccacgaggttggagttgggatgatgcgggcattgggagttcattatcttgtcgaaggtgttgacgcgggaacgttgtcggggaagatggagaggtggtcgccacaagttcttcgggcttacgcttgcgatccttgtggttgttacttccactccctcctgcggtcggcgtgtccttctttggcttccaagtggtgcccgactgtttggacgcggtaatagcatattcggctttggcatactcgtgggctttttcaaacatctgcttaaccgtcctgggaggtttacgcccgaacttgccgactaggtcctcgtggcgaatgcctttagtgaaggcggcgatgatgatgtcgtcggtgatgtcggagatcttgttgcgttgttcggagaagcgtcggatgtaatctcgaagggattctccagacttctgaacgacattgtagagatcaaactgtgtgccagggcgttcaaaggtgccctggaagttggcgatgaagtgatcacgaagttccgcccatgatccgattgtgccacggggtagtccgtggagccaggatcgggcggagttcgctagggccacaggtagatagtttgccatggccttgctgtctcctcctgctgcgcggattgcgagtccgtagacggtgagccaagactccggattagtggtgccgtcatacttctcgattccagtcggcttaaagccggctggccaatccactcgacgcaggtcattagtgaaggcagctactccatccacgtcgtcgtcgtagcgatttggtgaatggcggtgacctcgtgctgcacggcgctggttgatcgtgtcgcgaaggtcgacgggacgctggtgaggtggagagcgaggccgttcgactcggcgctccctgtgacgttcgggaggcgagtgaatagatcgttcgtcatgacccctgctcctgcgactagatcctgtgccgatgatgctgaggcttggctgatgataatcatgagatcggaggtgagggactcggctatcagtcggggtgcgggtgcttgcggagttggctggaaccgaggcagcgatcatggtcttcgtctggttcaagatgttgacaacatgatcaacttggttgagtgcgtcttccttgaggagggtgtcgaggagagtgattgctgcaaccgcgttctgctgggggtgcgaaagaccgctgttccatcgacgtcttgttgcccaatgagctctctcgctcggcgcccagattccaaggcgcgttgccgtcgatcttcagcctcctttgcaatccgttcgtgatcttgttgctcgcgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggagcgtgtaattatcctcatagctgtcgtcgaagttgtcgaggtcgccgtggtcatagtggtagccgaaatcgtcgtagtcgaggatctcggttggtcgagaactgacgccgggggagctaaggtaaccatccaactcttccgtcgagactgtcccaagaggttggagtataacgccaacctctctagatctagattggatcggggccgaagccggagctcgcctagatcttcgagtgggagatgtcttggcagtgaagacagcggccaaatcatcaggaagtttcatcaggattgagggataggacccgtcgtcttgatctggtcgcggaagagtagattggatctcgtccgagtggtttgaagccgactcgggagagatgctcttggagtaggcctcggccgagttcggaataccgaatggcacggggacctggtctctccccgactggttcgggtccgagtcaaggagagagatcttgccgaagtcgttggtgatgaagttgaggctgccgaaccggaacgcctgcccgggagggaaggcgaagtcgtcgatgccagaaacgaaacccatcgcacttagtcggcgagaacttgacgctacccctacctggcgcgccaactatcgaaacaagatttcgacaataataaaagggggtggctatcaagctaggaaagtggatgggtttggagacaaggaattttatacaggttcaggccttcttattcaagaagtaataccctactcctgtccggggatgattccgccgagtgtgttattgattgtatgattgggagaaaaagaatcgtcccgagaggaacccggacccctccttatataggggaaggggtccgtattacagagtacagtctatatcctaacggaatatgggattacagataaaatacaatcgtaaccgactaggatcccgggtattttcttgacatacaagtttagaatctaacccgagtcctcataaagatattctatctatatttggtaccatatatccagctggaatataaccgccatgtagatatggggtaaccataatctccacagtaaaacttatatatatgtgttcttagcgacttaaacgacaatcttcgacgaaaaaaaacttcagaaccaagttttaaaatttaaattttggcatcggttgatgctgaatagagtaaacgatgggcgcgagggagagatggctgcgccgccgccgtgcacggacgggaggcggccatggtgtgattcgaaccggattctagcaggaggaagacgaaatgggccgatacgaaatttgggcttggatgtgtgggagctgaaagtcacttatgctatcagccatggcccataccactagctggcacgctgcaggctgctgcgtcactgaaattccccacccacgcatcgcaccgcacgtcgccggcggcgggttgccctccccttctccgtccccgtctctggccatcctccccatccatccgccgtgctgctgcctgctatagcgcccctaggccggcagcccgccaaacgctgccccagctgggcagccacgcaaccagccgtctagcccactccgctcccagcgatagggccggagccggtcacctacacctccctctcgctcttatcctttgcatacttcgttctgcatctcgtctgatcgatcttctcctttgtcatctttcttacagttgcaagttgcttcttcaatggcaggttcggaggatttgagcggttggcagcttcacttggagagttacacgtggaatcatctgttagatggatctccctccccttgagcccaacggctcaagggggccttgacccgcgccctgatcgggggcgcccagcccaatggctggtgggcccccgtcacactgtgccatataaagaggggtggagg

SEQ ID NO: 65119 - DNA, 3325 bp, Oryza sativa
ctccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccatcctagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggcgcaagggccgctggcagcggcgacgccgctccgctcggccgctccgcccggcggcgcgctagagaaaaagtgggcgagcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggcctgggggaggggagggggcgctcgcccgtgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaattttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaaatacctcgaaagtataaagagccagtttactggttcttcaaagttttatgcgacacagctgataaagcagctttttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcgcctagaactcgcgaatggcttcacacttttacttccagatgtttttatgtccattctttgcaaagaaacttgataataagtgtatccaaattggattctgatagatatgaaatggcaaatgtgaactatggtataataatgaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggttattctgaaagatcaaagggtcatcgtttctactgtctaaacagctatacaaagtttgtagaaacgagacacgccgtcttcttggaagacgaaatgattagggggagctcggtaatt

SEQ ID NO: 65120 - DNA, 1447 bp, Oryza sativa
aaagattcctttatgattataatggcactagtggcacattatgatttggaattacatcagatggatgtaaaaatggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacatactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatca

SEQ ID NO: 65121 - DNA, 2895 bp, Oryza sativa
gagattgaaattaaaggagacagagatgtagacacacagctcgtgtacatacatgcatggaggcgtttcatcaaacaccttgcgcctgcgggagaggaggagaggatccaatcatccaaaacgaaggcaactgaagaagttgtaaggtgtggtctgccgtctgcggcggggcgaaatgtgtggtgtgggctaaaatatgtagtgtaggaagtaaggcccaaggcccatccgatatcgactcgactcttatctgtgtgggccgtcgtcgtcttcaaccctcctcctcctcggactaggactaggactcggactctccccttcctcctcctctctacctctacctctaggcagccgcaggaggaggccggctgcgctgcgctgcgcgatggaaccggagagggaggcatcgtcggagtggggagatggtgtcggggcgctgggtttccgggtgaaggcgtcttcgcgcgagccggcggcgcagaaggcggccaatgtgctggagccggacctgcgttcccactggtccaccgccaccaacaccaaggagtggatcctgctcgagctcagcgtgcgtactagcgacttgttctttcttccccctctctaactaggagtctccttctctagcggtagcggaggagaggccctgaatgaattgctgaatttgctgctgcaggagccgtgcctcctctcccacatccgcatctacaacaagtccgtcctcgagtgggagatcactgccggcctgcgctacaacaagccagataccttcgtcaaggttcgcccgcgctgcgaggctcccaagcgcgacatactctatcctgccaaccacaccccttgccgctacgtccgcatctcttgtatgcgcggcaaccctatcgccatcttcttcatccaggtacaactactagtataacttttactcttcctccggatatattccgagtaataagtcactcttcttcttcagctcattggaatccctatacctggactggaacctgacctccagcctctagtcaactacctattgccacatatcactgcacacaaacaatcctctcaaaatatccacctccaggtttgtttcttcttcttcttcttcttcttacttctgtctgtgtcttggcaacatataagtttcttctaatcatgcaatttttttgatattagttactcaaagacattgcaagcaggctaccaccatttctgccccagattgaggtaagctttccgactagcatgcatctccccatgtccatgtatggtatgttgtgcctttgttgtttccctttaatcgccgctgtctatctgagtgcaggctgacctcgctagtgtcacagacactccagagagcagtgtacactttttggctctgcttgctgggccattttatccaatcctccaacttacaaatgaaaggtgccagttccttgttcaacattcaactgcatatcaattattttttttatactaagctctgtgctgtcctagattatttttcggacagcttatgtgtttgtgcaggttgctgcacaaacatgtgtgcgcacacctacatgcaagcactgctatctgaaacaccttcttattttacagggattttactaaatcattaattagctctgctgattcagatgctctgaaaagtagtttggcttctactccaacggtttcttcaaactttgaggcatgtagtttttttatttccaatgtacttctaccgcctttctagtttctgcattgcactatgataatgtgaaatgttatagctgatatatgctgaaagagtgaaagctttgattaaatggtgctgttgcacttgctgctttagtaacacacaattttcatttgtgtgaagtgtctgtaagacctaaccttaatcttcagcacattgttttctcgagagactacgggaattcatagtgctaactaagggtatagacacctggctcctttagaccttaccttgaactataggaacagaagctaatggcaggatgcatccccacagtgacataataaaattagataggttttatggttggatccaatagacaaaaagtccttcataactattactctgtgggctgcaatatctatgtaagatttgacttaatgaaaactaagaaacacaacttgtttcttttttgaaaccaaaagtagtatcatgtaaatcatccacattttcttatattttactggagctttctgtattccataaaaaccatcatgtaaaccaataagacaatttgggatggttggtcaatattataaattattccctccattccaaaatataaggctcaaccacccttaacccaaaaaccaagatattatcacatcatagtttggatcatcctaatcctatatacttatagttcatccccactaagtgtagttaatgctatttctcttttctctcatgaagccacatcatctcaattatttctagcctttggatgatagatctatggtacacatagtctcttctttcttctctcataaaaccatgcaatctcaatttttaggctcaaaattcataagtatcaattacataaaatatgttcaccttgcactatattggaaccatgtgtaaatcgtatagaacataggaggtcattttgttttggttataaaatatattgtggcttatttgtacatattatacaacttaatttcccacagaaagacggcggggtatttatctagtaaatataatgcatgcacccaacagaattaaagatcttgagtatggaggatttaaaaaataataatttagtggaaaagaagtgctagttaatagcatgcattcattccttatattatgaaacatctcgaaaaagtagttgcgccttatattatggaatggagggagtagtaaattattactac

SEQ ID NO: 65122 - DNA, 1366 bp, Oryza sativa
cctttttggtttcaattgtagcctctgttatgttgcaagcttgctgagaaaggttcagacatgtggtctgtcttaccacttgttcaagctctgcttccaggtattaagtggaacatatacacttgtgctttatattttttactttttgatccaaatggccaaaaaaaatgtgaatagatagaacatttgttaccaaataatgtacatattcccccatgctcattcatatcttatcctatatataccaagtgatgacaggcctctgccaactggtgtaacataatgacacctttgtttttgtggattttctgggatttatcctttggcctctccgttggcatgggcctaaggctttgggatgattgtgattaactgcctgacttcacccattcgttgagttagagaaggggaattcctgcagttgcataagcgtacaacacagatggctttgttgactggtgtcactgatagtatgctttttctctctcgtgttcctgtagcacttcgtcctccacttagccctggttctactgaacagattgatggttgtcttagccaatggaatcatccaaatgttcataaagctctctctcaggtacctgaattggcactattttattagctttgtcatgcatcacggacatcacttaatattcctcaagttaactgtttctgcagattgctacaatgtcaatgtcatcatcagttcttcatcctcttctcagagcctgtgctggttatctttcatcctacctgtcatcacatgtttgttacataactctctcctacaaaaatatcccatttcttctgaaaattagtgatgtctcttattttcattgttaggcaaaagcagcctgtgttttgcttgacttatgcaggggaccattatcaccgtgggtacccatgatcacggcaaaggtctctttttatgatttttccccacacttatttctacaatccatatctttttcacaaccttgtatactctttaaacaggtagaccttgccattgaacttctggaggatctcctgggtattatccaggtatgtacaagttaaagaaaaaaaacttagcatggcataatttatgttaacctttgatgcatgtaatctggcatatttctatattgagtaagttgcccacgcattataagaacacttggctggctggagttttattttgcatgtcgctgaagatatgtgtggtatgtaatctggatcctcttggacaaaagtacacagcgaagtcagatctggatgcaccaccgtactctgctattggaatatcaatcaagtgatcaatcaactacctgtagtgctcttccctaagctcagcaattctattcctgttgtgtgtttctagtaa

SEQ ID NO: 65123 - DNA, 1451 bp, Oryza sativa
tcgagtgtgctgaccctgcatcttgagcataacagatcccaggtagaaacgtgagcgatgcgaaaacatcgaaaaagtccggataatatttttgcaaatccgaagttgacacgtgctagcgttgacatgggcctcctaggtatcaaccaatgttatctgctgatgtggaaaaaatcatgtgtggcatgctctatgataaaaacacgctacctgaccagtctttttcacctggaggctcattttcaaattcttgcaccagattctacccatctgccaagttattagagcatacataatttactcatctgtatcttaccatacttctataggattgacacttttgtaccaataactaataaataaagaaatcaattcttcaatttatttattttttattttgggttgactcttgaaggcatttaaatatactatgtgtgaaggtggtatgacaatattggtcatgttttctcactacaaaaggagtatttttccatgactatgcgcctttcctttttgccatcctaagttaatattgatgatttgctttgttacttcaagtcatgatttacccaaatttatgtgggatcaaatggttttgtttcttttaatgtttttcagggagttggtcaatctcttactcgttctcgtgcagcactgaagtatattgcattggccatatctggccatatggatgatgttctcacagaatataaagtacattcatttttcctcctgaaagtgagcttttccttggtgatttgttttacagactccttaacttgtattatgtaaatttacctactcaggacgtcaaacataagttacttttcattctggagatgctagatccttttattgatccttctgtaagtgttatgacagatgcaatggcatttggtgatgtgtctgttgtgcatttggagaagcaagcaagcgcttgcaatatttcgttaaatattattcgtacagcagtgaagaggcctgctgttctcccttctttagaacttgaatggcgtcgtggtgctgttgccacaaggttggtgaactctatatgtttacatgcttatcataaatttgccattaagattgatctgaacttgtcatggttgatgagaaccagaatagtactgtcattatttaattgtgacttcctctggtcacaaaattctccattggaagcatgcaattgaacttcatcattgcagaaaaaaagaatatcttggaggaactagttttgcctttagctaataagaaagatatgcacccaagtttgaaccaaagaggacttgggatgtatcatagaacctggtaaaccgtgtgactttagcatgcacatatgattgacggcttaaacattaaagcatttctctagctcagacctactttgtatgctggtaaaaacatgctaaatctagatttgatttgcagtgttattctctctaccttggatc

SEQ ID NO: 65124 - DNA, 903 bp, Oryza sativa
acacattcaggtattaaagcaatatcttcaggagcagaatagagacacgcccttgaaagcaacagcaaagacattcgtgtcaaatacccctgttctattgcataagaaaattgttccgcaccattaaggatgctgttactggatccaagaaaggactgtagatgatttctatcaacaaatggaatgtattcagtaagcaaagccaatgcatgcttccttaataacatagaagaatcatagaaagccaatgctgctactcggtcccaggtatgagtaaccaaaagggatgttactgttgaaccagatgagagtgaattttgcttataagtagtatattcagaatcaactttagttgtgctcataataatcctcccaagttgctgcaatgcaacagagcgctgttctggttcagcatgactcaacaatgtgcagaaaagatcaatcaatgaattctcactgttcttaaggccttcaattccataagaaaccaatattgataaccatatctctgtctgaagcctccaagatatcctgggtgcatgagagcagaggtgtttcattgcagaagacatgacattaagaacattatcccaagcaagaatatttggaagcttaatcatataatcgagcataactgatgccacctgccagcactgcttcttctgatttactaaaatggtttctgcgaggccttggagagcactctcccagtgtttttgggaaagatcagtggatatttcagtaccaacctcttgtttgatgctactatagatcatacctccttcggcaatagactttaggcattttgcatacagcaaacattttgcaatcgataaagataacctagaggccaactgaaggtgccatttccaactgccctcaatagatggtgcaaggtttgat

SEQ ID NO: 65125 - DNA, 984 bp, Oryza sativa
agatcaggaaatagcgaacccagaatgaatatgagaaagggcacctggttcttattgccaggtgtatcctctgattgtttaccaaactggattgtttcaaataactcttcaaaacaaagtaactcaaaatcactgcattcagtaatatcacctgatacatttccattatcagtactcttccttaagaagtgtgagatcattggcttcattaggcacagcacagaatcaaggaaagctacatcagtgtaagaagctctacaaagtgacacaagaatgtgcaccatccgtggcatttcaggaacaataacttccaagtgctcagcgacaattgactcaagtaggtagaaaacaacagcctttgccttagctgcaatgtttccttttaaactattaactccgtttgcaaatgcaagatgctccctaatatttccaagataaggccacaggcacatttctgaaaaccaacaaagaacatcatgcactgcactttttgggagacattttaattgtaacccaacagcttccaaaatgctttggccaaatgcatcaaactttttgctcatactcggaaagaagaaatgcagttcaggaagtaaaatctgaaacaatctcatgcttggttggtctgacagcaaaggttccttcttaagaagcacatagttattgcaaccagattgttcaattttagcagacttggccttctgagtagtaacaccacccatcaaagaaagttcatcggtgaaaattgacagcaaagatgtaagctgtgagaagtcagaggcaagaaatagctgctcatttaaatattccttggcataacgggacactgccatccatccaaaaaatcgaggtagtggactagaagacctggaaaaatctgatatcttatgtatccatgctgatggaggaaccagacttttaaaacggaaaccatctcttttaatgctgacaagttctctagtattatcactgccagacgaagca

SEQ ID NO: 65126 - DNA, 1368 bp, Oryza sativa
ttagcctacttgttagttgtcattgcttgggatgtacacactagaatgcatcctgctatcatgtagctctgtttatatatttgaactgcttacaaagcaacctgtgatcaaatgatggttgtgcttgttgataatacaaagcaaaggtactacaataagttgatttgcgtgtgttttgttcaggcaattcggttgatgatgatgctattgctgatgatgatgtatgggatgatgtttcggattctcctggtcatggatccacattagacagagagtgggttcacaggcagaaccagtttcataaggtataaacctaaggcagcaatttgattatgggaactttgccctattcctaaaggaatctgtgaaattgttatgttccatttaaatcatctttactgcaatatatttctttagttatgatttgtgaaacttgtgtttggaccagaatgtgtaaagtaatctttccatttttcctttagatgggatacagggatggtatagcagaaggacagaaggacatcgcccaagaggggttcaatgttgggtttgggcaatctgtgcatgttggctataagtggggtcttgttcgtgggattaccaggttaaaatggatatttgccattccaagtatagttcttgtacgcagccgcttgtagcatccttattgattctgttttctgtttattgtccttaaaacagtgcattagctagtctccctgacagcttgaaagaaaaattgttgcccaatgtccagtgcagaggacaactccaagaactgaataattctgtgcaagaaatttcagcagaagacgcacttcagatgtttcatgagagcattcttcagagtagccattcatcagaggaaccagatgcaacattatagagagctacagattccagtaggttgcaaagcctctcaaaggatcttgtgattttgttgcatgaatgctcagatgtgaaagttagcgaagaactgagaggaggttcataaacaagttggcggaattgtgagcactaccaaccctatgtctggcctagttgctacttgcgtcgaatttcagtttgctgaacatcgaggaagatggtgattcaggggtgttgttggagatggaagcgattcaattccttgatctcacaaccatgatttgctgtttcgaactcaaaaggcttaagcctcaaagaccaagaaattaataagaatgtaattgtaaatcttgtaactaagatttcactgatcatataagcctttccttttcctgctagatataaccggtttcgtatctgtaactcgcagcatgcacacacacacacacacgcatttcattagaactttggcagctgctaagatgataacttcctgaatat

SEQ ID NO: 65127 - DNA, 5706 bp, Oryza sativa
gattggcacttctgacggtacatgttattctgaatagattcagtttattggattggaggttctttttttacccaatcctgtcgttaaatctacatcagaacctatagcaacagagtttttccttccctatttcttgttacatgacatgtattcaggttacatgctcgcatatcaattctgatttcttgttcccagcaagtttggcaccgtcttattgtcaacacgcttgcacagagactggcagactgctgtcacatatccaattctgatttctggttcccagcaagttcaggcccatcactctcctagcggtattctgaaaagctacttaaacttgccatcacttatcagtcaagttagatcacagctcagaacttattaagatggcgaaagatatgcatcttctgttagtgattacaggagatataggagagattgaatggataataatagttctgtacccatagataatcaagacatgctattgtagggagaacaaatgctgtcaataagagttttattgatctttgcccaaggaatacatcccaacactcttgccacttcgcaagtctcgtacacttacacattaatctatcttatatttttattaaaaaatcataattatttagttgatatacaagaaattggtgtacgtctacttaagagattagaatccatttaagagattagaatccatcctcgatgtcatggccatattttttttttgcttgtaacgataagaagatgaagatgacgtaggctgcctgtttattatcaaccaacatatcagctaacgagaaacatcggttattttgtagtatacacaaaacgtgttcactatcatgcacacgctgctgatgcacactcttttttaattatatgggctctccatacatatatgtgtgtatataaaaagtgtacgtacgagtagtatgtagtacgtagaaatcttaattagtctatggatggatggatggatgattggatggaatcaggagtgcatcatctgattattattattgtcgtcgtcgtcgtcgttggccggatgggttccggcagggtgcatctccgtctcgtgtagctggcggtagcgcttctcagcctcgggcatggcgcccatgatggcgcggaggcggaggttgacgtcgtcgaggcggtcgtacacagcgtcgttggtgaacatgccggcgcagaccttggtgatggtggtccagctctcggccaccggcagaaggatgatgacgaccgagcccacagtcccccacgcgatcgccaccgcggcccacagcgtgaagtagccaaggctgtacctcctcgccggcagagacagcgcaggccacgccacgacgatgacggcggtgaagacgaggccccacctgacgatccaacgcttggcgtgcaccaggcgctcctccttgagctcgtcgtccagcgcggcatgcacgctctccaccgtggtgatcatctcccggctggtcccccagtcgtagtgctgcgggcgcagcaggctgcacgccgcgtgcaccgccccgcccaccaggatggacaccaggttgcccgccagcatcggcgcgttccgacctgtggtgtccaggttcacgcgcccgtactgcaccttggccaccgtgagccacacggccacgcccagcgcgcagccggacaccgcgccgcccatggcgcccaccgcgttggccttgctccacagcagcagcagggcgatggggatgactgcggatcccacaatgactcccatggccaggtacatccaccccagggacacccccgccacgttgagcaccacggcgaggacccccatgaagcagccgaagccgagcacgacggccctcgacacgcggagtatctgcttgccggaggcgcccgggttgaggtacgtccggtagatgtcgtaggtgcagagggaggagacggccaccagctcggcggagccggcggatgtgacggccatgaagagcatggtgagtagcaggacggagccggacttgcccatgagcgctgttgcggtggccgggggcaccaggcccttggctgcctcggcggcggtgagcgggaggtccagggcgagcgcgccgaggccgagcgaggtggccagcgagaagggaacggcgaaccacacgaggccgcccagcaggtagcccttgtgggtggaggatggccgggcggcgatggcgctcatccagtagccctgcagcaaattaaattacttgtaattaattgacgatccaagataattattagtactacgtacgtttgggtacgtacgttgtctacgaacaccgttccaaagttgccgacgatgttgatgatgccgaagacgagcccccccgagctgagcatggtgaggtaggagcccttgaagttgccggcgacggggccgcacgcctggccgttgcgcgagaggtcggcggagcagtcgcgcgcggcgctggcgacggccatgaggcgatcatacaccacacgcgggctcccgagtttggagctggaggtgtagacgaggaagacgaagacgacgagcaccgcgtgcacgacgacggagtggatgtagctggcgaggaaggtggccttgaggccgccggcgagtgtgtagacgacgacgccgagcgggatgaggaagctggcggcgtagacgttgactccggtgagggcgttgacgacggcggagccgccaaggaggagcatggcggtgacgatgacgttggtgaggaggcagaaggtgaggaagacgaggtgggcgggggtgccccatcgggcgcggacgatctcgcagacggtgtgggcgttgggggccttgcgcttgatctcgatggccatcacgccgaagaggagcacctggatggtggcgccgctggcgtaccagaatggcccgctcaccccgtactgccatgccacgttcgagctctgcaggatggtggcggcccaggtccactgcgacacgatcacgctggcgatcagacccgtcttcacgctgcgccccgccgtgttgaaccactccgacgtgtgctgcgacccgacgtaacgcttctcaagccacacctatatatatatgcatacgtacgtaggtagtagccacaaattaattaatcatatctctgcgatcgatcgatcgatcgatctcaagagaggagaggccgaaggatcggaggctaaccaggaaggaggtgaagagcgcgaagaaggcgccgaagccgagcacgacggcgtacccgacggcctgcgtgagcaccggccttccgccgaagtagctgccggcgcggctgcacaccccgttcaccaccgagtagtactccgccccgaaccccagctccgcaggagggcacacgccgctcgccatcgccagcttcaatccaatcgatcgatcctaattaaatggggaatttttactctaacagacggatagatggatatgtactgtactagctagcagatcagagatgtgtgcctagcctattaggcgcgtatttatacacgtataatgaccatatatgcgatgcaagcaaagatacactctccagtcatagatgcgatgcgatgcgagcttaatttggagtgattgggtagttgagcacggaatcttctcttcttttgacccagtcatccactagctagctatattccagctgcatgcgtacatcatagagtagtacagtatattatacacactcgtcgttttctctgatggcgaccagattatacaaaactccatttatttcgttttcgcaaagtccaacttagtttactcacttatatataacaccaaacaagggcgcttcacttgtcaacaacacgtactgcacgctatcagaatcgatagctacacttccgtcgattctctctgcttcctcctccgataggccaggtttaagggaaatggcactaattaacaagccactaggatccagttgtaacgataacaatccaaggtcaaaatcgcccgcacacaactcgctacataattagttgctccagttgcgcatgaatgccatgtccatgtttctgtttgtcaacgcacaccgcttgcacccattctatttgtggagcaaactctgttttttttaaaaaaaaagcgttctcacaagtcatcgaatatgcaatgtcaacggcttacattaagtatggcagaaaatctttttaatcccctctaaagacgcagccgcggcctctccacatctgcatcatcgtggaggctgcctaggccgcgggacggcgggaggcgtggccttcgcttctggtccgcacctctattggatggatggatccattctctctagtgaagtttgatgaaacgcatgaaaatttccttacttgtgtctctgttctttaaggataaagcgacaacgttgccgcaacaggaattgcaacggttaactgctacattattttttaacgcatctgcctgtaaacactatataaataatatattttttggcttcctaaaggaagtagcacaaatagttgatagttattgttaccttccctcacaatggatattgcaaaacaggatgtgagcttttattgcttattcattgctttaatcctataccgtggacaactaaaaagagattggatagacctgaaagccttttgtgtgtatgcggagtcctgcggaaagcgaacatgcccgtacctatagtctacctaggatcgatctaatcctaggggaatatgtgactcatagtggaattagttgaacattgaaattcaaactttggtaggcaacccgtatagtctattgtgtacgggcattgagtattgcctttaaaaaaagggtatatgagactgccaaataatcgttcgatgaggtttaatgggatttcagacactttatgctgctcattgatctagggtttcctttgtagtttcttaaggagatgtttgtagtaccttgagaatcaggatgggaatggctagggtcaatccacttataaattgaatcgatccttaaatttactctaatgaatctttagaatcactccaaaatgtaaacggatcaaaccattagaacttgcacaatcctagcaacaggcgtccaattagtaattccggagtgccgcagccatggcgatggttgcgcacatgacctccctagctccaagctgcgcactgctacactgtgggcctcacatgtattggacggagggagtgtattatccaatggatacaggtaacccattatgggccccacatgctttgtataataaatcgttcctataaaatccaataagtttttatagtgtgagcacgagttttaaaaaaattgtatgtccgagttttacctacatgtaatacgaattttttggtctattagtaatgcagatgatccatttgggtgttcatggataatctatcgatataatgaactcgtagtggattgaccttgttagaccatggatccataaactcagtggaaatggtttaggcacgattcatatcctaaccattcccatcctgacttggcatactccaaaaagccgttgaagtgaggcctaaaatcttgaaaatggaagttggagattttgatcaatggtgtctccatcatcgccaaccacagtaaacaactaatgttcttgattacatttcataatgttcactgtagatggtcgtatggaatttgacggaggctaagatgacatggtaacaagattacaagactatggcggtgtcttatgggcagttttatggatggggcaa

SEQ ID NO: 65128 - DNA, 1201 bp, Oryza sativa
ctgtccatttcgttgccttcttgcatgtggcctcgcagccgaccccccatgcgttccatgagtagagcagcaggaggaggaggaggagggataacatgagagacgaggggacgggcaggtggcgcaacatccctagcactcacaaggcacgaccaaggctgcaacgatgacaatttagtagtggtagcgtcaccggctcctatagatagaaccaaggataaaggtatgtcctctaattggtgcaacacaggcctagatggaaagaagaaaatggtagcaaaaggtaatgagcttatttaattggaattagttaggtggcccgcacaattgtgcgctagcacctatacaaaatgatctaactttttacacatggttttattaaaaaaatgttaaatagccatttagttgccttagtctttcaaaagatcgatcctatcatcattttttgtttttagttttatatttttaaaagtcacaccagccaccactctctactctttcgccacactttttttttctgttgcccgacctcccactgcttctaatcatcatccttgtgacctttaaaaattcaacctgatatgcacacactagttttttacatgcaatgaacagtagcttcttctctctctttgtatagggccaaatttgccttaatttctagcaccaaaatgttgaggtgtgtctcattcattagattctgcttcgatcagtataaattcattttggatgcaacaaatagtagctttcctattttgtagtttattaatttttcccaattttgcaattttcatatgattttcgaatgaaaatttacaccaaatttaagacgatactagtttggacctttcaagtgtgagcgtattttggctttacgccttcgtgtggagtaaacgccctttctgttgggcgggttcggctggatcttttgttcccccttttcctttcttctccggcagcggcggcggcgatgggggacggccgcgtcggaggtggaacgaatcggccggcatggctgcagcaatacgaactagtgggcaagattggcgaggggacctacggcctcgtcttcctcgctcgcctcaaacaatcgcatccccacgctgccgctggcgttggccgccgtggctctcccatcgccatcaagaagttcagcagtccaaggagggcgacggtgtctcgcccccgccatcagagagat

SEQ ID NO: 65129 - DNA, 704 bp, Oryza sativa
ctaagtcaaacctcttttgtgaccaagcttataagaaaatatagcaacatttccacaaaataaatatactacaaaaatatatttaatggtgaatttaatgaaactaatttggtgctttagatgttagtacacttcactataaacttggtcaaacttgaagaggtttgactggacaaaactgaagtgacatataatatgaaaccgagggagtatttaggatttatgcgtttttcatatgggcatttatcttaattgctcctttcagtttctgaattctttgattccctccagacacaacctaggagatcacggagtccatcttctgttcagcctgcttgttttctggcatttcgatctgaaacagccgtactgctcttaaggaaagcacacagagacagagcccttggaattgtttgcctgaaagtaggttctttgatgtccttttcctttcttattgattacaaactcttcccctcagagggttttcatgacatgtatttattttgaaattaggcatcaaaggtcctgcaagaacttctggagcccgatccattgttagatgatgcttctgaccaagtactttgtacagactactctagtttgtttggagatgaatttaacttatcggagaattgctttgatgcctctattctgaacattttggatattgctgctgttgaagaaggcattcttatatactatat

SEQ ID NO: 65130 - DNA, 5278 bp, Oryza sativa
gatgcgagacattaactcctcaaaggtaggtttcacagaaaacactaattgtctaactgtcattccctcaaattggcttccatgtgtactttcatctaccacacaaccaccataatgaagccggaccaatctatccatctacaatttttaacccatgcataaaaattacttacttgaaaataatatgtaattaccattgcaataccaatacttcaaaagctaacaacatgtctaatttttccaataaataagtaccttactcaaatactacacattattgataaaaaaaactctactcctacaaattacctacccttcaccacacatcaacccctttcaaaccctctcaatcaccacaaatacatcccacatcctaggccatcaccacacatccatctcccatcaaaccctagtgcatcaccaaacattcatcccaaatatattttgtcaaatgtatcaacaacaaccaaatggataaagatatgccacctccacacttcatccccacccacattatccatctaataatccatccttagccaactattatcaaaccacgtctacaaccaaaacaatacaaaatatccaataaaactttggggaacttagggtttatagaggggtttaccttctcttccgatcccaaactcaatgccacacaaatcaccttcgattagagaggtttttgggggagattgggcgaggagaacgcggtggcgaccgaaccctaggcgggcggctggggaaaaacagaggactaactggctggggcggcctcggccgggctcaaagtagccaagatcagcgccaacgtacttggcgctgatgttgggcacctcagcgccgaagcggttggcgctgaggtagctgccacgtcagctgggggatcggcccggccgccacggtggcacaatgtcagcgccagtcccgttggcgctgacacggccaacctcagcgccaatgcgcttggcgctgagccgacggcctagttttagttgaagtttttagcaggggttagtttcgaaataagtttttgaaaagggtcaatttgtcaaaaaaacggctgtttctgcccaaaagctaccaattcgatcgtatgcagaaaagtttgtcgtcagttcaattccctggattccgatgttaaattcagaagcaaactataggctataggtagaaagatacaagatgcactgctgcagactatgtatgatccatcttacagatgagatgagatatgcgtgcgtatatatggtatgtctatgatgatgatggatgaacaattaatggtggaggaagaagaaggagatgatagtggtagtggctagggatgagaagaagaatgcggtggcgagggcttcttggacttgtagcgggcggcgagcagcaggtagagggcgaggttggcgaggctgatgagggcccagagccagaagtagtagtcgaggtgggccgtgtccaggtccggcgccagccagccgccggagccgtcgctcctcttggtgaccgccgccacgatggtgacgacgagcgagttgacgtagaagccgagggagagggcgaggaaggagaaagcggagcagatgctgcgcatggacccgggcgcctcgccgtagaagaactccagctgcgcgatgccgctgaacacgtcggatccagccagcaccacgaactgtggcacctgccacaagatgctcatcgaccgcttctcccctcgcagcctccgcctctccaccagagcagccgtcgccatggccaccaccaccagcacacgccccacgcccatccgctgcagctgcgtcagaccacccgagcgccaccacctcctcgccaccggcatcaccaccacgtcgtggagcagcacccacagcagcatgaacaccacctccaccgacaccagcgacgccaccggcacccggaacctccccccgaacaccctcgtgtccatggccatcccctgctggatgaaggtggtggtcatctgccccagcgacgccgcgtacagcacgcacgtcacccagatgggcactatccgcgccagcaccttcacgcgctccacctcgctcaccgtgcacacctcccacacgccgcccccgtccaccctcacggcggccttgtccagccaccgtaacccctcggtgtgcgccagcttctcatcatcgccgccgttcttgttcttgtcgtcgtcgacttcgtacaggccatcgccgtcggcgtcgggaggcagcgtccgggtcctgttcctgaaggcggccaccagcaccctgaggatggccttgatgggggtgtcccccgtggggaggcgcaccctgtagcagggcgtggctgccaggaacgccgccgacgcgatgagcaggcagagcgtggcgatgccgaagcccagcgcccacgacacgttctgctccacccacgatacaagcgtcccggccacgaagatgccgaggttgatggcgccgaagaaccagctgaagaaggattgcttcgtcttctccggggccggggcgccctcctgatcagtgtcgtggtcgtcgcgctcgtactgctctgccccgaaggggagcagcgcagacttgacgccgcctgttccgatggaggtgaggtagagcgcgaggaagaagacggagaactgggtcccggtggccggtgagcatgggacgccggtgcacggcgccgggcgcagggaggggacagcggcggagacggtgaggagcacaaggccctgcacaaggcccgccctggtacgttatccatctccatgctgcatgtatggatcggatcgagtatgaaagagcgaatgacttacggcgaggtagaagaggagggaggcgaggatggtcctgtactttccccagtaggagtcggcgaggaaagccccgatgacggggacgatgaaggtggtgccattccaggtgtcgacatgggcggcgttgaaggcgagggtgccgtgaaggacggtggccaggtacaccaccaggttcagcgccacgccggagaaggcgatgctctccagcagctcgaaccccaggatggtggccggcccaagcttccacttccacctcttcttcttctcatccctgcccctgctacgacttggtggactacccatcatattattcatgctcatgccgcccgccccggatctatcccctaccaccacctttctagctagtatctcatttcacgatacgaggcagcgaggtcgtaggctcgtagctaccaatatatggattctgtactaatcctcagctgctcctgctcgatcgtatatcatcatcaacaacaactgtccggtttaattagtttgattcgataccatcatcttcttcatcatcatcatacatatcgatatatatatatacactcgactccagactccagtactagtatatatgcgcgcgcgcgatgacaaagtcaaagcaccgcgctggctagctggagaaaactgtctatcgtcttaatctggcaggacatgaacctgattgagaatggaaagccgatatctaactcaactaattacaaaaatgctagctcgtgaatgataacaataaatagtaattcttttagcccgcgcaccattttaaacctattaagagatttaaaacatggcgatgagctcctttttacgctaatttatgtcacgtcgaacatgttttcagtatcaactaaagtggcgttgagaaattttagctgaacgccatcgggattgacggcgtttggaattagtttttgacatagtttatttttaaaaaacggtcaatttatcaaaattacggtagtcataactaaccgatacgtgtatgtgaagaattaagagaagcagccacaaccatccatgtatccagcttgccaaccaccacctccgttacatttttggataaagatcacctccagtacatgcgtatacatgtgcaacgatacaagatagcatagcaaagcaactactactccacacccacacagtggtcaattcatggtggtagttgagcgatccatccatcttgccatcccagctgcagctgcagctaacttggttaatttgcctttgcgtggctagattgcttcccttcaattcaagctatctatctatctatgtattgtatatagcagcaacctaacaacccaaaatgcatttcgatcgaaccaatttggcagcatggcactggcatgcggcttaattcaattaccagcagctgctaccacctgaaactatgaacaaccctttccctttcagactgaataatcgcgtccaactcccagagaaattaagctggcctacagctgactatatttatctacaattaatcctacttgtaaaataaataatactacgtctactgctctgttttaagtcatggggtaagacttgtagttaagatcgaataccactagtattagtatacgaggatagttagtcaggcacgttggattcggccagcagccaagcatcaggccaatagcaatatactccatagtactccagtagtgtatacacacagacgacgacccaaccgcactcagtcagtcagtagattaattgattgatcgatccatttgattagattaatgagggcagcaccgttcgctaggctcgatcgatcgactaaaactaatcacaggcaaggcaaagcacccaacttaatttgtcgttaggacttcttttctccaacgatctattctgacttcctactggagtaggactatacatcaaaaataaatttgcattggccgcttaattacattactagtggtagttaattataataattaaattgcttctctgaagtctggaactagaaacctcaatattattcaggggagagaccatgtgagccacgtgaagtgcaaacgtactctctactgtaatcacctgcttagttgcctaccaaaatatctcttagtcaactggaactgctggaattgaatggattaaaaaaaattgcacgtcgcatgcactagttgggattgaatctctacctctaaaattgatagaagttcatatgtccgtgtcgagcttgcttccgtacgtgtggaccgtgtgaaaatggcataacggagaacccaaattcatagtggctatgttcggcagccatataagctacagctactgcatcataaattcgctgtaaactacagcaattcttaactacttcctccgttcgattttaattttttatttgtactgtttgatcacttatcttattcaaaaaatttgtgtaaatataaaaaacgaaaagttatgcttaaagtatttggataataaagtaagccacaaataaaataa

SEQ ID NO: 65131 - DNA, 7570 bp, Oryza sativa
cttacattgtgaaacggaggaagtagtacatagggagtactactgctgcagctgcaaaaataccagccgaacacaaaagtgtttctacctagaatttttgtagatatgctctcacctccctccgcccgtcgcctctttcgccattgcagcagccggcgcgcgtgaatccatgcagctagcaacggtgtgagatcccgtacggcgcagggatggcgatggcacgaatccagcaaggagatggcagccacgtttgcgtatggagaacccaactgctggttgaatcctcgcatactaatactagtggtattcataaacttcaagtcttattactactccatgacttaaaacagatcgagattcgagcagtacccaaatccatggggctcaaatctgatttgagggagttgggcatggcagcaactagtagttggattctaccacattcaatccaactatagccaaagttcaatccatgcccttctaccgcgaaaccagatatagaggatcccttgttccgtgaaaccagatatagagtgtccctcaattattaaaactagatcaatttaggttcctaggcggttgtgatggtggttttgtcatgcgtgacgtcaatgttggcatttcaattagaataaataaataaatgaaatatgcagaccttacatatcattggcatcttcttcctctgccctctctctctctcatatcctcttatttctctctccatcggtgggggatgggcatgagataaagcgttctccgtcaacgggagcaccatgccggagcatgctctcgatgacagccatgacgttgaccagggcaaggaacaacgagcgtgcggatagcctactggagcccattgagctcaccattttgatcaccaatgccgcccaagccacactgcccgccggatcgggaggcatatttggtaatgctgcaccccttcaccaccgggttgcactcgtcccatgctccttcaccaccaggagtgccttgagcaagaagggggtggaggagggtgttgtgattcagtcagcggcgtatgccgcacaaagaaggctgcatgttcacagcctaggaggacctagtgtcccagaccatcgagcgaaggaaggcgactatggtcttatacacctcgatggttgtcgttgtgccgcccacgacgagaaggctacaagaaggcaccggtgctagtgagaggtggtaaaaagggctcttgcaagtgggggacattgtaacaaccggccctctagaacctcgtagcgcaacacatccgacgggtgggcacacttacacataccacctcacttattctttcatccttgcttcatgtaaaagggttaacccgagagtgatatggttggagtgtcatgcctttataaattggtttcacccttgctaaactagtattgtggtactaaacatacgcacacaactctcatgggctacataggtcacgtcctaattagcgtatgacatgccatgacatgtgcctcacgcgccatatgcccacacattgattcatacgcacaatcacgagggtcggctacgcagacagttctcatgggccacataggccacatcctaattggcgtatgacataacatgtgcctcacacagagcccacacgtgtcatgcgccatgagcccgcacattgattcgtacgcgcaaccacgagggtcagctctgataccatttgtaacaacccaccctccaaaaccgcagagcccaatgggtcggcccacttacatatatcatcccacttacactttcgtcctcgcttcgtgtaaaagagttaactcgggagtgatatggttggagggttaggctcttataagttagttctacccatgctaaactagcactgtgatactaaacatgcgcatgcagctatcatgggccatacatgccacattctaattggcccgggatgtcacaaacatccacaatgatgtgctagagcgtgtcctggacagtcgcacaccgcaccaggagcttgagcttgactagagtacaccgtcgtgcaaacctgcttctccgcatgccaccaccctcgctaatgtagtgagcctgaactccgccaatgatgatgtcaatgctcgtagatccaacaagggcgcatgggatgagacgcgcggaggcacgtagggtgatgagataactatcgttgcccgcgtgcatccaaatccccatgtcgttccgccaccgctgacagcggcggtcgagcttgggcacaaccacccttctcattgcctgtggtagcgcacggggacttggtagtgtccattggacttcaccatcttcttgctccatggggggggggtgcgttgtcaccttcatgtccatcgctgcggccgtgcaactccccatccttcctcctcactcccgcctttcgatcttgctcgtcgatgggcacgagcaggatctccggcggcgcgggcggcagcggcatcgtgttcaccatcgccaactgtggctagggagggagaggagggaaggggaagaccacatagcttgcgcccgccgttctttgagctcgttgcgctccatcactgcccacctttagtagtgagaaagcggaagtggcggtggccgatcggtgagggagcatgaggagggagggggaatgttgggagagagaggggaaagaaggtgccgcccgccaggggagatagagaggtgagagtgaagtgggggaagtaggacccactgacaagcattttgtttatttttttaattttgcttataatgacacttcaacaccgcacgagacaagggctaagtcaaaacaactaaccatgtaggtatccaccaaccaatccaaaccgtttttggatcttgtctgcactagttttaggatttgagagacgtgttatatctggtactgtggtaccaggacgtgattcaaactctacgtcaagacaagggatcctaagtgaacttattccttgatttgcaggtgggattgggaagaggatattttcctttccagtgggttaggttgggcagcggaatgataataggcttttggcccatattccattccactttttaaaaaaattcctcatgcatttgggctgttaaatttctgtccttttcttttgtgagggtaagagagacttattaattgaacataaggagcattacaatcttcaagcaatagacgttgataccgtccagagtcgactccagctagccaaagagcactactacggcagcgtatagcatgctgagctagctcatgtgatacctttgtttattattttgttcttctgtttaccttggcgatacagactccaccaaataatatgtgaccaaaattacaagactgatccatactagtgccagaagaaaccgaatttgcaatttgtgtggaaatcctgtccttagcttattaggtgaaggaagtaccaactagcaaggagcaagtaattgtcagggagtgtgatcctgaagaagacaaggacaagagaagggagccaagtattgagaaggcagaagaagcaggaagacaagctgaagacttgggccgtcatccagctcgtctgaggaggcccaataccaaggtccaaggcccagactgggttgcgtgagtcacttgctcgcctgtgagctggcgtgatgttggtgttagttaaatactgttctgtaaactgaattaagacattgaattggcaactggaggcgtaggcggcggcggctcgatcctgttggatctgagaggaaactatcatagtgaaacccaattatgtgtgtgcttgagtgaatccttgtgagccctaacaatctggtatcagagcccttccgtgctgcatttcctcttgatttggctgtaaatttttctccagagcgaggtgggatttggctgcttcggcggtgagaaatccacaaaagtttcggctccctcaatctggttggctaaattcggagagcatgtgagggattacggtccaaaactagccatggatctagacgccaagtttgatctcttgttcaagaccattgctgacaacgagaagaagaggatggaggcggaggagcgtaccagggcggactacttggagttgaagaagacggtcgagggccgcataccggcgatggagaagaaggtggaagaactaggtgagtcgctgcagtccttgagcaccaaggtcgagcagctggaaggcaacacgatgcggcaagtcaagtttgaaccattctctgctgcaagtgcttcgggtgttcaaggaggagctaaggaggagcagttcggaggtgttgcgggaatgtttactcctaatggtacgcctgagaaattttccccttcccctattcctttcaattgcgattcggcatcacccacttttggtaacggaatggggacaatgaatctaagtagtgctattcctcctatgacttgccctcaatttactggtgataacccccaaatgtggaagtcaaactgtgaacaatattttgatgtctatggaatattgccagttcactgggttaagattgcaacactcaatttttctggtaatgctgccttttggtttcaatctgttagaaatcagatgagtgggatttcttgggtgtctttgtgtgatttggtatgctccagattttttaaggataggcagcaagctcttatcagacaatggttccatattaagcaagagggcagtgtttcagagtatgtggaaaaatttgatagtctgatgcatcagttgctagcttattacaactccctgttgcctgtttactttgtgactaagtttattgaagggcttagaagtgacatcagaatggtagttttggttcaaaggccacaagatttggattcaacctgctcagtcgcattacttcaggaagaggctatggaaggtgttaagttccagggctacaagagaccaaacaattcagttatgattagaaacaactcaccagccccgatagttggacaggcctccacaccccagaaaatcttctctcctcaaattactgaagatagaaggggcactgaagctgcaagagcaagagatgacagactgtcagctctgaaatcctatcgcaggtctaaagggctctgtttcacctgtggtgaaaaatggggtaaggatcataaatgtgccacagcagtgcaattacatgttgtgcaggagcttcttgatattttacactcaaaatctcctacataaattgaatcttctggtggagaacaagaaattgatgaagtgggagatttgatgtctatttctcaacaggcagtttgggggactgaatcctctcgttctatcagactcatcggctgggtgcagggtactgaattattgatgctgatagactctggcagtactcattcctttatggatgaaacagttggttctaagatggtgggtgtttctccactcaggaagcccttgtctgtgcaactagctgatggtgggtccttgttatgttcccatgagattgctaattgtaagtggtggatgcaagggcattctttctctagtaatttcagactcttgaacttgggtggctatgatatcatattgggcatggactggttggagcaattcagtcctatgcaggtggattggtcacagaaatggatggaaattcaagttaacaaccagcctgtcaggttgcaaggtataacttcccagactaacagttgcaatgctatctctgctgaacaatgcttgggtatggctagaaaggggtctattctgtatttggtccaattgacatcttctgtttcagaaatctgtgacactatgcctgaagcagtacataatttacttctcaagttccaggatgttttttcagaacctactgaactccctcctaagcgatattgtgaccatagtattcctcttgtacctgtggcaacacctgttaatttgaggccataccgctttaatcctgctcttaaggatgagattgaaaagcaaatttctgatatgttgaaatctggagttatccagcctagccacagtgctttctcatccccagctctgttggtcaagaagaaggatggtacttggagacttgtcattgactatagaaaattaaatgccattaccatcaagggtacttatcccatgccaatcattgatgagcttttagatgaattatctcaggctaagtggttttctaagttagacctacgagatgggtatcaccaaattagaatggcccctggtgaggagtataagacggctttccaaactcatactggacactatgaatacatagtaatgtcttttgggctgacgggagctccggctacctttcaaagtgcaatgaatgatactctgaaaacagttctttgatgatatcttgatctacagccctgattttgagtcccatctggatcatattcaccaagtactagccttactgtctgaacatcaatggaaggttaaattgagcaagtgctcatttgctcaacaacaacatacttatcttggccacaccatcagtgctaccggtgtccatactgatcagagcaagatccaggaagtgttaaactagccagtaccaaccactatcaagaaattaaggggtttcttgggattggccggttactatcgaaaatttgtgaagggatttggtctcattagtaagccccttacaaatcttttgaggaaggatgttccttttgtgtggaccactgcaactgactcagcttttaaccagcttaagtaggctctggtgactgccccggtcctagccttgcctgatttcaagaaggtcttcattgtggaaactgatgcttctgaagctggtattggggctatgttatcacaagacaatcatcctatcgctttcattagtaaggccttgggtccaagaacaaaaggcttgtctacttatgagaaggagtgcatggcaatcctcatggcagttgatcaatggaggtcttatttgcagttgggggagtttattatccttattgatcatcatagtcttatgcacctttctgaccaaaggttacacacaccctggcaacataaagctttcactaaactccttggcctcaattataaaattgttacagaaaaggtaccagtaatgctgcagctgatgctctctctcgcaagtttcaggatgataacagtgaattgtatcacatttccagctccaccccactctggttgcaagaagtaacaaaagggtatgctcaggatcccttttcccttcaattcctcactgaattatctgtctgtccaacttccaggaagcatttttctctctctgctgggttactgaaatataagggcagagtttggattggtaacaatgataatttacagcttcaactcatgtctgcactgcatgacagtcccattgggggacactctggctttctagttacttataggaaaatcaaacaactgtttgcttggccaaacatgaagaaaatggtaaaaacctttgttcaccagtgccaagtttgtctccaggccaaacctgatagagcaaagtaccctgccctcccttaacctctccctgttcctgaaggagcttggcaaactatatccttggatttcaatgaaggattgcccaggtctgagcattctga

SEQ ID NO: 65132 - DNA, 2919 bp, Oryza sativa
ttgttgtagacaaattctctaagtacagtcacttccttcccttagctcacccatttttagctctatctgttgctaagctgttcatgaaaaatatctttaagttacatggtttgcccctggttatcattttttttagagataaggtttttactagccaactttgggaacacttgtttgagggagctggcaccaagttacatttcagttctgcatatcatcctcaatccgatggtcaaaccgaaagggttaaccaatgcctggaaatatacttgcgttgttttgttcattcagttccttccaaatgggctgcatggttgcatctcgctgagtattggtataacacatcctatcactctgccattcatgctactccatttgaggtcctttatggtcatcccccaaaccattttggcattggtatttcagactgttctattcctgagatggatacatggttcaaggaaaagaagttgatgcaacaacttgtacagcaacaccttcaccgcgctcagcagcaaatgaaacactttgccgacaagaaaagaagtttcagaacttttgctattggtgattgggtatacttgaaacttcagccgtatatacagacttctgtggctgtcagagctaatcacaaattatcattcaagtattttgggccttttcaagtgatttagcgtgtgggcagtgtggcttatagactttaattaccacctcatagttctatccacccagtgttccatgtgtcccaattgaagtccgctgttggattctctggtcttgttcaatccaaactgcccactgatacttctacattgcagtttcccttgcatattttggacaggcgtttggctaagaaaggtaattcaactgtcactcaagtgctaactcaatggtctgattctctcccagaggaagccacttgggaagatatggaggatctgcgttcccgttttccagctgcattggcttggggacaagccaattttcaaggggaagggcttgtcaggaagtgtgatcctgaagaagacaaggacaagagaagggagccaagtattgagaaggcaaaagaagcaggaagacaagctgaagacttggggctgtcgttcagctcgtctgaggaggcccaataccaaggtccaaggcccagactgggttgcgtgagtcacttgctcgcatgtgagctggcgtgatgttggtgttagttaaatactgttgaattgaattaagacattgaattggcaattggaggcgtaggcggcagcggctcgatcctgttggatctgagaggaaactatcatagtgttgccaaatgtgtgtgtgcttgagtgaatccttgtgagccctaacagtaatacaatgttcacaagttgggaatatgcgtgttttcatagttttggtctgctgatggatctcggtaggatgtacgtaattctagcagagatctggtttaaaagctgaaagattttttcctgttgcccctaggggttgtattttctcctgctctattcaataaaaaggcactctagtgctattttccgttaaaaaaagatttttgttaagaaactgcagaaggtaatgcatggattcagccctttatttggtttattttttatttggtttatatacatgctcaacgaatcaagtggaataataatacaagaatggttgattggaataatacaaggcagtgttgggtggatgagggagacgatcagtgcgagtgcgggacggcgagtctcttgacggtataattcttggcaaaggcggcgtacaccacaaagttgatggcgctgatccccgtccagagccagaaatagtagtccagatggccgtcgttgaggtcggcggggagccagcccttgttcgaggtggtggtgacgacggcgacgatggagacgacgagggagttgacgtagtagcccagcgagagcgccaggaaggagaaggccgagcagaggctccgcatcgacacgggggcctccgagtagaagaattccagctgagcgatgccgcagaagacgtcggagcaggccaggatgacgaactgcggcagctgccacgcgatgctcaggttgccgccgtccctgacgctgcgcagccgccacgtctccagcacggccgccaccgccagcgccggcaccgccagcaaccgccccacgcccatccgctgcagctgcgtcagccccgcggggttcccggtgtagcgcctggcgatcgggacgaccaccgtgtcctggaacaccacccagatcatcatgaagatgacctcggcggagttgagggatgccgccgggacagagaaggatccgatcttggtgttcatggcattcccctgctgcacgaaggtggtggccgtctgacccaaggaagccgcgtacagcacgctggtcacccatatcggcagcatccgcagcagaatcttcacttcctccacctgcgttaccgaacactgcagccaccctccacccccaccctcatccttatttatctcttccacctcctcaaaaaccactgccgccttatctaaccacctgaaatgaaacaaatataagtctatatccaaaagtaaccttttacacaaattaagattatcaaaattcaggacaagtgacacagccccctgtcgatcatcccatccattactgttgttcggtttatctcactccttagttcagtcggcttttgccttatgaatgggtagtgttgttgttttttttttgtacaattctatctactgcggcgatacactgggacgtcgtccccccttgaactgtgtttttaatcttataaataaagtgatgagttctcgaaagaaaaaaaattcaagacaactacaactatatcagctattttttagaggaagaagaacaagaactacctaaggccagcttatatatatgttcgccttgggctgcagga

SEQ ID NO: 65133 - DNA, 808 bp, Oryza sativa
aggttgtagtaatgggatgacagcagaggcggtaattacaagcaacccctggtttgtttgtgtacatatataactcagatagtacatacttatatggcatgagcacaacacatgcaaatgcaaatgagaggaattactactagatagctagctagtattaaacgatgcacaaaacgatactagtacatggcggatgcacttacaataagatagaaaactgtagagatggcaatggtcttgtactttccccagtatgtatcagccaagaaggctccaagcaccggtgtaagaaaagtggttccgttccatgtatcaacattggctgcgttagaggcggtagttccatggaggacggttccaagataaacgaccaagttgagggagatgccagcataggcaatgctctccaagaattcaaaggctacaatgaatgaagatgtatgaagtatttatattaggatacaactatggagtccgtgattagatttaaaaaaatgccaaattggcagatttaactagacagttgttctgcaatcacaagacaagtattctgacaagtgtggaaaggcgttatattcatttttcataggagtatatggttaattaattatgtatgtgtagatagatccatgcgactggtggatcgaggaggaagataaattaattaagaagggggtgggggctggggttaccctacccaagataagagcaggagccttccagttgaaggggggcttggtatagtgctgattggatgctgaagcctgcaagcagaagggaggcgaggaagacagtgagtactgatcga

SEQ ID NO: 65134 - DNA, 17806 bp, Oryza sativa
  unsure (1)..(17806): unsure at all n locations
aaaattgatgactactccactgccacttgcaacctgtgagctgctgttttgacctcgtggggatttttattttctttttcaattatttatacatatatttataagggaaaaggattggtgacccacgacagccacgagaaagcgacacagactgatgggcttaactgggcccacgtcactaggccggatatcaattgggctggatgcaatatgggccttcatctctctcgtcgctcgatccctcttggactcctccccttctcgaacaaaccctaacaacaacagacaagagagaggcattgcacgatgcggcggtggtgcgccgccgccggcctcggcctcggccgccgcctcctctcctcctctgtctccgcccctgcccaccgccctcttccggcgcacctcatccccagccccaggccattgcccttctcctcccgccaccacctcttgactcctcctctgggtctccatccctcctccccaccgccgatgcaatggcagacgcagcaggtgcgccacttcgccgccaaggacagatcgcgcgcgccacggacgcccaccacctccaaggtcaagaagtacaagatcaagcccccctcgtacgcatccctccttccactcctctcttccatcattcaatcactattatcaacttctcacttactacttttttactactagctccatgaagtttcgattcagagtcatgaatgacggccaggtccgcaggtggagagccggcaagcgccacaatgctcacctcaaggtacaccatcttccatcttcttccccccatgcctttcctgctaggcctaggaccttatcatctctctgttgcttgtacgtatccattgttttcctagtgaaacctaatttttcgatttaataatgatgtatcatgatttttcagtttattactgttatatcatggatgatgaattccctgctctttgttactatctttttttgcaaaaccgcatatgtctcatcgtggaaacatggatttccctgccattttctctctctctctctctcaatatgtagttcaccatgatccaacgccaatctattggttccgtgcccaagagagagagagagagatatgaatatggaccaattcggtaaaccttttagatgtcccgtaacttcagtctccagaaaatcataatgaccatcttctcttctcccccatgcctttcctgccactttaacttctctcttgaatgcctgttgcttgtaccagtgttcagtaccaaactttcgatttatgctgtctaaatggaaattttgatttgttactgttatatgttggatggtgaactctctgctctgttatctttgcaaaaccacatatgtctcatcatgaaaacatggttgccctgccattttctcttcctcgatatgattagttttaccatagtccaacgccaatctattggttccacgcccgagagagagagagagatgaatatagtggaccgattcggtaaacctttcagttgtcctgtaacttcggtctccaaaaagttgtaacaaaatctgacaacaccacttgagctacccttcctcctcctatacgctacacagaatcgaatcaaactcatttccacatagccaattgcagaactcattaaacattttccaaagttcattgatgcatccatgtctttcttatatgatcaaagttactcatagccactttaacttctcatttctactcactatgttatttagctggtactgccggccagtgcacaccgagtttgtatgtgatgctattgtttatgttgttgcagtcgaaggaagcgaaaagaagacttcggaagcctgcattagtgcacttagcttatgcaaaagtgataaagaagctcaacttctgcagctaggaaatcaggacagacatgatggagtttggcatgcgagacagattgatgagtactgagtgccaactactgcattcctcacactgatttgaaatgttatttttttcccaattgttgtttgatgcattctcatctggttttgttttctgcacaatctggctgataaagcccacccgtcttgtgctatgtacaatattcagcataatagtgggataactgctgctggtgaagaaattggtcttgcacacacatcgattctacttaacgtcttcatccaagcttcaggccaacttttaacatggcaatatttctctgagagtttagatatggacactctggtcacacaaaggcatagttgttgttttctcagattgcggccagtagattttctgctcgagggtgaatgccgttgatcatcgccaggcgattttgagtttctgaattcagttactgatgatgatgatgactacatcatgcacacataaacctaaagataagagcatagcggacacgatgtgccttgttgatcatcagttccagggagtgtttgagacggaattggtcgagaaaatcaacaagacgctatatatttcctacattgtccagtctcatcagctagcaccctagcagcaacagggattgcattgtggtaacaagattcttcttgtcgtttgagctttttatcttagctttcggacctcaggttttcctttcagcctgtgcccatctctcttttccttcttttcaattttttttcttcccttcttttgtggggtttacagtgtcctttggactgaatatcgccatctcattcattacgaaatgcagattgggacactgcgaagtgatggagatatatagagatccagattcaggcacacgtcgttgttaataatcgatttagcttgtttgctagttaccctatgcatatcactctccattcagtagaatgttgaatcaagacattgatcgagaacaaccaagctggtaacagcgtcagcgtgaaattacatatcaaactgacctttaatttcggcatgcagcttgctcactatcattagttggctctatagcatcgatagtttttttttctcgaaatattttttgcctcaattttcctcattatcatatagcagcaaaaggcttttttttttgtttcagtaaaaataacagggtaataggatcatactactactccctcaattagtcactagaagaaaatgggttttggacttttcaaagttaatacgactatttaatttcttttgtataaatccaaggttttataatatgaaatctattgctcggataaacttggctacaaatattttaatatgtccaaaatcgacacatcattttcataataatggatagagaatcggtttctatatctataaatggatatacacaaccaaagattacacaaatacatacactccacatctcataatcgagattaaaaaaacaaaccaccaaaaagaaaagacaaaaacactaacttcatgtttttcctcatcacttcaaacatcggatgtggagctagcatgtctttctacctgcacactctctcgttgacactgtagcaaccgtaaaaacttcatttgctctgccatgagcaaaggaaggggccaggactagtccgcccagctgccttgacatcaccaagcaccagcctcataccagacggacaatcaatgccccccttagcatgagcacatccatcgccgctatgtcgttgttgtcgtaaaataccacctccgctaagctaccgcagcttatctcaccaaaagtcatcgccacatcgcacaaaagcgatcatgctacccctctgctgtcaccgtagaatctcacatcagacaagtcacggaagcttatctcgctagagaatcatcgcatccacgctgtcatcaccacaaaccacaacctccgtcgagctgcagtagcttatctcgctggagagctgccgccacaacaccattgtcatcacaaaccacaaccttcgccgagctaacatcacagcatatcttgtttggagagtcgccactatcgagtcgtcttcacccctaacctctgccaccacccttggcattgctcctagcgcgccgctgagctgatcagccaccaccatcaccaccaagcaagccaaccgctactactgccagcaccaccaccaacaccgccatcgccacctaggccccaagcactgccacttcgtatgccgctagtagctaccaccgtcgacccttccacctctcagaatgcccccaccacctccgttgtcactgccatcatgcctccatacccaccacgacctgtgctagctagggcctacgtcaacgccgccgttcgcctctaacgcggctttgccccgtctcggccgacgagacaaggaggaacgggagggaaggagggagaggaagccttatagtcaaattaacttctcgaaggattgaataacaagaactaagcctactagatgaggggtgaatggtaggaacaccaaaaaccaaatctattttgcaaaattaaaaagttaccctcaaatttaatgaagatcaggtctgaccgacgtgtgtgtttcgatttgactgggtagatgccgctggtttggccgacgatgctcttttgatctggctgccttgctcaccgctacaacctcctgacgccaccggtctatagacgtggataccgccgatttgaccaccaccgcaccaccagttggaccgccgctttgccgtcgatgtgaccgttgagatccaaataaaaacatatcaaagaaactcttgaaagtagatcaactttattgcattaatatatgtttataaattgcatctaaaacactcctccctctcaactcacgaactaggcccgaagcaaatagtaactttcctctcccaaaacgttgatatccttctagtctcaaccagtcttctatttatacccataacattactgcccctagccacgaatccaactagaactagcactcctaatcaacataggaaacctatcaaaccaggcaaacaatgtcaccatacaactccacactccaatcttctcaaacttggactccgttttaaatttgacctatctttccataggcacaactctacgtgtatgtcatatgaaaaccttcacctccacatgcattgttctctagcctgaacatcccattgtctagcgtgataagtcccaatccatcaccagctacattcccatggcctcaactaacacctacacatgaagaacaaaaaatttcatatttgagtataagttcgcaccaacttgattcacatcagcacacaatagtatcacatacgaataaaaaccatctagaactcatatacatgaaacaatctataaattccacaaaaacaatccaaaaccgactccctcctggagtctgccggttcgaccgtcgggcactccagttagactgcacgaacaccaccggtttgactggactcctagagccgacaaaaaccgtccacaataaaaaaaactattcactgtattttaaataaatactttactttgataattgttcatcaccaagattaatcatcacatgattgtgcaatgtggaggcattctaaacgatattccttttgtgacgggagggagtaacattttaactaacaattgtggcgtgctctgtaacaagtaattaagcacgtacgctagcttacattaggctatatatagatggtaaagtagctagctagctactagtagcttacaagaaagtgtggctagtcgaacaagccgaagctgtgaggatagtcttgatgaaacaagaggtggtgcttggtgtcaataatggtacacagctgatggtggtcgggctgcagcagggagggggagatgatcacgtcctcctgcttgaggtgagtggtcgtaagacgatcgtggccagtctgactctgatgatgaactggagtactgtcttggaggcgtatgttggatgagttggaggaggaggggcgggtggagccggcgagggcgttgcggtgggttggccatggatggttgtggtcggaggtgtaggtgacgacgagcattgtggggtcggcgcggctgcgctccacctgcttccgggcggagcaacctttggagctgctgcagcggtagtacccgcgagggtagggcgaccccttgatgggcttctgcccgtacttcctccacgcccacaggtccgacggcaccacctcgccgccgccgccgccactcgcccccgccgggatgcacaccaccttcttcgtctggctcttcctgtatatatatatatacatccttacagctagctaggtactactccagtataagaagttaaagaatacctacgtaccttcgcttgatgggcggaacgacataatgagcaccagcaaataactcctcgccgtcgccggtggtgtcctcctcaatcgtcgtcctcgtcctcgacgctccctgctgctgcacctgcactactggtggtggtggcaacagcgcatggagaaggtcgcaagctgcagaagcatccaccatgctctgctgctgctgctcagcgtgttggctcactgctgcaagctggtcttctcctcctcctcctcctcctcctaagaggtgcacatacggcggcgatgcagcctgatggcgaggcgccgtctgcagctgaaggctggccctcaccacatccgagaggtccccttggtcggccgacgactgccaaaacaagctgtcacacatggtcgatcgacgctatatatctcgctagcaagagatctccatattaattccagaggagattaatcaggccggccggacagggattatatgtatatagtattgaagaagaagacgacgacgacgacgacttaactagagtatattgtggccaccatgccatgcccttgcatgcatatatgaatatataccagcacaacggaaagaagacgaaggaactaacacaccccacatccccatcgatcgatcgatcgaagctagatagtgcgatatatagctagcaagagataggtaatagctagtcttgtcatacatcaacaacaaccgatgatgatgatgatgagtactagtgtcactcacctacagctatactagagttactccatcatccattcatctctccttttaggctttatgtatatatatttccatttcctttcactaccaccctgttaattttactttgatgcatagttattgttttgattgatctttgagtgggtcggcgggcacggacgggactgattgatggatatatctgtcagacagacagaccctaaatagattgatcaacaattgttgatgggtgcatggccatggcgatctcaggtatcaatccattcacccatccattcatatacatatactgtatctcccccaattaattcatccgatcctcactgtcgatgtgctatctatcttgtgtacttttccatatgcatgattaggcagctttcatcaacagcaagaggcatatccatgcatgccctccagataaaaagctatactccatagtacctttaattcgacggacggcatggttctttttacatgagaaattcatcatatatctgatgattatgcaagcaattgcaagtacagctagctagattaattaaactgtgtgcatgtagttcatcgacaatcatatcgaacgattacaatgtcatccgctaattgtaattaatacttggaatttagtggggattgtccgggcccacatgtcatccgctgctactatatcaacagtattgcataggatgtgcatcccttggacttaagtagtactgaatatatatcctatctttatatatagttggtacccattaagaagcatttacttctataaagccacataatcaacaattttaagccatcagatcatattagtataaagataacaaccgctgaaccaagaagctacttattcattcaattcaatcatttattagttatccatctattcacctccctttgctccacctcatagtcacacgtagcactgctacatattttatgcataacaccatgttttccggatataatatgtggttattgtttaatatgtatgttttattttattatgcatgataaggttgcatataattattaggtatagttacctgaatccattttcagaaaaaacttgagtggggtagagagatgcaaactgtttaactacaacgatacccatattgcgcatgaagataatattcatatattataacaatacacaatgacacttgaaaaaacaaaacatgaatggtattgtaataacataaggcatatataaatccacattatcatatattttatatatacatagagttgcacttaaccatttaaaactatgattttgtttgacgataaatctataaaacccatggcaaagacgcggggcgggctgccaactagtatatatgtatgcctgacccatgattcttgtgtagatatctgtaaaaattattaatcaaacaaaatgcattttggagctgccacactgctagctagagtagctagagttggattctcgtttccaaggattagacgacaaggtagaatgaatgaatggacaaggatcgattaaattaagctagcagctagcaaccccatgagttaaaactcagagcatatgtagtatgtgcagtagatcagcaagtgcatggactgtggtataaccggccgtatatgtttagtataacctgccgatgtttggatggtggtttagggttgggcgacggaccatggaggcaggggttgtaggggttccgagcgaaagcttagcccaagtcattgggccaacaatgatcatacttttgggcgtgttaaccctccagaggacactgttgaggtacccctcctctcttagcaaagagctctgggtgtaaaccttgtctagttttttggacggacgacgacggcgtctttcggtgtcgcgaccctcttgagggcataatttttacctcttgagggcgtaatttttagagtcttcgttccgtggtggtggtgatcggtctcgcatagcgatagccaattcggtgcccggcttccctctctgtagcatgtgtttaggtggttggcacatgatccggggcgtgtgctctggtgtacatccttgcttgatagccaactgtcaatgtaaaacttttcttgtaacattttcttcctatcttaataatattggatggtctccttcggctattccagcaaaaaccagccgtatatacccagagattaataattaggctgcaatactagcactctcttcttttacatggaaacaaattcaatagtccacatccatagttttttttttagaaatgcttttcttaatatatactgccaattataattcaaatggagtccattcaattcactgccgcacatcgttacagatgagagcagtttggtcgaacctaattaatgcatccaaggcatggaatggaggagtaactaaaaacattactcgcagagaactggtggtactgatcgatcgagtgtgattttctttcctctgcatgcagtgcaggctagtaactgatcaattcaagtgtgtgtgtgtttgtgtataatattcctaattagatataacaatcatcactagtgcactacagtagtcgtatggcgacttgcatcaagaatggaaggaacagaaagttgtttgattctccactgcatatattactataatgatatggcctggcgatcatacacagtatcatattattggtcgatctgtagctagctgtacataacatggttgcctagtgagctgcatatgttgtacttaacccccaaacaaatacaaagaagatgaatataagcacaaattaatagtgcgtcgcgagtgtctgtgttgtactgtgtaattctaaaaaaaaagtagtgatgtaagagcatcttaaaattttactcctaaaaatcttggattagctagtatcgtcccaaaaaaattgggcccaaatatcacctcctactccaagaatgcccctaaatttgatttccaccaactttaaaatatgccatatcatctcaagtaggttctgcttcgaccgtttatgtctttttatttttccggtaagagagggatcgatgctaggcgctgctaaccaatcgcacgctagcggctcactatgctgtgcaacaggacgatctcgtgcatgccttgcagttgcgacagcggacagcgtgggcatcagcaagtctacaaggcgcgtcgaggagggcagacagggctcggccatctcgcggcagggcactacagagtaacacatgaggtttcttggttgtctcgacgacgccctagacggaggggtagcgacgccttggacggaatggatgccgcacactagtcggagcagaggcgagcttgtcgatgcctttctgagcactgcccctgtgacggagggtcaccaacaccaggagcgctcggcaggatgcgacaactctagattgtcacgagaggagaagaaaaggtgcgagcggcaaaatcctcccatgatttcatcaatggttttgggtgtcagtaaatattgggaccgtctttggatatctctttaagacatggttttagattagattcctataatttatcttttagaactggtattagggagctcttggagatttctaataatctactactttatctgtttcacaatgtaaatcattctagtattttccacattcatattgattttaatgaacctaaatatatatgtctagattcattaatttcaatataaatgtgggaatgatataatgatttacattgtgaaacggagggagtacttgtactggagtagtatactaagtgatttggattaagttttggcagcgcctaaaactcggcccatcccagaaatgggctcccaggtgaatgaggagcccatacagatgaagtctggtgggtggttggcccatccatgttcctcttcttcctcctccgactccgacccgcagccgcaggaacccaagaggagatcggaagaaagagagagagattgaggaggaggaggaggaggagccatggctgcggtggtgcgtggcgtgttgaacggcatccgggagaagggcctctccaacttcctccgccatgcccgcgacgaaggctacttgtaagctacctataacccctctcctcctccatctatgctacgcagggcgccgatccggatctccatgcgtcccgtccgctacctgtttctcctctttaattaggccccgatccatactagtttcctctccccttcgattcagcaccgaatcccctcgattagggttgttgcttcatgccgcccagcccaaccgattggccaatggctatccgaccctcgcttttcttttcgctgcatttctcgataccatctgcttgctccatcaaactgaatatcgcttttgtatcatttgcagcaaatgccttctggatggaaacctcttgtaagttcccccttcttactagctctccgtttattctttttttttacacatatctggatgtgtctgtttgtctccccacaggtcgccgcagcctaatgtagtaattatcatcctctcttttcaggcaaactaaaatccacaatatcggcgccacacttgtaggagtagacaagttcggcaacaaatattatgaaaaactacatgacactcagtatggtgagtgaggtttctcgcatacgctacattttattctattatgcaattttaattcatttcaatcatggaatgtactagagtagcatcaattatcttctcacaacaagacatgctatgctatcctgttttgcttttttttttttttgccatcttgttttcttttcttccacttctgagatttgtaactttgctcataagtgatcaccctgggcttgattggtatgcatgtctttgtagtaatgtaacgtttcttactttctgtctcctccaaagagaggtgctttctacaaaactaaatactggtaaccctgcaggaaggcacaggtgggtagaatatgcagagaaagggcgctacaatgcatcccaagtgccccctgaatggcatggatggctgcaccacatcaccgacagcactggggacgaggcaagttttcttctttgtgttggctgtgtttcctagctttggtcctccgacataactataggttatggtaatgctttatcgtatgccactgacttaggaatttggatcttggaaaaaaaatgtcttgccctcaaaaccaaacaagtagacacaaatttggcatcaaaagtgaaacaaccgaatgtccagacaagtcaaggaaagcttatctgaaaagggcaaatcttggttattgcttcccatggctaaatgagcaaacatgcatgtttagttaagttagcaaacaggggagcctttagaatttactgcagtctgtatatgatgaaaactctggtggtgcttgttacttgtactgtccagtgtgatgcttagaaatgttattaccttttaggcgttttcttatgtaatattcagcggtgaattcacctcccgggcagctgcctaggcttaacgccattgaaccatttagcctagtgataaaacaacaccgatttgattagattccctggcaagttaattagttgtaggtgccaggtagcaagctgcaggcctgtttggctgtgtcccacagcatgaaggtagcaaccggtggcccaaggtcatccttgcctaatttagttaccttcagttaatcatgttgatgtggcccacagtctactcagccagcatgtatcccatagcccaggaaaggcatacaaaaggaatatttttatcttatatttcttgcagagttgttatgatgctatgatgtagtataaatttgagtaaatttcacaaaactacagatttaaggccaagtatcacataacttcatatttaatatcgacgttatcacaaaactacagaatttagaggtcaaatcattagcactaccattatattggagctataaacattgtagttttatgattgaattggcactaaacctgtaattttgataaatttgctacttaatctatagttttgtgaccatatatctaaatctatagttttgtgataaactgataaatttaaaactaaatatgtagttttgtgaaatttactctataaattttcatttatctttttttatctcgcgtctccgaagagacttcatttacttttttattaggcttatctactttttatctactagaaaatctgctggaatttatatactcattggatcataaatttataacaaaattgtgactccgatagaaatttgagcttatagacatgtttgatcatactggttttcattagggttgagcaccacccaggcttccaaaaattgctggctttgccactggtaatagttgctgggaatgtgggtgggtgttgtggttggatgggaaaggtgattctgacatacttgggtatgttgtggcagctactggagcagaatgctaaagcgtacatcgtggatcacaaggagaacttctccggcgagggtgaggaactgatctaccactccaaggggcatgctctaaacccaggacaaagggactggacgaggtaccagccgtgggaaccaaagaaagaagaggcaacctaattaaggcactgatccagtgtgtcatttgatttggtgtctaaaacaacagtcagccggctcggtgggctgaatctgaataatgttgtcttgaggattgtttacctgagaatggaagaacatgatggagttttaattcccatatgatatgtttgtttatttttgatggagcggagcgtcgtccccattgaatggacgagggttgaatgctggtttgctgaaatgaaatattgtcgattgtctggatttgtgatgtgatagaacgtcggtatcgtccgtccttgactgggctggtagctgctggatctggatgtgagagagggctactggctacgtggttggcttcgtctcggtggaatgaaattggggcggaagcggctgccacgactcattgtgtagtgtctgcatgtgttgtttgtgaatattttctgctggctactcctaataataagatattttgattgaatatgacgtatcctagtaatttggaccggcttcatatttagattcattatatgtgtcgcattcaactaaaattttttatatttatggacaaatggagtagctccctactgctaatatttgctgaaggctcacccccaacaaaaaaaaaaataaagaagggaaagggaaagaaagactgctgctgagtttgtgacagcagcaatgtctgtcaaagtttcacaaaggaaagataaagaaagactgctaagacggttgctaaagtttcggcacgtaggaaggaaaggaaaagaaagactgttaagaaggcggctggtttgattgaccatgtgccgttcataggagtagtccatgttatgtagccaaatgactcgtatagttagcttggaggactgagctttgtgggtgggttggttggttggttatacaaagacgctacgagtccgggaataagggggcaactaggaagttcctcttcctcctccgagaacgagaacccacacctccataacttcaatttccaagttatatatatataaaaaaggcaatggcggacgatcctctctccaactccaccaccaacaacaaggtacttgtcgatcttgcttctaccaattccaattactactactccatcggctcggcagattgatttgattgtttgcttcttcttttttctgattgatttcagagggcagaggggatccagctccagcacggcgactgcgagagcgagagcactgcgcccttgctgctcgcgccacacgagtcctaccgcctctccgccgcaatcctcccgtgggttcctcttctcctcctccttcttcctcctcttcttccttggtcggtaataaggctggcaccttcttctgcagcttcctatttccagctttgggcggccttctctatggctacgacatcggagcaacgtctggtgctaccatatcgctcaaggtctctattactatactccactattcatcgattttgttaataatagaactatatattacttgagcgattacccatcattttgctttgcagtcatccaccttcagtggcaccacatggtacaacttgtcatcgctgcaaaccggccttgtcgtaatgcccttaccctctcctccatttgtttctctttttttttccttgtacactaccacaatttcatttcttcttcccaattctcgttatgcttatgcaggtcagtggctcactctatggtgctctcatcggttccatcttggcattcaacattgccgattttctaggtctaatacccccacccacctcctctcttttcttttaacattgccctagtcttctgttttcgcttatgcttatctcttaccacaggacggcgcagagagcttattctttcttctgtctcatatttgattggagctcttctcacagcagcagcacctaacttccctatcatggtggttggccgctttttctatggcataggaataggattggtaatcaaccacaattatcttattcatgccatacttgacactgcaaaacacatacaaacaccacacggtgtttatgacgcttacgctaactctttgctttcgtcaggctatgcatgctgctccaatgtacattgcagagactgctccaagtcagataagaggcatgctcatttctctcaaggaattctttattgttcttgggatgcttgtaagttcacattacatgacctgcccttttccccctctcttcctttctctctcagactacttagtcatttacttacgtttctcttttgcagcttggctacattgcaggcagtctctttgtcgaaggtggtttctggttggcgctacatgtatgccaccagtacaccattatgtctcatcatgggaaattgggatgtgctggttacctgcttcacctaggtggcttctgttatgtgccatacaagggaagaggaatattatggagtcaaaagaaaatgctacccgttgcttatgtcgattgaggggtcaagcttctcctgatttggtttcggaacaagttgatttgattctggatgaactgtcatacgttgatcaagagaggcaagcaggcttcagtgagatctttcagggaaaatgcctcaaagcaatgataatcggatgtggcttggtgttctttcagcaggtggtctcttaagtcatcatatagccatactcgtatgttccatgatgtaaagatgaaactgacggtgtgtttcttatgcacttgctgtatgaatctgtcaggttactggtcaaccaagtgtgctatattatgctgcgacaatccttcaggtactgatgcttttctgtatgaattacgtatttcagctatgtccttttgtggtgctatggttggctctcaaaaaatggaagcccctacatgttataagatgttaccccgtattgctcaagaatataaaaaataatgttattcttgtaaggtcaagtggggctcacgggacctccagacaccatgctttcatcgctttagttcctgtatttttcatagttgtcgtttttctttcatgcagagtgctggattctctggtgcatctgatgctactcgtgtatcagttcttcttggcttactgaaggtatatagtacttcttaatattagttcacatataacacacgctgatattttcaaactttaagctgttccatatttgccattcccctatgaatgaacatgaactagcaacaaanntttancctacaatttagtgacaaanngctgatannncancccnataagnnaggncaaatannancnctggntganncnncnannccntnannttnnttnnttggnttnnnccttnnttggggnaaannttnaaantttctattcganntacgnacaacactaacgaaaaaaaggacacagctagcactcaggcattgagacggcagcaccaaatacctgatgacatgaccatcttgggaggatccccttttcctttttatgtgctgcatctcctctcctcttcatctaaaattaatttgtgcatccataaaagtgaagcttgtttgtttcaagtgttttgagtctccactagaatatcttaccatcccagcaaaaaaaaagagagagaatatcatcaccatgtaagccagagaaaaaacaacatcctttgtcacaaaaatactaacaccaccatgcaacatgcaagggctcatgatgcaacaatgagcaattactaattgtaaaaactatgaagtttcgcgcaacaaatcgatagacctactgccacaaataccaatttaacaaaacagtgagctagtgagctacatgtcctagctgcatcaattcagtgcaacaaatcaacattattgcagatacagttggttttggtgcaagaaataaagaaacatgaacatctacaacaaataactcttgtgactaattttgggaagacaagttgcaacaaataaatactctctgcatcatttcaactgatgttgtgtttcttttgtagttgattatgactggtgtggcagttcttgtggttgacagacttgggagaagaccattactgattggaggtgttagtgggattgtaagtctagcctcaacatatgcactcttatctaaatatgataaaagcagtcatgagcttcttcaataaatatcaattcaatcattcacatgctcgttttctctgttcaatgtgatacacaactgatatctcaatagaactgtatctccttattttctgaaaaaaagtacttaatcgtatattttcatgttcagttgtatgtttctgtggaacaaagtagcatcgaaatttgtagggatgagttgactataggtgctataggcatagtttt

SEQ ID NO: 65135 - DNA, 13767 bp, Oryza sativa
  unsure (1)..(13767): unsure at all n locations
atccgtcattagtaagtgtttacttagcaccacattatcaaatcatggtgcaattatgcttaaaagatctgtctcgcaatttctgtcagaactatgtaattggtttttttcacatttaatactctatgcatgtgtccaaacattcgatgtgatagatgaaaagtttttgttttgtgaactaaataaagtttttatatagaaaatttttgcacgaatattagtttgaaaaaacgtactgatggaaacgagaaatagctaagctgaaccagctgtttagaacacggccctaatgtctttatttgattgatcatctggcatcaatcaatcggctcagtcgctaacaacaaaatactaatactccctactccctgtgtaccataaaaaagaaatctaaaattaggatatgacagattcttagttttaaaatgtattatatttgtattagattggttttcagacagatggagcacatctcaataaaaccaatttaaaattggatttaacataattctatattggttttttgttaggacagagataaatttagaattgaatttaattagtttttattgggacggagcacatctcaataaaaccaatttaaaattggatttaacataattctatattggttttttgttaggacagagataaatttagaattgaatttaattagtttttattgggacggaagaagtagagcgctgcaccctcctcaaatctcaatgatcagtatagtagcagagagatagagagagagccaaaacacacgggttacaaaactccaagcgccaaaaagaaaaagaaaaaagaatgtagtagtaggctgtagctggcctgcactgcacgcctggagtcgtgcagccagaaaggcaaggctgcacacttgctgccgctctcgcctccccatactcagtacagtagctaggaagaaggcaagggaagggcatggcgacgctgccggacctgggtgtgtccgccttcatcaacatcttgggcgccttcgtcttcctcctcatcttcgccgccctccgcctccagcccatcaacgaccgcgtctacttccccaagctctacctcactggccagcgacgccaccaccctcaccctcatggcttcgtcaacctcgacctctgctcctacctccgcttcctcgcctgggtccccggcgccctccgcatgtcccagcccgacctcatccaccacgccggccttgactccgccgtctacctccgaatctacacgctcgggttggttcgctcctccaacacctccctcctgttcttttttactacactacttctactggtattccagattaattaagcaccaccgtatacgtagttgcatttgctttccctgcactgcacattattatgggcatccctcccttcctagtgcaactcttgttgatttgtgtctagtatgtgctcttgcttgcctgtgtctcctaccaaagtcgtcctgctcatacagtactactatggacttcaattatggttgtttccagctgcatggagtatgcgataggaattactcttcttgcttcttttttttgtgtaaagaaaatccttgcttgctacactactgtagtcctttttattttctctgccgctaattaaggagctctttcctgaatactttcgctcatttccgattccatccacaattgattgattggacctcacaaattgaggaggagtgctgcttgccaagaatattactatattgcttgtatgtgtttggtgatgacgacattgtggccgtgatggatcccgcggtaattagttactggactagttaatactccttcgttgaaaacggtgtcggcggataggataatcttaacttgatgtgcaccgcaattcctggccttgtttcatggaggaagagccatagcctgtatattttgtttggggcctagcctacacgactggtactcctatgaattcataatgcagttctaaattaaaatatacacatatatttctaatgtttggcgtgttgctcatgttcttgaatcatgctcgcccactacctttggaaaattgccgtccaacttttgtttgtctccaacgattcctcaatccgtgtgatggtggggactgctcttttacaactggagatgcttttcttgccactttggaacttgcatgaaatttactcaaaaagttttacctatacaggatgtactagtcatattttgatacttgtactcttgtcattctcttatttatagtactgtacagaacaaagtatatataactccaccatcacgtggggggaaactaactaactaacttgtgctagaagtttgaggatttttcagccatagttcctcaggcagcgccttggaccttttctttttccctttccccactttcctgtgagcaaaagttttgagtttgtgccatgagacaaatgatcaaattttatttaaccagtttctatgttttgcacactaacccttttgttttgtttctttggcagcctcaagnnatatgtgttgtggcccatgncatgnnnactggtcggctctgtgngcttggnnttctntnnattccagnnttaatggtnnctctggtggcacgttacttaatttacgaaaagaaattgtctttagtgatattgataagctttccatatcaaatgtcaaccctggatccaacaggtttgtccacaagtatcttaatcatgaactcttagcagtgttaattattctttggcagagctcgtataattgttgatgactgctgtacttgaactctacattgctctggctttatgctttcatttgtagcatgctgaaattgtctgaccatgtcctctgcatttcacttcaggttctttatccatctattaatggcatatgtgttcactttttggacttgctttatgctatacaaagagtatagcaatgtggcatttatgagattgcacttcctggcttctcagaagcgttgtgctgatcagttcactgtaagtgcaaataactaggcaatgctatatttagttctactacaatttatgtatcacaaccaagctccactaaattttttgtaaaggaatagaagagcagttgaacaaatatttggatttaatgtctatagtgttgtcttgctgactggggcatactccttttattgtgatataactcaatgggataccatttaatattgagatccatagttatactatatcacttactaatatattttggcatggcaggtgattgttagaaacatacctcatgtttcaagccattcaacatctgaaacagtggatgaattcttccgtaggaatcatccagaccactatcttggtcagcaggtacctaatcctcaccattgcttatgcctcatcatggatttaaactggaatgatgtttaaagctctacttgatttctgaccgatattcaatttacaaaccatggttattgatgaatatactgaccgcaaaactaacctcaatctggatgttcaggctgtttataacgcaaacaggtatgctaaacttgtgaagaaaaaagagaggcttcaaaactggttggattactaccagctgaagtttgaaaggcatcctggaaaaagaccaattggaagggtattttataaacgttgatcctgtcctttcgtttgcatcaataccaagttcttggacaactcgttctgaattcatgttccccccaagaaatgtttcaagcttgtgaatatttttggttctgcagacagggtgccttggtttctgcggtagagaagtggatcaaatcgactattaccgtgctagaatcagcgagcttgataagaaggtagagctagaacccacagtgtcgtgtttcttaccattcacaggcactcagcataactttgcaggctgttgcatgtatgtttgtatgcatgagtgaggctcttgttcagttttaacttttaacacaagctgtttgttattgtgatctttttagcttgcatctgagcgtcaaagagttctcaatgacccaaaagctgttatgccagttgcttttgtgacatttgactcgagatggggagctgctgtatgtgcacagacacaacagtcaaagaatcctacccaatggctaactgattgggctcctgaaccgcgggatgtatattggcagaatcttgccattccatttttctctctcagtatccgcaagttcctgatatccattgcagtttttgctctggtgttcttctacatgatacctatagcttttgtgcaatcacttgccaatcttgagggtattgaaaaagttgcacctttcctaaggcctgtgatagacacgtaagttagctcccattatatctgtcgaggttctgtaaattgcgccccttttgctattcactcatcatatggcttgctgtataacttgcagaccagtggtgaaatccttcctgcagggtttccttccgggtttggctttgaagatttttctgtatatcctcccaacggttttgatgattatgtcaaaggttgaaggttatgtgtctttatcatctctggaaaggagggctgcttcaaaatattactacttcatgctggtgaatgtatttcttggaagcataatcgctggcacagcttttgaacagctaaatgcatttttccatcagccaccttcacagtaaatttcttcgagcaacctctcttttgtcacatatgctactgtttccttgtcctcaattaactaatgcgatcatggcatatacgagtaaatatactgatatgatccttccttccaatttctgcagaataccaaggaccattggagtagctataccaatgaaagctacattttttatgacatacataatggttgacgggtgggctggcatcgcgaacgagattcttcgagtgaagccgctggtgatataccacctgaagaacatgtttattgtgaagacggagcgggacagggagagggcaatggatccgggcagcattgggcttgcagagaacctcccatcactgcagctgtattttcttcttgggcttgtgtatgctgtggtcacccccattctcctccctttcattatcatcttctttgccttcgctttcctcgtgtacagacaccaggtgagtctgtctgtcggtcatgcctgctgctttggctttggctttggctttgaaagtgatggttgttttggtttggctattcagttaggcgctaaaatgtgttttttttttgtttagatcatcaacgtgtacaaccaagaatacgagagtgctgctgcgttttggcctcaggtgcactctcgcataatagcgagcttgctgatctcgcatgtaactctgtttgggctgatgagcaccatgaaggctgcctactccaccccgctgcttatctttctgccactcctcaccatatggttccacaagtactgcaagagccgtttcgagcctgctttccgcaagtaccctctagaggtgcgtgcatctctcattactctctttgtgaaatcaagaataatttgttcaagtatatgcaacaatgacatctaattaacgagggaataacctgtggtgttggcaggaagcgatggagaaggacaatctggagcgcacgtcggagccaaacctgaacctcaaatcgtacctgcagaacgcttacctgcaccccattttccacatgtttgagcagcagcagcagcaggagcaggagcagcaacgggaggagaaggtagaggtgcgaatcgacaaggcgcagcaacatcatcatcggcaggtagaggaggaagaggaggagagcaagagcagccaggctacaacacactactaccaccatcaccatgagcagaccacaacgacgacacaccaccattaccatcagcatgagcatatgagccactaccacatgggcccctccgacacagctgactcaccctcgccgccgcactttgtctaccattatggcgtcgacccttgataatcgcccagatagtctcttagcttctgaatcactagattgtttgttcttttgttttttccttttgtcaattgggggtgatatttttattcctctaattaacgaccgactggctgctgataattatttaatgatctgttgtaaatgcgaatatgtgagttgattgagtgtgtatatgcacgtaaatcggaaaaattccaatttgactccctcgaatataggccaggtatgcctgatccgtatccctcagcctgtaaaactaggtataatatcgtttccttgttgatgacaccaaaatgactaaggagagagagagtggggtagagaaggaagaagaaagagaatgtggggaggatgatatatgggctctttcatattttttttaattttctcaaatgattgggttgccatatagacaccatgtcagcaaataccaccaacaatactatctgggagtcattttgcaccgattttaatagttggagttattgtacctgattttatacttgagagatacaaatcacatccaatctatatttcaaattgagctttttccatgtaagttctctttgtttctttttaggaataagtcaatttgccgtccctcatttttccgtcgaatttaatcggcatccctaaaacctaatattagaaatctcaaacccaaaccgttcaaaatcaagtcccatgatagtatggatggttgttttagttgtcatggcatcctagtcacaaaaagaaaattaaaaaggcatgtgaggcccacatgtaatcggacctcaacctttcctgacctatcctcttttcccactcactccacctctcccttctcttccctaggagttcgccaatggtgagaggggcagtggccgatgagcttgttcgcgagggcttcggtgatctgcctgccaggctgaagcggtttagaaccgacagaagaggtagctagagttgtaggtcaaggcggcaaatcaccttggcctcgaactcttcagccgctgacggcatccttacagcacccacggcggacattgagctatgcctcccaaacaacgtcctctagatcatggtggccgaagagcgcggagtagtcaagggcaccgcgcggagaagcaaagtttggatggagctcgatcaagttgaggaagctaggcggggtcgatgggctagtcaaaacgtcgtggcctcaagatcaagcgcccacatgtgttgtggaggtctcccacttttttttggcacataaatgcctaattagaacgagtggacaggtcaatttgcaatgtcagggaaaccaaccatttatactgctgaaggaacccggttttataagttgttggttctaataaggtataggtattgcgatttagggatatcaattaaaatcgagtggacttattccttgtttctattgggctagaatgggctgtgaaatggcggattggggccgcaggaaatattagtccataggaggagataagatgatgccaaaaccaaacacgcaacttataatttgaaaagcgcagagagtcagtcacaggctcacagcgcaggagcctcacgctcgtcttccttttttgcgtgaacctcctcctctgtctcctctcctccctgcgatttctttttttcctatctctctctctcgatctctgaagtctcaactgaaagcagccgccgccgccgccgccgaccttaatttccgattccttccacccgccgcctcaagaaaccgcaatgcagcccgacgccgccgccaccgcccaccccagcttgagcttctactccgccgccacgggcctctacagcagcctccaccctcccctacccctcccctccgacccctctctctgtccttggtcccccacctcttctcccatctccccctccaccaccattccctcctcgtcgatgcccccaccgccgccaccttctcctgcgccgacttccgccgcctcgtctcctccctcgccgccggcctccgccgccgcctccacatcgccaggggatccctcgtcctgctcctcctccccaactctctcaccttccccgttgccttcctcgccgtcctcgccaccggcgccgtcgccaccaccatgaacccctccagcgcccccgccgagatcgccgcgcgcctgcgggacaccgccccctccctcgtgctcgcctccacccacaacgccgctaagcttccgcctctcgccgccccgctcgtcctcgtgcccgacaccttccagcagcaacatgatgatgatcagttcgacttcttcttccacgcgctgctcgagaccgaccccgaaacgccggtggagatgggggtgggggtggggcaggacgacgccgccgccgtcctctactcgtcggggacgagcgggcggagcaagggcgtggtggtgacgcaccgcaacctgatcgcaatggtggagctgttcgtgcggttcgaggcgtcgcagtacacgcggcctgctcgtgacaatgtctacctggcggcattgcccatgttccacgtctacggcctctccctcttcgccgtgggcctcctctcgctcggctgcacggttgtcgtgatgaggaggttcaacgtcgacgacgccgtcaaggccatccgcaagtacaaggtgacgcacctgccgctcgtgccgcccatcatgtcggcactgctcagggccaacccgcccttggaattggattccttgctgcaggtctccagcggcgctgctcccctcaaccacaccctcattcaccacttccttcacgccttcccccacgttgatttcattcaggtccctccactccttcccctctctctctctctatatatatatatatatatatatatatatatatatatatatatatatatatatgcattattaattgcttctgtcccatgtttctcagttagcgtatcaattaaaaatgtggctgctaatgaatattttgtctttatctactgcatgtactacattttactcagctgttagggaatagtatatatgtggaatgggctctgaaatctccaatatatcttcatgcaatgtttgcacaggggtatggcatgactgaatctactgccgtaggaactcgcggcttcaatacatgcaagcacaagaagtatgcctcagtaggtcttttagcccccaacatgcatgctaaaattgttcatctggaaagtggttcttgtctgcctccaggctcttatggggagttatggctccatggcccggctataatgaaaggtaccgtgtcaaaaaaaatttactttattcaaaattctactatttttgcagtctgatacaaaagatttgataattatttcaaaagttaattaacaagcctaattattcacatatgctggtatgatctggctgcttggaatcttatatgaaaactacgcttttctactgactctagtttcttctgtactctctgccatcttgtttagctcctttagataatgtggttattcttgttgactgaagataacatggtcattcttttttagataaaaacgtggggtggtcattttttttttccactgcagataacagaatcattctgattttaaccttgtgtacttgctctgccgaacactaatcgttgcagtgctaaacactaaactctttttaaatacggtactgcattaggactcccatgggttgccatgcttagccaaaaaagaaagattcccaatgcatgctgctctcgaggaatagatttagctgccttcactaagtattgttcctgagatcagttaggcaaggttcctgagatccatggggaatggggatttagtttagcttccatactttagtctgtaacatcatatcccgctttaggtttgaatcatggtatgctgtacttgttacctctttgtatttgggttgtcagaattttgcttcgtcacaggttacttgaatgatgatgatgatgctttcactagaaaggatggctggttgaggactggtgatattgcttactttgattcagatgggtatttgttcatagtgggtcgcttgaaagacacaatcaagtacaaaggatttcaggtatggcctcctgtagcaggccttggaagttggaatacaatatcgttgttcttgtttcaaggaatttcaggtatcatgcaaggaagtctttggttgtaacaaattggtgtatttttcttgccttcagatagctccagctgacttggaagctgttctgatccggcaccctgaaattattgatgttgctgtgacatcgtaagatttttatttctaaacagcgtgatattatagctgttttatctgttatcatgtccttcaacgtgtttctttgattctctcgttactttttttttttgacattgattctctcgttacttagtgatgaagatgaagaagctggagagatacctgtagcttttgtggtgagaaaatctggaagcactctttcttgtacgcatgtcatggagtatgtggccaagcaggtaagaacaagaaggtcctacacaacacaacactcaccatattttcttgcttgggaacattacaagataataataacagcaagtgcacagagtgcattcttgttagctagagtatcaaattccagtaaaaatggatcactacaagctttatgcccacctgtgcaaataaatatggcagatattagttagtctcaagtcgtgttggtcagtgtgctcctctgcatccagcccacctgttttgaaaacagagatgtggttgttgtcagttgagcccccgtgtgtaccgatgggaatgtgtaactgatatgagcctgtctgtcagttggtttggccgcagccatagaagacattgtccatccagaagctggttgttctttgaccctgcccatccaaattaacaatatgtctttttttttcctgaagtaataatccttgggctgatgctgtctagtagagtgcttaccaagtagtgtgatgttgtatactgttatggtgggtgcaggtggcgtcgtataagagagtgaggaaggtaatattcgtggaggcgatacctaagtcagctgctggcaaggttctgaggaggcttctcaaggactctcttgttgatgcttccagtggcagatccaggctatgatcagagaagaagcaacatttacgcattcaatcaaagattcattttggccgtcaagttaggccaggcctcctcccgtttgttaaaacgaaaaagcaaaaggtccgggcaggccttcgttccaaagattttttttatttagaaaaacaaagaaacaaacgaggtcagtccaggctggcttgtccagcagcatgcctgttaatttccctgtagaagagtagatcctgaccagaagtggtcaatttttatgtattgttacttgtagtcgctcatgggtaggaatatgcttaagagcatatgctcttggaatactggtgggattgatgaaggtgtcaatgatataatactatggttgcaaacatatatatgtaatactattaacttgggccttgttatcgatcatctggtattttgttttctgatggatggtaggatgcgtttaaatcgatctctgtgtatctatctgctcaacaaactccagcgaactaacgaaccaactaaccaagggcaggcatcctaccaggcccctggattctaactattttgttttcggtaaacaaggcaaaagaaagagattgtaataggaggtttgtttgcttttttttttttgtttctagtcgcatcgcggcggcgtcgtggcgaggctgtgggtgcgtgtcctccgctgcatattattatgccaccgcggacgcggataaatgatggatttgctttctttctttgttaaaagataaaaaaactgaagaaacacatctctctccaagagtctgctgattcaacctcgccctcgcgcgtataatggagatgatacactcgcatcgcatcgtatcgtatcgcatatataagttgtcatgtgagtgtgtgtgtgcgtgtgtttaatttaccttaataataataataataataataataataaaatgaataaaaaagaaataaaggagacgaagaaggcgtgtttgaagcagtgattcgattcgagtagaacatgagacgggtggcggattatgcatatgttgggagtaagtaattgatgatgtgtaaaatattaaagagagagatactaacagtgcgtagtgtagaaattacgcgtgacccacctggagtcggagtcggagtcttgttccctttttattgagaggatcccctccctcgtgtcgacacgatcgtccaaaatagggaagagggagggggttcttcttctcctcgatccggttgaggactttgaggtagagagaggcagaggcgacgaggaaggatctgatctatcgatggcgcgcgtttcgcattccagaaagcggactagggctccctccaactccaactccaagcccacttcacaaacccaaccgccgccgccggagctcaccgaccgccctgtccgcgtctacgccgacggcatcttcgatctcttccacttcggccatgcccgcgccctcgagcaggccaagttgctgtcagtttctctctcttctcttctttacattacattacatggatccccccgatcgatttctcttggatctgggcctctatgttagaatagatcgagagatctgttcaattccaattcctgattgctcatggcgatcgcaggttccccaacacgtacctgctagtgggctgctgcaacgacgagctcaccaaccgctacaagggcaagaccgtcatgacccaggatgagcgatacgagtcccttcgccactgcaagtccgtctccttccttccttcttcaccttaccacatacgtacatggattttcatcaactgctcttactggattctagtattacatatcaatatatatgcaacaactgcatttgcattggattggactagactccttaatcaacacgtagagaacagaatttggattaacaagcacacaaggaagccaccaacgtttctatttccctttcctagccacaatattatgctcgcggcttgagtctcccttctgttgtgctctttgcaaactacatttctggattaacttatttcaaggggcctcttaatctctaatttagtgctgtaaatttaggttccataattacttctcaccttgctcctctcagctactttcatagctccactgatcctggatatttttttacatcagtcaatttttttccttccctcttgtgttgtgctgatatcaagcttcattattgtctgccttcttagatgggttgatgaggtcattcctgatgctccatgggtcctcacgcaagagttcattgacaaacatcagattgactatgttgctcatgatgcactgccgtaagtttcagcagcacaccaactattatcgaattcccattttttgtccctttaatactgtgctctttcagcttaactgaccggagttccttttttttttgccacagttatgccgatactagtggagctgctaatgatgtctatgaatttgtaagtcagagtagctatatttgctactagtaactacagatatttctcttgcattgctccttactgatggctgtcttcatgtacttaggttaaaaagattggcaaattcaaggaaacgaaacggacagacggtgtatccacatcagacctcataatgaggatattgaaggactacaatcagtatgtcatgaggaatttagcacgtggatacacaaggaagatttaggcgtaagctatgttaaggttagtctcatctctgtgttggtttaccttcatcttcttgcagacaaattcagatgcat

SEQ ID NO: 65136 - DNA, 4317 bp, Oryza sativa
ccttgtatacaaatgtctatagcagaggcgtttggtgcataatccagagtgtgtagtaggtgttggacagatgaagttgagtggtactgtagtgttgttgttctcttcccttgggttttgtctgtaacgtcgagagggagagatgttgacgctggctgaaagcacaacacaagcagagtgatattatactactactagtaatttacttattagtacctgtgtagtattatctatccattgttggtgtgtgtttatctgtcctcccaagttgtggccagcaatcccaatcccagaaattgaatgaatagtcttctagtggccggcgagggaagggagtttactccagatagcgagagaggctagtgtttgagggaggggaaggggatgagaggaggaaaacgaagcaaatcgtacgtatggaacagtgacggcagttgggcctggcaggaagaggccgtcccccgtgcagtgcagtgcattattgaatgatgatttgcgccttctccttgcccccgtcgctgccgacctccaccggtcgccgcccgcacgcatcgatattggaattggagtagtatatatgatcgagctaggccttcctcccggctagttgtcattaaactctacaacgtacgtatctctcctctcctcctgctcccgagcattccgtccccatggctgttgacgatctaaaccaccacctcatcgccgtcggagtcggagaagaagccgccaccgcccattgtgggctgcgcaccgtgagcaatttcttctttaattaactcactctgtgatcgatcagatcacctgcattaattcgttcatctatctatctatctatcacatacgcgtagtaagtaagaagtatgatttgaaataatagatggcgcatgcagcttgtgcggaatatggcgcagctggtggtgtcgctgggcatattggtcgccgccgacaagttggtggagcaggccttcgcagccgcctccatcaagttccccagcgccctcttcgccatgttctgcgtcttcgccctcctcctcttcctacctccttcgctcgccaacggattcatggctttcttcgaccccgccaccgtcttcatccacaggtggctgcccctcttcttcgtcccctccctcgtcgtcctgccgcttgccgtcagggacgtctcgcctgcttctgccctcaagatcctcttcatcacatgtaataattaactactgtaactaacactactcttcttaatttataattcgttccacgtacgtacagatgatcgacatgactctgctctgctcatgaattttcttcttttaatattaataatttactagttggtggctggtttgcttcactggtggtggctggttacacggcgctgagtgtgagaaggatagtgaagacacagcttataccagctgagcccatgaagagaccgtctcctttcgggccgcttgaattctgggcctgggctgctgtctttgttgcttcctttgctgttgcgtatgtttcccccactgcgcttggtaccaccgcaacaacatgccttcctttcttgcttgcttccactgttttcggttacatccttggttcccggtactactccattttatatttactctctctttattcttgactttaaacataaccttttgttcattaacctcatctcaaaatttagtgcaaatatatgagtcatacataaagtacctataataattaataaaacattgcaccgtgtttctaaattaaaaataaaaaaaaacttctatatctatcttgatagcgattaaaatcccgcactattgaaaaagaaaactactactacctactactacttgagaaaacttcaacatcaactctaagatcaaaattttaaaattcaaattttagcgtgcaacctagtttactccattatattaatttctctaacgttcaatataattctcacaggttaccatctggtgtcaagaaagtgctacacccaatcatctgttgtgcactttctgcagatttggcggcagtagcatatgggtatctctcccggtctggagtggatgcagtgctaggttctaggcttaacccccaaccctgatcgatactcctataatcaaattgcatcaatcgcaaagtcgtgctccctgatcagttttatcctatatatataatgctctcaaatatatatgtatgtatggttgtccaggtgattacctcacagagtctccgtcaaatccaggagctggtgacatcctcatgggatttcttgggtctgtcatcatatcgtttgcattttcaatgttcaatcagagaaaggtaggtacccttctctcagttagtagtattactagtagttagcatatggttatatatgttgtgacatgatcatattcgaagctctctgtttaatttgttgcgagacgagtgtgcctagctgttggctagctaattaaccatgcatccaaccaaggagtaattaattaatgtttttgtgttggataatataatatttcagcttgtaaggaggcatgcagcggaaattttcacatcaatcgctgtggcatcaacattctcgttatattcaactgccatcctaggacgagtggtagagctagagccaatattgaccatatcaatattgcccaggtgtataaccgtggcattagctttgagggtagtttctctctttgaaggtttgtccctcctcgatctgtattagctcctccgtccttgcttcttttgtcactatgaaatgaaatcatcgatatttcaaccattattaacttttagacgatttatctatgattaatgaaaactatatagttgtatttatatcgtaacatgcattactaatatggtgtctgtactttaagtatgtatatatatgtgtgtatttttttttaaaaaaaagacatattatcaaagttaaaaagtgaatagctagtatccaacgacagattaataatgaaatgcatatagattaatattcatctataataatggtgtgttgggtgggcaggtgtaaatacttcagtaaccgcagcggtggttgtcctcacggggctgatcggcgcaaattttgcgcaagcagtgatggacaagcttcgcctcaaagaccccatcgcacgaggaatagggacagcttccaggtaggatcacaatataagagcaacggtaataatacagccgatttattggctataagctcagcgtacccatataatagttagctctttacaattaatatatggctcacttatctttctcatagaattttttggttcttatgttcgaaccggctgtaagtttatagcccgtttctcctctcttctctcctccacctcagcatttagccagcttatagcttactattatacttgctctaaatgtgggttttcacgtccaacatttgacgtgcctcaaagtagtatggagtggattacatggctactacgaccaaatatacgaagatctggtaaaaggagaaattgctaggcgtgtgtttgctttgtgtgacgatggatgtttattgtttaattgcataatacctctctgtttcaggctataagacgttttgattttgatcaaagttaaactgttttaaatttaactaagtttatagacaaatatagtaatatttataacactaaattagttttatcaaattaataattgaatatatttttataataaaattgtcttgggttaaaaatgttgttactttttttttataaacttggtcaaatttaaataagtttgactttaaccaaatttaaaatgtcttgtaacatgaaacagagggaaacggagggagcagtaattgataaataagagggtgatgttaggcgtgcaatctgatccatacatacatgcagtgcccatggactgggaacggcagcggtgtcagccaaggagcctgaagcgttgcccttctgcgccatcgcctacgccctaacgggggtcgtcgcctcgttattttgctctcttccggcgatcaggcacagcttagtcttcatagctggcgatgcctctgcctcacaaacacaacacttttcttactagtattatttggatatatatttgtttgtctgtcactattcatgaaaaacagacccagtacagattgatattgtgattaataatcctacgaccgaataaatactgtatatacagagacacgtatatatggtaggagtaacatggaagggagaactatttgtatatgtaattaatttttgtaagggaggacctggacttggtggaatgaagcagctgattgcagttaaagcgaatgcagcatcatcaaaatcagggctgcaggaa

SEQ ID NO: 65137 - DNA, 4498 bp, Oryza sativa
aaagcgaatgcagcatcatcaaaatcaaattaagcagacaagagtcaacacaagtcaaagtgattttattattattagcagagcagagcagatcaagaaagcagagagaggtgccacactcttgtattcaccgacaactcactctgggcatgggcatggcggattcacatctggatggggtgccggcgatgaggaagacgacggtctccagctccagcagcctcaacatcgccttcctactctccatggttgccaccaacctgctgtccctctaccacctctccacccgcgcatccaccgcaccgccgctcctcttgccggcggcgcaccaggcccaggcccaggacgagcagctcctccgccagctgaccgccatccgcgccaccgtctcccaactcaaccacctccgctcctccacgcccccgcctccgccgccgccaccggagctcctcctctactcccgcctggcgcccctcgcctccgcctgctcagcccacccggacctcctccaccgattcatgtcctacacgcccttctccccctgccccgacgacgccctctccctcgccgagcccctcctcctccgcggctgccacccgctgcccaggcgaaggtgcttctcatcatcttcgatctcgtcttctcacaacctgaataatctgcccaccgatcccttctccccgctcccggactccgccgtccgctggcctccgggggccaaatgcacctccttctcctgcctcccgccctcgctcggcttcgacctcgcgcgcacggaggccgcgcgcttcctgcgggcggaggggcccctcgacctcacggtgccgcagctgctgcgcctggcatcgctcagccgcgcggggcccatccggctggggctggacgtgggcggcgggacggggacgctggcggcgcgcctcaagcgggcggccaacgccaccgtgctcaccaccactatgaacctcggggcgccctactcggaggcggcggcggcgcgcggggtggtgccgctgcacgcgccgctgcagcagcgcttcccggtgggggacgccaccatggacctggtgcgggcggggcacgccgtgaaccgctggatcccggaggcggcgctggagttcctgtggtacgacgcggacagggtgctgcgcccccgcggcctgctctgggtcgaccacttctggtgccgccgccctgacctcgccgccgtctaccaacccatgctgcgccgcctcggctacaagaccctcaagtgggccgtcgccgacaagaccacacccacgcccacggcgccacccggagccaagcatgaccacgtctacctcaccgccctgctgcagaagccctgatcgattcattgccattgccattgtaggtgggatcctggaacaaggctgtcactgaggtgatcaatttaattgtgcaataagctcaaagaggaatgccaatgccaaggctcaacaatgaggatgatgcactgatttgatttgggggtcttttttttaccaaggactgtacgtaacttctctgtggaatcatcattttataaggaaagcctcgcatctgcaaaagaatgcaaatccccttctcactcaaatttgctttgaaagttgacatcttcctgtggcttatgcttcggaataacatcttgatgaaggacaacttcatcaggagagggtggaaagaaaaattagagaggtcaactctacaccgcagatgagatagtgccgcatttttgtttacaaaatgcacactgcctcgatttgtttcgagtgtagcaccttcaattttaggagtgagctcataatattcctcacttgtttgggaaaggaggatatgaggaatttgattgctctaggagtaactgatgtggtgtggtcgattttgataggaaattgctatgcatacagctcaattgtccgactcatgtacgactaaatttgatcaacggttgtaaatggctgcaggcgcatatgaacatactttcatttgattgatctgtggttgtatatctctagttgtacatgagttgtataactaggttctacttatagcagtactcatttggagaacttggaatgaagcttcgttgctggattccctcgcactctcagagatcatcaatggaaagctgcatgtttatatgttaggttctgctacagtaaggaaccagcgagtcttccatcacaacaaaattcccaacgacaacttgggcgcgggcggaagtgaaaagactcgtgaaaatgttaacctagttcctgtgaaactccttttctttttcttctcacactccttgtaaatacttttagtgccactataaacagtgaaattgacattgtcttgtgctggttcgtttagggaaaaaaaattccccttgttcaagacatggaagcacgaaaatcttgctgactttcgttgtgtcgaaagattcagagtctattttaactcgaagagctgatttcaagtctatttgtcaggagttaaaacttccaaatttaactcgaagagctaagttcggaatagagttgtagactagtttaaaccggcttcactactctagttcattttataagagcagtttaacctactccgctatctttttaggttgagttaaaaccgtttggctctgctacagttttgaaatggttggcgcttatgttggcgtgatcctgatgatttgcacacggcaggtattaaattgcgataatgattatcgccgggcgacgggtggagggggtgtgtgtgtgcagaaatcgggcgctccccccacccccgcgcacgcgcgcatgctaggggcgcgtgcgcgtgcactccccttggcccaccatgtgtccacaaataaactctattgcaacaaatcacccacatattttggaaaccctctattaagggaattcgtttcattttttgtttcacaacaaatgtttcacctagtgtactcacaatgtttcactatatatagatctaatgttgcagtgaacgaaacattcttttgcaacaaatcgcccacatattttggaaaccctctattaaagaaattcgttttattttttgttccaccaaaaatgttttacctagtgtattcacaatgtttcactatgaatagatctaatgttgtagtgaactgaaacattcttttgctatctgctgaaacattgtttttatataaggtaaaacaacactcaatttaaacgattgaaacatttccgatatacttagcgaaacaattccgatatacttggtgaaacatcgtgcaacatttaaaaaaaatcaataataagctaatttttttcctcggaatatatctatgtgtggtcttgttttgaagatttaattgcaacaaattaaatggtgtaatcggatcatgatttggataaataatttaagagaaaaattagtttaaatttgttttacacgtatgcgtggcgctgacgtcatcgtccgatttttgccaatccgggcgcccgaccggaaatcgcgtccattgaattgggctgggttatgctgggctggacaaacagtacagtagcgctctgagtggtgggccgtgtggcgtggtctttctatgttggtttgctgggctgtgacgagacgtggcccgtggctaggctagtcgtccgacgccggcgtttgagcgagccttcgctgccgccgccgccgccgacgacgacgacttgcctgcaccaacaataccacgctcttgctttgcaatgcgatccccttgtaatctccccctcgctgcctcctgcttctatgctccacgccacgcgcacgcggacgccgcgcctctctgctgccgccgccgccgccgccttcttcaccaccaggcccaggtcccacccaccgccgccgccgccgcgcctctctccaaggctcgtcgacgccaccgtctcccgatgtccctccgacgccctcgccatcaccttcttcctctggtgcgcccgctgccccgcctacttccaccctccctcctccttcgaccgcctcctccccgctgccgcccgcctcgcctcccgcctccgcaccgcccccgccatccttcaccagctccgcgccctcggctgccccatccgcccccacaccttcctcctcttgctcaggctctactggcgcgggggcatctacccgctcgtgctccagctgttcgaccaaatgcccctctggggcttccaccccaacgccttcgctcgcaacgtcgtccttgacgtcctcctcaggacgcgccaccaccactccgcgctctgcttcctacgggacaatccctcgcccaactaccttacctacgccatcctcctcacccacctttgcaggtccgggaactggccaggggtgcgggcctgcttcttagccatgctgcaccagggttttctccccagcgccgcctctctcaatgcggtttttgcctgctgcactaaacttgctgccacgtccgagctactgcagcttctgggcttcacacttgtatcgggatatcagctcacttcggccatgtggacatgtc

SEQ ID NO: 65138 - DNA, 3205 bp, Oryza sativa
tcagctgatatcccttatgatctcgtggcctgcaattctgtgctgaatgctctgcgcaaatctggatttccatctcaagccgtgcagttcttcatcaatatgattaagtgtgacatcaggcctgacagctacagttatgttggtcttttggacagtctgtgccagttgggaaggattgaccatgcaatcaatgtctaccacagtattgtttcaagtgatcctgattcaaacgcttatgttcatgctgcaatcctctgtggccttgttaaaaagggccacaaccgtatggcgctaatgattttgaatgaggctgtacgtcaaaattatgctctcgacgctgtgtgctacactgttgttctacatggccttctacaagctcatttgattgaagaggcttgcatgttgtttgacaaaatgaagcgttcaggaatggcttccaacacttgcacatacaacataatgcttcgtggactttgtagaaccagggatacacatgcactcaagtggtttttaagagaaatggaatgttctgatgtggagatggatagtatctcatacaatattctggttgtgttcttaatcaagttgcagcatattagttcagccactgctttggtaagagaaatggttaatctaggcatggaacttagtgccaaaacttcctcattgatttctcagtccatgggccatgagtatgttctggaggatgctaacattgctgaaaatgatcattccgactcaactaatgatctgcttgcatgctcagcttcatagtcaattttcaactaaacagccatgctgcttctgtacatcttcagtttggtggtgcataattaaatacagatacacactattaaaggttggtgaaatcttcaatgatttatctccctccattgcctatctaacaaatacctaccatggccactgaaaggctgctcaattacatgccccccgccattatgttggtatatactttctctttccctgtgatatcaccacttagtacattcttatttaaaaagaaggatttgattgcaagaaagaaacaagatccctcctattgcattcatcttatctttgctatagaacattggtcacaattctcactcagtgctgagacacacagaaatgcaaaaaaaatctgcaagtaataaattaaaaagaaagacttacctgctttttgtgtcctgccacataggctcagctagggctgaactaatgggttattgtttttctccaaaatttacattgtgatttaagatgatttaaacattattatggaggcaagcttagggctcaagctctatctgctctaggcttgcctccgtccatggtttgacctgaacagcctgtaaactacatctttatgaatttatgttttgtaacttgaccattttttatcatttggcgggagttcaaagttttgttccacatgtcaaaaagaatgaacactagcaatcagctccaaggcttgacactgctatacgtgctgaatggttttctttcagtaaaaaacaatcttatttgtgttagagagaataaacagatgatttcaataacctttcaaataattcaggaaatcatctccgatatagaaggaaaatatacaaacttcagtactgaacctcgtatatgtatactgataacaaaagctcagatggaattcgtatttaacaaaccctttgattatctacattagggggttgtcaaatgattggagcagagtttgtgtggagatggtgtctgtaaggatgattatttatgtagatcaaacatttacatgtctaatattcaaacaaccaaaaattgcatatgggatttttttttattttgccttgtatgtttttttcatttgtccataccaactgttttagtcaatagagcttgtcagagtaagtatctgacttatggatttagtgtcaactcagtggagaactgaggatatatgatacttatggtaaattgattagtaaggaattttttccttattgttgaaattagttttgctgtaggaatattctaaatggcatacagtggaaccatagaggactcggtggcttaacttgatcttcctgcgattttgaagtagccatagagcttgcgatgaacatgcaaatacttaactggcatcactttaacgacgataagttcaagtaatatgaattgatgttcttggctttataatttgttgctgaccaactgtttctttgcattatcttttctctgaatatatttattctgtacttctataactgcttctgatattgtctgcagcaagctgaaattgctttatcagagttgatccaatcctctccggaggaggctctacatgactacatccttggagtaaatctctggtcaagatcactttacttgaccataagaaaagaatgtcaaacttttcgttccagcttgctttattgaagttatgcaggtccttgcacctgatccaccttttagtgatgaaatatttaaggtatctaacctgatccacctttgacacggatgattgggtattactgatttcttcgactgtttccattactgacatactgatacctgatgaccatttttgaacaggatttctgaaatattaataatgtttgaactttagcaattatatttagtggcagaaaatttgaacaaggaccacactctcattacactttttaactcctttttctcaggagagatgtttaggctctttatcagcacatttgcacaccttgctgaaacaaacagtccatatcttccaagaagatcttgctattggaaaatgtgctgcactcaggtattctgtaattacgtactctctgcttgcttagagtgaccagatatccggttggaggcagttcccctgatttgggggcttgtatctcatctttattttggtcaagaaaaccaactagttttaatggaattttttaagagattatctgacatatctgcagagtaagagtttttgcacgtgatgcagcaaaagcctgttacatggccgtgacatcaggaaatgaaaaaaaagatattcttagtaaggctgcttctttttatctgttcttttgttcagagttctatattggcatcttcatgctgaagttttgatttatttggcagcatcacttgaagagaggttattggattttgatgtcaaagttagaatgcaagctggttttgcatcctgcaatttagggccaaatcaaatcta

SEQ ID NO: 65139 - DNA, 990 bp, Oryza sativa
  unsure (1)..(990): unsure at all n locations
ggcgtcaccggagaaagggaaggggaggcggaggaagacggggaggagggacggggtgagcctttatatatgtttgtgatttttggggggcgtactacaaatattggacttatatatgaatagaaaatctgaggatttaaatggaaaatgtaatcgactgacaggtgctgaaatgcaaaaataagatagagctgtggcttatgtaacaagtgtgatttcatcccacttggcatctcctttttcatgagggtatagcttccatcggccatggtcttagtttactttgttcctcaacctttttgacaaaaatagaagaaatattgtcaaacgtgtggtttctttttacagacttaataggaacaggttccaagttccgagcttggatactctagtaacattatattgccgattctctagtaacaatgtattacacctgtgttgatgtcaagtgtcttttctttctcccttttctaggaatgccattcaaatgacaatgagctctaaacaattttagaaaaaaaaatcacaaacaagcaaaaatagtgatctcactcactgtgaagaagcagatctggactggggtgaagtgcagtttgctccatgaagcaaacagactgtgggtgatatgatcatgttccctaggctgcggtagctcgatcgaccagctagcatatgaatgaatcctaagcaagcagatagcagagagacaggtagtctggattgggtgtgtggaatgagaatatatgtatatcaggggaaagagaaggatcctcctagctgtgagttggcttgtgcagaaggaggcttgattgcaatccagagcaaggagatggtgatggcgacgaggccagaccagacgtagacgatggtgggtgtccttcccctcctgcccatgaggcccttggcgaaggggtagagatgcgcgaggacccagaagctgaagaagactccaccgagnnnnnnnnnnnnnnnnnnnnnnnnnnnnnnnnn

SEQ ID NO: 65140 - DNA, 1818 bp, Oryza sativa
tcatgagccctgtccctatacagataacacaacaaagaaatagggataggaacatttatattgtttctgacatgctaaatgacaaaggcaacaactctaaacctgtcaagttcttgcaaaagttccatttcccttgaactagtctcctccaagtatttttcacgagtatgtcggataagcagcttcttttgtctgcgtgctataatttcctccctgagtttggacctttccctattgaagaagaacacaaactataagtctataaataagactagcactaaatttgaaattcttctagaattcaaattggtgaaaaaaaggacatttcacaaagataataaagaattttacaaggaactagagctaaggcagtattatatagaagcttatcgagcaattccaaaaaaaaaaaattccagaaagcaaacatgtattagtagaactttagttcaccttagcagacaatccgtgcctcctggagaaaatcacaggtgttatttttttttagctttttagtggtctacaacatgtatagttttttttttaaaaaaaaatccaaatgaagtataatataggaaagtaatgtactttctattttcacaaaaatatactctatgggacaaattgagcctatttactcattagtaggctggtttcttctcttatcagcatttttagacgttgaacaattgaaccaatatccaaccacttgagactcatcatacccaaaaggaacgatcaaaagccaggcatgagcgcatgacatgctgactgggcaggaccatatattattgcccataggccataaacccctaaagggcttggcagggctggtctattaccatgacagaaaaatagttcagttgaaacaaatcaggagttcagggcttacaaggaccgtatatcttcctgaatttgctggagctgcttattaacctcattaccatccttatagtctggaaatagaataatatcataacacatcaaaagtatatcgttaatgaaaggatgccttaaaattcgttagtcttacatgatgacatgtccggaatcatggtgtcctggggatgtacaataaagctgtgaagtgctttctcatttttaacaatctccaattcgatctctgcttcttcaagttccttaatgttatgattaaccaagtgtcagtataaggtgttcaaaacaaaggcccaaaaggaaagcccttgttgcatttctaacctgatattcctgatcagatcttgttgagaagaactcaaagtatgattcaacagaactcaaagaggacagcacctataaaagagagaatcatgaatcgagatagaccagcactgacaagatcaggaaatataatttacagcatcttctggtatagagataataaccttttgaacaaagaaactataatacaagcacactgcagtggaccagttgtgcctattgattgcatgacgaataaaaaaatccacaacaataatagttgtcatcaagaattattcatttgggcaaagtaattgcactgatcctgtcattatcaaattctaaaaatagatgctcatttggctcaattaggagaactagttagctaatttgcaagtattgtcatttatgttgtacagtttaactgtgcaagcacagtcagcagtcagcactgacaacctagtttgagtttttgaactataagcagtgatgtttgaaggcagaggatcaagcaagaaagaagaaagatagccaacaatagagtgccctgaagaatatgacctgaagaatcgattcacggatgcccttaaaatcagtttcaactggtttcgcagtaga

SEQ ID NO: 65141 - DNA, 2019 bp, Oryza sativa
tgtgccccaataggtcatgggagaaggagaagaacatggaattataaagattgctgattttggactcgctaggatatatcaagctccattaaagccattaagtgataacggggttagtacatccatctggtgcccattagcatgtttgctgctgtcttgtgtttatttcaaggcatataagggcaaaaaatggtagttatttgtaaaactactgcttgtttcctcttttttgtgatgaaccttcatatgctcatctgttcctttccttttttgtggaagcatttaatgtgttatcaatacccacaagtatatggctaaccaataatttccaggttgttgttaccatctggtatcgggctccagagttgttacttggggcaaagcactacacaagtgctgttggtatccttgctggagattgaaatgatatctttcgaccatcttttttcgctttattcacttcagctatttccttaatcaactctagatatgtgggcagttggttgcatttttgctgaattgcttacactcaaaccactgttccaaggtgttgaagccaaagctactccaaacccgtttcaagtatgggcattcacactcaagtaattgctatcgttaccttgtattcagaatcaattactagatactagactaagactgcgacattttacgttttctatgtgatgcttaatttcaagtaaagatattatcactcttgcctggaaccttcctaaaagtaaataggcagttgataattgtatgttgttgcattttatatatcctgctgtattacattttgtagaatatccatgctatgtatgccattcatttgccatttatttttatctcacagttgatttgcccatgtcttgtagcttgatcaactagacaagatttttaaggtcttaggtatggatgactcatttctcattctgactatttgattgtgtactcttcctgagataatatatgctctaggataataatataattattctccaggtcatcctaccgttgagaaatggcctaccctcgctaatcttccatgctggcaaaacgatcaacaacacattcaagggcataagtagtatgtcatgcattgttaagctgcttttaaaaacctgtgaaaatagcatttatctttccttgaggaaatagtttctcccttgcagtgagaacacaggacttcataatattgttcacttgcctcagaagagtcctgcgtttgatcttctctcaaaaatgctcgagtatgtaactggccttttggcctgctataaatccaacataaccttggatgattatcatttcttacattcatcttttgtactactaaatgttgttttaataaccttatatattcctgtttcaggtatgatcctcgaaagcgtataacagctgcgcaagctttggaacatgagtaagtaactacatccctccatttattcattattccttttttgcctagttggatacttcttatgttctcagtgtacagcaagtgcgatctggagttctaattgcttccctgaatctagtttagcaaccatgcaagaaaaacagttatgctttatttgcacgaggttttgatacttggacgaggtcttgatggtcctcagttggagctgattttgtggggtgggctggagtggtggtggtagtggtgtggcttaaagggtgtaaaattgccaagaccatctgtttagagtggctaacggtcaatttttccttgtaaatatttgtgcatcctaaaccttatatattttactttaaaaatataaatatatgcaatccttagtttgattcgctatacttctaaatgttttcatctctagtggcttggatgaaggtttaatgctgaaaactcgaggaaatactactttcgttgtggtgctattgtttattactccctctgtttctttttgtaaggctataggccctctgtttctttttgtaaggctatagtcttccctcttcctctgtttctttttgaaaggcctagagttttttcaatcattt

SEQ ID NO: 65142 - DNA, 13500 bp, Oryza sativa
ccgcaaggaggcatagctgggatgaatcctggtaatattccaatgcagaggggcgctggagcccaatctcatccgcatcaggtaaaaactgctgccttggaagtaaatgttgcttggaaaaaggcctgtgacaaatgcaacatttgattggcttttgatatgtgcaacagttgagaaggaaagctgatcaagggatggggatgcagaaccccggttatcctactcaacagaagaggcggttctgaccgactgaatttgtaattgtatatctatttggtgtgttacttgtgagcacgcttagcttttgcggtggttgctcctagtcgtacagtgagaattgtatctgttctgttgtaattgaacgccatcacaaccaacacctctactagttagttactagagtgactacgcagacagggccaggttgccgatgatgccatcaccaatggagacaggcatacccagccagagtttcgccaatactctgccccctgaacccaaccaatgaatgaattggcatcgtacgatctatttcacatccatgctctcataatgatacaaagccatttttcgtcagaagagaaatgcatcgagtgccctttcctactaaaggaaaaaaaatatacacacaactcttcgaatctgaaaattcacgaatacaactggttcaagagcaaccacaattatatcagtacagtagcagcttcatatatttacaaccactcccgcttccacgaaaagatgaactttcagtaagtaaaccaaccactcctcccaagtgcaagtgcatcactgtcacctgtctttcgtaacactacagttttgcctgaatcaaagctttactaaaaagcctcgcccagttcacgaccaatagctacaacaggagaggaggaaatcaaatggaaaagaaagcaagatgcaggcatcaagtcaatccacatagcgcaaggatcaactatcccttgttattcttcatgacgatgatgttgaagttatccgccctgaagctcgcatctcatccagagttgttgctaaccagtccaatccttcatagaggccatcgcctttgagagcacaggttccttggattgccatatacggttgttcaggtcatatagaccaaggccctcgcatacttccatcggagtcattgcgcccctctacactagcagatacattacatgggtgagcaacaattcagtggcaaataataaagccattaagttatctagtgcagagtcatactattccaatggtttcataagtgaatgcacaatgccaacaaaatttagcatcatcataccataagcatggaaacatgccaacaattaattcatcatctgcaaactcaacaaaagatagaagtgcatcaaccatgaatggcagcaatctcacatagtgacatgggcgatgggaaacacaagttacatggatgtgaacttcaataacaaatgatttttttcatgtactacccagatgatgaatttacatatacaggaaacaattatatattggaaaaaggtaatatagtcatctgaacaagctagatgatgttaaagtagctgccataagaaatacaggttctggaaaaagaaaaagagacaagttgagcataccatgtcttgcttgttagcaaacaccaatagaacactattaagcataaaagggtcattaataatggcctgaaagacagattaccacacagtaagttagagcaacaaggcaacaaatgtcagtgcagaagcaaacacttgctgcctcataataaattatttatacatatatgtaaacctgaaattcagctctggctctcccaatcctctctctatccagggaatcaactacgtagatctgcgagtttacaaaagaagagaggaatttacaacgcaagaaaagtgtttctgaaaccaaaatgtgcgtgctaattaaataaagcaacgtggatctgtaacataaaaggtccttgtaggcaatcttgagcaaaagattattaggagctgtaatgctatttggcatagcaattgttgctcttggtgggattgatgtggtttttgataagcaagagaaataaagtcacaaagtgaattgcttgttcaaaggaggtacgttatgtgtaagaaatgtttccctatgccgctggataaaagaagaggggaaaaaaagagtgaccagagcatcggtgttgttgaagtagtgcctccataagggcctcaatttttcctggccaccaacatcccacacagtgaacaccacattcttgtattgaactttctccacgttgaagcctgcatgatgatgatgatgatgatgttaggttgggtttggatttggctcaaaacaaaataaaagattcgatgaggcggagggagggagggatgagagtgaacctacctatagtggggacggtggagagaacttcgccgatgtgcagcttatagagtatggtggtcttccccgcggcatctagcccaagcatcaccacctgccagccaaaaccaccatcatccatgatccgtccaaaacccaatctgagacgagacagacaagagtggaaaagcttggggtacccgcatctccttgttgccgaagaaggcgtcgaagagcttgcggaaggcctgccccatcccttcttcgccgatcgtagcggccggatctagaagcttccagaagattccgcggcgagcgaggaggaggaggcgggtactcggctggagcctggagcggagccaaagccaagggagccaggggggagacacgagagaggagacgacctacctgccctgccctgcccgtcgtggattccagatgccgagccgaataatctgggccgtccgatctgtgcggggcccacctctagttgagtgcattacctttcccttttttattcatttcatatactttgaaatcaactttctagtaatattcatccattgggcctagaggtagcaagtggcaacggcttgcaatttgtagtgtgtaaagtagtaccgtaaagcgctttgttacgtgaattacttaaaaaggtttttaatattttttcaacaattaagctagaagcaaaagagcaaaatgaaattaaggaaatgtcacagttcattaatactaatcgtgaaaaagacaaatgatatccatgctttgatgcagaatatattgataaatatatattaagtattatagatatgatagatatatatgttaaaatattgtggcttgtggaaaagatgtgaaggatgatgattgaatatgtttgcatttcggtttgtagaattcaataaatcatagatgaggttgtatgcttgaatgaggtttgatgtgtaattattgctagtggataatgatatggtatggttacatattaagttttagacttagtgggttgtaattttatatatggtatacatattaagttttagacttagtgggttgtaattttatatatggtatagattatatgactaatgtactactgacatgttaagaacatcaaaaattgataatgtgtatagtactgctgcaaattagtacacaagttatatgtgcatagtagtactgacatgataagaggtgcatcgtaatacttaattagtgtgttcaataattatttgtcgattttcttaaataaccattatttgttgactaaatatgtctttcaccatctttgtgcctttggaggttcatggcttgcaccaatttgattgatatcatttttttatttatatgggctttaatcccgtgactatgtaaccctttttaattggtaaatagagaatcgatcattgtacaatgcttagcaagtgatcggttaccccgtagcaacgagcgagggtatgtgatgaggatgttactagctcgggtatggttataaccatacttatattacacatcaacaatctaaaagtgcatatattttatataaggtttacttattatatgtttgaacaaatgttactatatcatgagttttatatcttctcatatgcagtaggaattgaaccctgtatacgaaaatataatcaaatattatcaaggaaagttttctccatagacttaatgtgacacccaaaagtttccactataaaataatatggcattgcataaatatagagcaaataaggtaacaaatatttattaaaatatgaagaaatctaacctagcttctcaaatcaacgaaaagatatagctcaatatttttctaataaaacagtaaaattatatttctaattttttatcaattaataataatagaactaattatacactttacttttctggagacttacaataagcaaaactacattcatatataactataaccagtatggaatggctttaaaaagacaaaaaaaagtcattaggcaaaagaaaaacagttctagagcattgggctagaaaaaaaaaatcccattcaactgatcacctcaaatatataattatgtacatctagaatagataaggctaaagattttatcctatatatgataaatatatatattttttccaattcccataagaaaatccgagttcgtttcaggaatgcttctgtccgattcctatttcgacagacagtgatctaaccgtattcgtttccatttttgattcgaagaaaaaaaatgggaatatgtttgtttgaaaaaatttatgcccgacacttttcattttcaaaagcaggtgaaattttccaaacagttttcatcactacccctaaccctcaaaatcgtagtcttggtgccaccagcccaccacgcgacgcgatggccgttgtcttgacttgctcgcgctcgctctccggcctcgaccctcctggcctggcctcccctcgtcaaggtcacttgctcgtcgccagcaagaggtacaatgcaggaggtgggggcttcatgccgttggatggatcccgcgattggtgcggtgttttcgacggtactgtatgttaccaatcatatacggggtaaagaaaatactactttttacattgcgtggtccccgccttccaccttcttttacagaaaatactgtactacttttgtggctggtgtgttccaggacatgccgtccctggtgttccccctttctcccccgcgcccctccgcccccaccccccgcttagcctcgccgacacggcggcgatggcgtccacgccgcagactaaccggaagctggctgttctacaccatgccatcggcgatggatgcacagcggcagatgaggttggtgtgtcgagcaacaagcccgctcaagaagagcttgcgagctcaatgtcctatacatatctcatcctgagttgcggctcgtcgtccggatctcccatggtcggattcgcgtaagcgtcctctgccccgtgctctttggatgattgcccttatcagctagctgtgtctcttttttttttctttgtccagtcttggtggtgagccgataggcgatagccctgttttttctttgttcagtggagattgcccgtatagctacttgatggagattgtggaacagcaagcagcgaatgtggggggcgtcgtgcagagtgatcttactggcgtgtgcgaacaacaaaaacatacctattctgaccaggagaattgctatgcagagaatgcgagtgagccgcctgagtccagcaatccttcgtggtgagtttgttgtttgtcatcattttgcgaaacagaaaatggtattgcgagttcgcgttctgcgtttcgtaaaactctttttttttttgccaaaacaaaatagtgatgcatattatgactatgttgtctcttcagattgggttgtttcttcggatcaggctgtagatgatgatatactgtcctttggatcaagctgacggaaggtttgtttttttgaatccgtctctgcattttgaagtttttttccggaacaccacttgtggaatggtaaaaaaaaaagagcatcttttttgcctgcagtgcttattggttgccaacattgaaagagagcactcctggcgccgcaatgctaattgatgagatggagctgaggcaagctgatgagcagcatccaggcgttcacgccccgcaaagtccagcagccgtgtccggtgtcacccgacgagctccggactgaccgcggcctgctcgagcgctgcgacaatctgctcggcagcatccttcccctgcccaaacactacgattttcattcgtactgtgagcggacgccggcgagccgagacgaaggaacaacacgagcttcttggaggtccttctccatccgttcattggcagacgctgagacgaggcaggagcacgcattcttcgtcgccgccacgcaagaactccagggcttttaaagtttcaattttttttagcaataatggtgaacgaatttgtccatggttgcttgtttttcccatacattttgttggacgaaagaaagaaacctacagcacatttgtttttgcacattctgattactgagatgttgtttaaaaattattgattataattaagaccaagcgagccaatttttgggatgaccaaaattgattcgaacttaaataaaatcttttttttatctgagcttatttgttattgggacatctaggagcacacctatatgtgtattgctctctgggcttggtacagtacctgcttcctctgctggcaaaggaagatagcaagatgaagttgagagagtgagacttcaaaccaaaagacctcgcttcttttttggatgtaacttcatttttaaattttatgatgtttttttttctctctcgaatacttttaaattgacgtgtgacgaaggtgttggtccaaggtaattaggtctccgtgcatttttttccatgtcttttttgctcctggttagccaagcgtggtgtcatgttagctgcaaattgtaaaaaatgtaaccgtcggagtaggagtcgagggagaccggactccgttgtgcttgttggaggggatgatggcgccattggaggggatgacaggtgtgtactgcgcgcgcatggccagcacacagcgcagtgagagcgccaactttatgctgaagagcataatgcctagaaactccaccttgaaccgtttcatcgagcagtttgcaaagctccagtttgatagagagagtgatgatgccaacgctgagaaggctaacaaacaggtattgtgtttaaatctaaaaaaaccttccttctcgattttgtaaaaattttgagcccacaatagttaacctgacaaaagaaatattgcatcgtgttgcagaagaggttgtggttgaagccaacgttccctgtagacggagaactaggggaatccacccagtacgttgtcaccggtcatgtggatggagttggtgctttgagggtaaggccgtgtttagttcacccctaactaccccaaacttctaaatttttatcacactatatcacatcacacataaacttccaacttttttttccaaatctttcaatttttcctaaactttcaactttttttttaggatctaaacacactaaggtacttcgatgcagcccgcaggaagtcatggtgcagagttgaatttgaggtacatgttgatatgtggagcagaagttttttttttttattttcaaccaatgtaatttatgaataaaaatgaaccacacaaatctataaggcatgtggcgcccattttcttccaatgctgatgtacattgcgtacaaacccagctgataccgtagacgggtgtctccccatgcttcggccgccccgcaagcgtgtcagcatccatcttagcttctggtcaaacattgctaattttggctcgacgttttgtggaatgctcagctccccctcgaacgcggcattgtccaggtaaaggatctaaagaaaaaaataaaacacggtggatgagtgatgaataacggtgcttgtttgtgttagcgattcatgacggcgccacgctgaacttacctgcaaaagcagtgagcatcccgccttgttcgccaccttatctttatgcttgatgtcgtgctgtgccttcggtgcaacgtcaataaggtggtcgatgacgtatttcgcccaattgtagttcttgatttcttccacattaaggagtgccccccagaagtcgttcgatccagatttgtgcgacatcttcggtgcaagaaacatgccgacaatccacacaacaaatgtggtcctaaaatggtcctgagcccaattgttcatggcgctgggaaatatcctcttaattacttcctcagcacccttcagtgcgttggactcgaagccaggagcactgatataatattgcacaaaagagtctttctccttttttgtgttgtgcggcattggacacacctccatgccctcaaatggaatgccaagcactctgttaacattcctaggactgattttcaactccaagtgtttcgatgaactcctgctggttgcccctcgagcttcccagccggctgtgttctgcaccggcaggtccgtgggtcccctgcgatggcaggatccccttacattgaatctgactcgagagcgtgtccagtgcctggagcccatgatacagttttagccctccgatccatcagtcatatgctgtggataggcaaaaagaaaaaaaatagtatgaattaaacacacagctacacaaatgcttatggattcacaggaaaaaaattgctaacgtgatggaaaaagaaacaaaaattaacaacaaagctacgcactgcttgtgcattttcacggaaaaaatacaaatgctaatgtgatgaaaaaagaaatgaacacatccatgcatgtgctggtactgtgcgtcgcggtatctgaatggactaatgtggcatcaggggatgggggtggaggggaaattcctgagtggtcttttacggtgcttggaaggtaccctaggtacctctttaacgaactgttatccaccgttaatcttcaaagggtaatttaggaacaaaaatttttattaacaagggtagcttagtaattacttaattctcaccccgtcgagtgcctaaccaatcggccatccacgatgtcatgcaggtggcgagcggctcacctcaatcgatcttcagaatatgtacgtagtgatcaaatagccaaattaggcgcagaaactagcaggggattggatgcgcagcgcagggcattgttgatttgtttttgctggcaaaatcgatcctcagaacctggaatacaactactggatgcatgaaggcctgacgacaaagaacgagcaaggaactagcagagcagacagcagcccggggattcgtgcggcggtggtgatggcgacctgctgctgcgtacctcagctgcgaccggcgggcgctacgggcgcgtgtgacggcggcggtgacggtatccggctgctgctttcgtacgctaggaccggagggcgtgtacagcggcggcgagcggcaggcttttacggcagcgacgacgaccaacaggtagttcatgtaggttcctctcgcacgcgttcttattcttcctctcttttttttcttcctcctgctgaaatgtttgtagcttctctcgcttttgcccttcaccgaaaaataatttaatgaaaatcaattaccattttaccctttcaccttacatacctagcccatacttttaaaacctttctccaggtactttctctctctatccgttagatcattgctgatcaagggtcctaattaattctaagcattgaagaagatcttacctgatggactcccttggacattcgtcggccggatactcgacgagaccggacggtgcgccgattccgccgacggaagatgcaatggagatgcggggcggcagccactacagcttccaggaggatgcgagtagtgcgtggggccggtggggcgggggacggcgccggtgggcggctggcgaccggcggcggtgggtgtgggttcggtcatggtggctctcagacgatggagagagatgaaaactggaaagggatagaatgtatcgaacggatatgtggcggaggatacatggggtcgtactccgtacacacgagctggtcccgcgtactacccttccacagggagtctgggaatcttacggtgggtcaggctgtatttgagcgagcaataaaaaaaaacaaataccatgctagcccatacatatactatctgatactgtaaaagtgtgcacgaatcttcaagccatcgtgtggttgtcagcctaggtgccgcagcacctaggtgctaaaaggactttccggtacaatgcaatgctgccctggtcgtatatctattgggcttgggcttctctgtttctgcccttttttttgacaaattgaccctattggaaaacttatttcgaaactaacccctgccaaaaacttcaaccaaaaataggccgtcgcctcagcgccaaacacattggcgctgagattggcagtgtcagcgccaacgggactggcgctgacattgtgccactgtggcggccgggccgatcccccagctgacgtggcagctacttcagcgccaacctgcctgacgctgaggtgggacttggccacaacgaccaaggtccagaccagcaagccttctggatggcttgcgggctgggacctcagcgccagccataatggcgctgaccgtgggaagctcagtgccaaccggcctggcgctgaggtgggacttggccgtttcggccatggcccagcccagcaagccttctggatggctgggctgggaactcagagccaggtgcactggcgctgaggttggacatgtcagcgccatttatcctggcattgaggtcccagccttgctaaactttagcaaaactttgcacacaacacaggcaaacatcaaatcacataaattcacaggcagtaatatatccagagaaccatacagaacatacatccatccatcaatcccaacatcattccatacatccatagaaccatgcatcaagtccatccatctatcgaaccatgcatcaagtccatccatctatccatccaaccatccatctatccatccatccattgaaccatgcactcacctcctcctacctctagtgcgaggacgaggcacgtcgggggtgtacctccagtcctgcgaaggagcccaccggcgtcgtggttgagacgggccgggctgcgagagatccggctgtgacgactctggtgcgtcctctagctgcgagggaccgagctcatccgcctcctcttcttcgtccccctcctcttcttcctcctcatccccttcttcctcctgatctccttcctccgcctctttgtcttgctcgccctcctcgtcacccacctccccttcttcatccccctcttggtgggcatgagcatgttcaaccacatcagtcgacctgcagccgagccttgctgccaacttccgacatcgctgccgtagtctctgcataaaaaataatccatgttaagttatcgcttttggaagaaaacaccgtaatttcatctctttccaacgattacctgtagggcgttgcggagggtgccgccctctccttcggagccaggagccgtgcctagcgccactcccgcatcgttgacggtccgcaagagctctcgagcctgtaggattgaaatgaagtaagtcacaacatatatggcattgaaatgaaataatatacaatattaatgctagaaactaaccactctgtcgcgaacaggtcccgtctcgaccgtggtacctagacgggtacgagtatcgtactcgttctgctcctcaacatcctcggggtcatccgctatgtcggctagtgtccaggccggacgtaggacaagacggtagggcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtcaaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgctgcatcacgcggtggcacatctggaactccactgcatagaagcagatcagtgggcaccgtagggtcttcaacgcatcctctatatggcacatgggattcagttctagctcgagcgcttcctgtgcctgatatggcatccacaccacctgcagcaacaaaaataaaacccattgaagcacatttagtactatatagtaagaaaccatcttcatgtgtgatagaaccccgaatagcttacatgttctggctgtaggtagtccatctcttttgtgtagtggtagtacgccaaattcctgcggcctactactggagatgggaccgattcccacaggtgagctacagagggacgtcggtctgcatcctggtgcggccaagcctgatgggtcctccacatgggccgaccaactggaagcctcatccacatccaaacctgcgtcacatacgttagcttccaacatgttagcaagaaattgaaatgttacgaaacataacatgcgtgaacttacctgtagcaaccaaacacagcatgctaggttcacgtccccgccttgccttcggcaagcatcacagagttgccgttacaaccaggctagggcagccgacccccagctgaaggtacccgcctcgtcccagtccgcgagcaacggcagccacatccaagaagccatgtctccaccagagtcagggaacagaatactgccgaagatgtatagcacatacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtgaccggaaattaaatggaatcattagtaattgcaaaaaaattaacaaatgaataggaagactcattagtaattccccgatgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgtgccatggtcacgaacgccaagagcttcgcccgctgtaggtacgggacgtaccagtcgtcgaatagtatgtgcgccgtgtgacctcttactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgttctgctttgaggctcttgaat

SEQ ID NO: 65143 - DNA, 716 bp, Oryza sativa
caaatgaaaatggaatcattagtaattgaaaaaatattaaatggaaaaatcacaatgagaacggaaaggaggacaacagaaagtaaacattgaagcaacaatatgaacttaacaaatgaatgacatccaatcccacctgtgtgctaccctcaccacctccccccgtcctacggcgctttttcggtcgatccttagacatgtctcgcttcgggcacctagttttcttatggcctagttcgtggcatagcgagtatctattttgcatgaccggctctgaatttgtattgttcggcttttgtgaccgtcggttggctgagcctttgtatgctttgtccatgtcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggggcatggcaagtgatggagctgagggaactgacaactacatgtgttatctcgagcaaccacgacgtagtgacgtccaccccattgaaccccagccgccgtgactccgccttgctcgctgacctcatacttcatcgaagggaaagggctgcag

SEQ ID NO: 65144 - DNA, 1828 bp, Oryza sativa
tggcacatacccaacctttattcaaatctcgatctagaacaatatttttcagagtagtgaagactgaagagttaaactatcaaccttaatcaagaagtcaataattaaaaattttgcatacatgctatgttttaaaattttaagtaaaaccatactcaacattcatagggctggggttttgtgaaactttataaccataatacctgaggtttatttgccaccaatcaaaaattagggttttatgcaacttacccataaatcatgtggttttgtgaaatttacttcaaaaaataatgttcaaggatgagtgaatacactatcatctctgtgtaatcagttaatcacttgatgcctattcaaataaatgcaatgcagtgtacaacaaaattgtaaagacagaaataaacaaggtacccctgagacttgcagctgtttctcccttgacatcttccatgcctccttgttgatcttctctaccatctaattaaagagtgagaattcaatcagtaagataaaaaaatattttcatatgttagtagtacacaacaacataaacaaactgctgaaaacatgattttggttgttttaatggggaaattcaggattactttttccaaccgggccatctttggaagcctgatggacgccactgttatgatatcccctttatcaattgcttttaagatggcctaaaaacataaatttaactgtgagataagaaactgtactgcaataatgagatcatcccacttgagaaaattatagcataaaattaccgcttcatcagtagtagagcagacaatgctaaaggttccaaagtttcttcttgcataaatgcagagagttcctcacagccaccaaggggcatcttgaagtcagtaacatgagaagttctgtatatgtcaagcagtttcattctactatatctaaatgctgtgcgatctcctgatgtaccaccaggcctgtcagaaagtaggccaagatggaatggacgtgatgatcctgaactggctgtgtttgtacttccagatgtaaattttccacgagaacctggaaaacttgcaatttcattgtctggcttccctctaccatatccatatgtgcagatgatttttgtgtattctgtgagggatgatgagatgaatctccccgtccacggcccacaggataactagatttccatgatctagaaatattatcatctctttcagcatccttctcatgactgttgccgtcttttccatgagctatgtagtgagagaaacctttttcacgggcagcatcaccatctttgcctgaatcaccccatctgtcacgccaattctcagactccttatcattagggcccctacgagcactccatttgttatcacggcgttgatcatagtttccctccttgttaccggagtcactccaacgttcctgtggaggacgacgaccatccacagagtacttggaggagtcatctgaccacctttccagtttgcgtgtatcaccatgttccttgtctgtctccctccagcgattccaccgaggggctgaatttggttctctttcatcatcacgccagcgttcacgacacccagtttcaccatcaagcacagaggccctgaaaacatcctttcttttcacactgaagcttgtgtcctcatcatttcctggtatctttgaaccatctgaacgaacacccagtaaactgggttcctgcacaagcaatcaacgatcttcagtatagacaagcaaaaaataactaataagagaggttattatacacttaaaaggtatcctactgttacaaccatcatgtatagtattagcatgaccagtt

SEQ ID NO: 65145 - DNA, 23025 bp, Oryza sativa
tgcctcaccaccaagtccaagtgaggggaggggggggggggacaaccaccatttcccaaccgcccaaaaaccccaaaactccgggaacggcggggcggatcgaacgaccgaactggaaccaaatcggaccggcccgagcaaccacggaacagctagggttccggcccgggggaacggatcgagagggaggggaggggagacggcggggggctgagttggggagggacctttggcgatctgcggcggtggtggaggggcgtcgacggcgaggcggcggcggaggtcggcattggcgcggtccggagtggcggccatggcggcggcggcggcggcggggaaaaccctagttgggaggtttgtgagcgagaggaaggaaagaggaggcgagcgagcgaaggggaagagtctgttgcctcaagcccggataaaaaagccagccgcacgcacagcgtgccgcgtttcctcgaggaggggctctttttcgcctaagccccttacttttgtagaattatcctttacaaatgttcaagatgggagatgaattcctaactcctctgtgtaactttttatatcggtccatctcccatatcgatatattttcacggatacgttgggttgtttgtaacatttatttgtagctttaatgatgtctatctttgagatatgtatcgtgtgtagatttatatgtatgttaggatgactcattaatgcgtagatttagatatggataaagagtagcgccaaacacattagacggtccaaccgctttaagcggccgcgtgtgaatgtatagttggcccatgagaaacccctagctactttagcatgttttaggggttggcaattcatccgcttaggcccaggcccagatccaatccaactatggcatctcgcctaatatgtgttagtttaaaatctcatgatgtgttggcccactgagttcgatttttcaaacctctcacgatgtgttggcccactaagttcgatttttcaaaccatgttaatgcttgatatatgcacatgtgaatgaaaaacctaatccattgcgatagattaaagctagcaagcaacaagtgaactaggaagtactaactgactgtaggcgaccaacatttgaaatatttttttatggcgcaccgtcgttgacagtttagattttttcaaggatgtccttgcatgatcagatagtatcattacaagctaataatcgcaaatgtgcaacccattaacctacttccctagacaatatatagacatacaatattatgagactcgatgctttcaaattccatatgtgatcatgtaatgaactctcgagctttcatgctttccattatcatccattttgtttcaggacacatgatttttggaatgctaactcaagaggactcaaagagatcgtgggtgaaagcataatttattaccttttcagtttcagcagctgcacataacagatttaaagaaatagagagggcgtaaaccatacttgcctgcatacacaagaaacttacgaaagggcatgtagcctagtggttacagtgacctgagtagtacaccaaggttctgagttcaaatctcctatggagcgaattttagattgagttgtttgcggggctaagttccctatttcaatggccgtatatatccggttgtatgtagaggccgggtaaaaaatacccttctctaaaaaaaacacaagaaacttaaaaaaaaatctctaggtaatatctctacttctctaaaaaaaacacaagaaacttaaaaaaaaatctctaggtaatatctatacaaatcaaagggccttccagtaaaatggcctgcgtaatgacctgaggagtagtagcacggccggtcagaaaactgacgctaggtgtccccgtatcacgcacacagaagtgtaaccgccctttaattctcctcctcctccacgtcagctttttgacatgcaaactgccgctcgctgcaggcaacttccaaaccgaacagattgcagtacagatcgtgcaagaatagcaagcgcgccaaaatggcacatctcgcgccatggcctttcgcctcaggtacattacattgggggtaattaactaactgctcgatctttgattaattaattacccccctcttgatcaaatttgttcaattaattagttgcgcgtttgggtcgatcgatccagtgcgtcctctcctagatgttgttgccaaaattttgcatgtaggttacagttcgcattaatttcgcaattaattttgctcgatcgttcttgcatcggacatgcatgaaaatgtgcttcctctttggtttttcagatcgattgattcgtgttgaagtttggaattggaatcaaacaaaattgggtcaacaatcttcaaaaaaaaatttgtgatgttctatcgtgaatcctctggccgcgcgtccaattcatgatcatgtcttccgatccctcgccgtcgtcgccgaggggcaccgattcgccgtcgacgtcgatggcggatttctactcgccgtcgcacgcctcgagacggctgtcgacgtcgatcacatttgccggcgggctcgacgtgacgtcggagctcgtcatcgccgccgtcgcggcggcgctgctcctcgtcctcctgttcgccgcctgcgcctgctgctcctggtgctgcaggaggaggtcggcgacgcagcggtggcagaatcaccacgccgccgccttcgggtaccaaggtgaggcacacgtcgcgcacgccattgctgtgacttgccattgctcgtcgtgttcctgaccatggcgacgtcgacggcgcgacgacgacgcaggcaacaccacggcgtactactaccaccacaccggcggcgcgaggccgcagtgggcggcgaccaagaccggcgccccgtcgacgccgccgaacatgatgatgcacccgacgaacatgaccggcccgcacgtcgtcgtgcggccgccgctcgtgccgcccccgccgccgcctgttccggcgggcctggacgagaacgcgttcgggtacgacgagctggcggcggcgacgggcgggttctcggaggggaacatgctggggcagggcgggttcgggtacgtgtaccgcggcgtgctcggcgacgggaaggaggtggcggtgaagcagctcagcgccgggggcgggcagggggagcgggagttccaggcggaggtggacatgatcagccgcgtgcaccaccgccacctcgtccccctcgtcggctactgcatcgctggcgcgcaacgcctcctcgtctacgacttcgtccccaaccgcactctcgaacaccacctccatggtaaatagttaacatgataaaagacgggtaattcacttatacttcaataccgtacatggttacttacttcatcgtgaacatgataaaagatggacaattcacttataccttaacattataacacggtacatagttacttactccactatgaacatgataaaagacggacaattcatttatacttcaacgtgtacagaaaaggggttaccggtgatgaagtggacgacgaggttgcgcatcgcggtcggatcagcaaaggggctcgcctacctgcacgaggaatgtaagttgaactccgaattttgatcagttcatcgatcaatggtggctttggttcagtctgtgataatctcctttttttttttctgttgaaggtaatcctcggatcattcaccgtgacatcaagtcggcaaacattctcctggacaacaacttcgagccactggtaaatcaaatcatcgatcaatcaatcgatcatatgctgtgttctgcaacattgtctcgatggatcgctgactctgagaccaatttggatcatcgtgtttaggttgcggattttgggatggcgaagctgacgagcgagaacgtgacgcacgtgtcgacgagggtgatggggacgttcgggtacctggcgccggagtacgcgtcgagcgggaagctgacggacaagtccgacgtgttctcctacggcgtcatgctgctggagcttctcaccggccgccgccccgccgaccggagctcctacggcgccgactgcctcgtcgactgggcgcgccaggcgctgccccgcgcgatggccgccggcggcggcggcggctacgacgacatcgtcgacccgcggctgcgcggcgagtacgaccgggcggaggcggcgcgcgtcgccgcctgcgccgtcgcctgcgtccgccacgccggcaggaggcgccccaagatgagccaggtggtgaaggtgctcgagggggacgtgtcgccggaggagctcggcgacggcgcgcggcccgggcagagcgccatgtcgtccagcagcggcgactccagctcggggtcgggatcgtacacggcgcagatggagcgggtcaggcggacggcggcgtcgccggccagcccggagtactacagcagcgagtaccagggttacggatgcccgtcgccggccagcagcgccggcgacaacgcgtcttccggcgagcatgataaccagtggcgtaaagctcaccggtaattaactagagcgatgctccggtgttctttactgctagtatatatactataattctttatttgtgataagtatttcaatactatagaaacaaaggcagctaaaattctgtagttgtcattagttaccttgacagtgttatctgacatttcaattttgagctagatatatattgcgtgacttagtagtagcccaaacgaaaatatgcaaaaaatgattcagattttcaggctcatctgtctaatggggagactacgagaagtaaatagaaggtgtcaatcagatagcttttattgaaaaaagatttatataatggagggggtgttgattctgcatgaaacattaaacgcaatgtaccggaagaagcaatcttaaaaaattaatggagaatagctaatatggtccctaaagtttcgctcctggatcattttatttcttaatcttttatattattcaaataagtcctttaaatttgtcatgtaggctaacatagtccttggtctcaccaaaatcgccacatggacatgccatgtcaccttcctatgcaaaatctatatgatttgtccaatttacccttacgcataggaaaataaaaaacaaaaggaaaaatttaaaaaaatatatggtatatgtaagagcaaaaatatacctcaaaagggtgaaaaaaaagtatttttttcctatggttatgtctaattcaccattatatttatttttctatgatatatgtaagggtaaattggacagctcatcatagattttacatgaatgatgacatggcatattcatatgataattttggtggacccaaggactattctaggtcttatgacaaaggttaaggatttctttcgaccatttaaaagattagggactaaactgatcctatagacaaactttagggactaaagtagctattttcccaaaaattaactttgaaaaggcatataacaaaatgaccatgtgtttataatatgctgaaagcaaaagatttctctgatatcgagtgtgattggatcttaaaggtgataaaaggaggtagcagcaatgcaggaggtcgacagtggctgcagggcagaattgcgtcgtggtcttcagcggcgttgtcctgcggcggctacaccggctaacttctcgccgtatatatagcaaattcggtaatttaaatggaaaaaaaatcactgtatcagtgttgggccgatttcagcccattacttttcctcctgtatctccctccctccctaaagagatttgggggataatgaaatgggccaaaataagcccaagactagagatcagatgggtggactgttttcttccggaaaaagtacaccggaggtccctgaacttgtcaccgagatacgaaaacgtcctcaaaccgcaaaaccagatatatggggtcccttaactatataaaaccggtcacccgaggtcctttagtggttttgactccggttttggtctacgtggcggctgagtcagcgtgggacccatctatcagcatgccacgtcatcactcactctcctctctctctcttcacttttctccagcactgcgaagaacaccgccggcaccacaccaccgccgccgccgccggccgcggggcgcctcgtcgtccagtgccccagcgaccggcgtctctcaatcgagggtgggggtggcaaaggtgcaagcgagctcgagcgatggtcgaggcggcgaggtgccggcggcgggggaggaactgggcggcgtcggcggcgggggaggagctgggcagcggcagcacggaagaactgggtggcggtagaggagatgggagccggcgagtgtgcgggggaggagctgcgcgcgcgagctgccatcatcgtcgtccgccaccacctcgctccgcgccaccgccttgccggccttctccgcccgccgtcgccccactcctctcgccgccatgcttgagctcgtcctcttttatctcccccatgctcctgccgccaccttcctctccttctcccgtgccggagcacaagccgccgctcctcggcgtcgacggcttcctgatccagctttggccgcccgacgccgccgaggtgctcgcctcgcgcctcggcatccacccctccctccgtgccctcaacttcgcgatgcgctccgccctccgtgccgcgcaccttgacctcgtcttccgcctcttctcccccgacttcctaggcgacgccgccattgtagccttcctcgtgcgcgcctgctccgtcgaaggccgcctgctcgacggcctccgcctccggcgggtgaggagctgggcggcgttggggaggacgaaggagcagtcgagcgatgggagtgcgtcgatggcggcagcggcggcgcggatgagccactcgatggccttgcttggttggtcgacgccgaggcggtcctggatgtcgtagaacgcgatggctgtcggcaccgacagcctgacgcggcggtcggggagcccccgtgacgtcaccactttgctgtgcttgtccttctcgcccgccgctgcgcgcgccacccggctcgcccgccacgcgcgccgccgtggccgccgacgccaacgccgacgagcgcgcagcgcaggagcttgcgctccttgccgacgacgacctcctctatggccgacgcttgcgctagctcatgcgaaatccgcctcggcttcgtctgatcgattttaatggaggctgctttagcacctcatgctcctgccgccacctccctccccttctcccatgtcgccgccgccgcatcgctggccggccgtccgacctccttgtcccggtgacctccccaccgccggccggcttgcccagagggagatgagtgagagagagagagagagaggaggaagggaggggggggggaagagagatgatgacgtggcgtcctgacatgtggggcccacgtggatcccacgctgactcacccgccatgtaggacaaaaccggggtcaaaaccaccgaaggatgtaaaacgaacggttttgtaagttaagggacgtcatatatctggttttgtggttgtgggacgattttgtaattcgatgacaggttgagggaccttcggtgtactttttccttttcttcccactccttgagaaggactgaaattagcccaatactgattgagagattttctttccttttatgtttttaaagtagtaattgctgaaacaatccttgttttattaacattagtaatgtagctctgaaacctattttagttcatggagtatttagaaaaaaaactcacaccttgatttattaagaagattttattcccttgtttacttcattaaacttaattgatttacacattactatagaactccaaacatattatgtaattttaaaattcttgcaaattcagactattgtgtttcaatgaaaaaaaaagatatgatagtgttttcaatgaaaaaaaagatatttatgatgaaacaaaataacattcatcacgatacaatgttaaactagcttatgacgatttgtccttagtttcagtgacggacacctcattttcatcactaagcgccacatcgctccctaccaaccgtcgtaaaactaaataacataatactccctccttccctaaatgtttgacaccgttgacttttttaaacatgtttgaccgttcgttttattcaaaagcttttgtgatatgtgtaaaactatatgtatacataaaaatatatttaacaataaatcaaatgatagaaaaagaataagaattaacaattacttaaattttttaaataagacgaacgatcaaacatttttaaaaaagtcaatggcgtcaaacattctgggatggaggtagtaacaaataactttcatggcacgagaaattcgtcaagagaagatcgcatgcgttgtagtgtggaccaacactatctcctctctcgtcctcaccacaccgtatggaatcgagggcaaggagcgaaaagccataaccccgccgcatcttggcctttggcggcgggaacccatggttagccagtgtccccacacctaatcgcccccacgtagccctggcctcctcgtcgtcctcctctctcgacgaccgatcagcttgatgactcaatgtttgtggtggtggcatcacttacttgtcatcagaaagggaggttggaggaagagagatgtccccgagttagaggaaggacacgatggtcatttccccttagatgtggtaacatgacaccttgcatgcttaacgatggcataagaaatacccaatcttcaatggtgaaaaatcagagttttccgagagagtgatatttgagaatacatcatccgggagaatgacatgaaatcaaaaagaaaaacccaaaagaagatgggagacagaggtagagggagctaaaaaggacatctcatgctgtttttttcgtcaccttgttgtagtctatcatattctggtgcctactgcctggagtgtctaatttataatgtacatggacataataagagcgtcactcatatgtaacaaagccacatttttcattatctttcagcaaatgctagtgtcacatagcaaactttgtcactctattaatatcaaagaatatatttctattttttttaaaaagggaaattcaaagaacgagatggaccgccttacgctgatctatggactggcgttgtgtccaacgtcagaaatccgattggacatcggagctctagtcacgtcccctaatacagtggatatgaaggatcaagcttataagtgatacgctggtacagtgaatcatacagtgatgcaactaaacattgtataaatcacgctcataactgttgcataggcacgcatgaacgacagtagcatacaaaggatgaaatttgtcttgaagaagaaaatacatgacagggatacttaccatgttcaatgatacacaagcaaagagggctcttaattaagttcctccaatattctgggacagcgatatagcagtaccagtgtgcaacaccaaaattaactgcataatcagataaacagagtgctctaaaatagataaaggcactaggccagctggtgatcatctaaaactcaagagactagtactagacaacagtatcagatatactactcgttatatctgatgagaagggcaaaaattccaatcgctgcgcccaagctagaagcaaccattgccctcttcagcttcttgtatgcagcgatctgctcctccgtgcgccttgcaaaaagaagatgtgaataggtgttagttagcacatggatgccactagttgggagtatatcgcacacgaaagtataaggaattaggttgcctgttatatagtaccgtgcatcttccttaaccaattgggcaaaaatccgagaccgctcttcaaaatacttgtccccaagcaattcaaaacagttgtcatcaacaggagttttagtcttagaagatgtcatgctgctcagcttctcctacaataccatcaaagtaagaaacaaaatcaaattgcctgttagtatttcaccgtgaatttaaaaagttcataattttttttagcaaattaaaagatatattctttttcgcaggatgcataaataactctacaggtatacgtatgcactacagtcacattgaatcaatcaatctatctatctatctatcaaacgctggcagaaacactgcaagctgattggttgatttggtgtgcaataatatgttgacatgtgtctattccctctattatattccacaatctggaagcaaggtaaaaaaggcaaaaaaaaaaagcaagtacattaacaacttccagagcttcccattctggtgggattgaaatagatctattatttcctttgcataaaaatagtcttctttagtgccaactattagaatgttgtagaaaaaagagagaaaataaagattcaccctcgaagaagaaaaaccaaattttccatctatgcacagcctctatacttagagatcaaagcgaaggaaagctaaaaataagattaaaaatgtgaaccaaaaagaaataaaatgaaccgaggaaagaacaaaaaacagcaagagggttgccttctgcttgataggtcacccgcaactaattttatcaagtactaaattttgctatgtcatgaggtttgtgggcatcaaagtaaaactttctatgtaattcatgtgcatatatcaaactaaattgtgctaaatcaaatgtgtatgcacctctattaggtaaattatgtgatttttacacatcccgagtaaaaattatgcagaggagaaaagaaaatatccgattctaccaaaataaatttctataataagataattagaaatctgttgatcttctagaagttaaatagggaattaaaaaagtgaataaatattatgagaattaaactatgtgctgcgtaaaaattgtgaaaaatattacgttctaaacagaacacaggaagcatatgcatgcaaattttcatgtgttagaaaagataaaatgaaaaaataaattaagaatattactgccctgtttatgacgtcctaaaagtaaaccacaaaaccccaaaaccatcttagatgatcattatgtagaatatgtagaaaataatatttgttattagatattacatgtcagcctctatgttagaggtccaaaatgttatataaaaacttgaaaactaacatagatacgttctgaaagtctgtaaacacgtactataaaaataaaatagcccgtcgcgccaaccgatgtgtctattttcagtggttgattataatcattctcaagacaaattaaacatttttgaaaaaaaaaaggctggacttttttttccctcgaaactaaaagctcgcgaatcggggactaattgaacagcgtgcggtgattgaatcgggaagatgaagataattacggaggaggagggagggggagaaggggagggaagacgaagaacacctcggggtggaaggagctcgacgccggcgcccggcggagggtggctgccaccggcggcctgagcttcccggcgagagagcgcagcgccatagccatgccgatggcttccggttgctgggcgtcgagatcccgggagggagatgcctgcctggccctagggtttcgctcctctcctcctttccccttcgtcttctccttcctaatccttccccttgctgtcgcgcacgaaccaatcaacaaaccgagtacttattagctaagcccggtctatagaccgtggccccaccagccagtctatgcaagttgattggagaaaatttgcttttgaagcctgcaacgttgacgtttttaagattggaataagttcactttgggtccctcgggtccctctatttgttgcccactccgattttcgtcctttgaccgcaaaaccgggtatgacccatcctccaacttacgaaaaccagtcaattctcgtcctatagcagtatggagggcggttttagctgagctggcacattgaccgtctgacgtggcacgctgactgggagcgacagttggtgtggggttaaatgagacggaaaaaagggcgcgtgtattatcacttctcccattctcctcagtcgaaaaccctagatcgagcttaagcgaaccggcgggcgacctcgagggcgagctggcggcggcggagggctcgacggggggcacgacattgggctcggcgaagggcgagctggcggcggcggagggctcgaggggagcacgccaccggctccggcgcagggcgcggccgaggcccgctcgcagggcacggcggatgccggctaggctaggggcggtgcggaggcatcggtgcagggcacggcggtgcataacctcggccgacatggggcagctgacaaatcaatgagtggccaggtaaatttctttgccttttggtgctggtagtattgggattgaggattccgttatttaagtttggtggaggaggatgatgtgttggagtcggtgtatattaggagtagtttagttagtgcttttgctggatctgtgcagattggggctattttattcgtttgcttgcagaaaagatgtgtgctttgttttttttgcatgtttaggacaattgtgggtggagctaagtcatttttttattgcattttgcatgttaggataaggctattgaaggcatggacgtgcttgatactcttgtggtgaggttccatatgaagggtgattttgtgacagaaggaagggaaaagagctatgtaggtggtgcggaggcattgttttatgtagctaggtagaaggtgacattgagtgggatttttgcacatttgcgtgagcactgcagggtgttagagggcacacttttgcactggctttttctagggaaagatatccaaactgggatgcgtgctctactgagtgacaaggtgtgccaattcatatcagactgcatttgtgagggaggggttgcataagtgtacgttgaggagcctgaaatagtggacttatgtgatgattcagacaaggatagtgattatgaagctgacatggaggtggacggtgaaaaggaagaggattgtgaagaaattgctgcagatgttgagccagagcaaataaaaggcaattgtgtgcaataaacagtaacccaagaagctcagggtgatacaagtgcactaaagggtaaagctgtgcaagaatgtgatgaagatgagaggatgcttgtggtttatcaccctgattctgcccccttgctagtgtgccaccctctgaaagtgaaactgacagtgattacatcccaggagatgactgccctctgatgatgatgaagaaacagttgaaatagagaagcattttaaagaggtgaagaagaaggttaagacagcacagttagacatcttggatgatgtgttctttgtggtagagaggtccaaccctagtgacagaccagctgcagatgagggggatgaaaccccttatgttgacagtcaatatgatgactcaattgaagaaattggcagtgatggagaggttaggataaggagagacaagcactgtaacgccccgattttcgttcgggaataaaaatcaattaatacattttctagaaattaaataaaagttaaatcaacttaatcaagtgaattattgagggaattaaaaatttcctttaaaaattattggccgggaatattctgtaattttctttgtgccctaatgtactccgaaattttccgtgaattttcggagctcgagaaatagttttaatagcacaaagatcattgcatcaattaaaataaaaagaaaacaaataaaatcctccttcctctctttgggcccctttcggcccaatccctcctttctctcccgcggcccgcgcgccccctttctctccctctcgggccggcctcctccctcggcccgctcggctctctctctccctcaagtccgttctgcgtccccagccggcctctccctccctctctctccgacaggtgggacccgtggaccccacctgtcatccctttcctccagctccaactgccgccatggccgcttgagccaccccacgacgccgcttcctccgcgcgcctccacgctcccgcgcgcgtgcagacgtggtccaccccacgtcctccccttcctccactttcttccccatttcccccccaaaaatcggcgccgttcgagccccactcgcccacgtcgccggagctccatccgtcggccgttgccgcctgccacggccacgatctccccctccggggcctataaaaatgcaccccgacctcccctcatccgtttccccaactcactgccccctcccgcgcgctctctcgagctccccacgccactcccgtgtgccgccacacgccgacgaccctccagtcgcgcgccgtcgccgcttccgtcgcccccgcactgcgccgctgccacctatagcatcgcagcgtcccaccgcaccccggcatccgctccatttcccctccccgcctctgaaacaccgtcgccacgcgcaccacctctctccaccgtttttaccacctccagccgccgcttggcgccgctcctaaccaccccaagcagcgccgccaccgccgctcgcttcgcagcgccgaggagcacctcggccgccgcttttcacggccaggatcccgccgggacacggttcccctcgcgccggtccttccagccgccgtccgccggttcccgctcgcggaacgccgccgggccgccgttccgccctcgtcccgaggagcgccgacgccgagctccctgcctttccccgcccctcgtcgccgcgtccttggtgagctcctcctctccctccttgcctccctcctctgtctcccgtgcgcgctgccgcgccggtggctgccgccggcgaccacctggccgtgcaccgccgccccgctcgtctgggccgcccggaccccccttgtcgcaccgcgtcgatctcgtgcgccgccgccgcccatgcgtgccacctctcccgcgccgcccgtcggtcgccgtcgccggagaccgcgctaccgccgcgccatggctcagctaggccggctttgtgccgtgctgtgccccagccgcgccgcccctggccgcccgatcggcttgggccgatccggaccgtcggttcccgtggaccggtggtggactgcctcggtggtcccggtccacggtggaccggcgcccttgtgccgctgaccggtggggcccgcttgccggcgccgcccctcccctttgatgacgtcagcaaccctcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgcctgcgtgtagaatccgtcgtttcggaagatcacggtcgcaaggataagagttcggaagattgtttgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaataaatcgactagctcatgttacttatgtgacctagctagaactatatgcttagccatgcttaattaccactagctcagttgatggggtaattatcgtattagaccttttagtatctaaatgagctgcgtgctcgagacatctggccatgcttcatggtcgtaattatccaactaaaatgcgactgaatggtgggctgtgggtgcatggttttgctggtcgcacccatggcagttaaggaccggttcgcgggatgccctggagaacttatcatacttaccacaagccagcgtgggcaacggctgggcttgtagtgtagctttcctctagtcgacgcatccaggcaagggtgggcgtaatggagtggggcgggccctgcgacggcctctgtcgcttccggattcacctaggcacgagaggggactgcccgttgcccgctggggatgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttatgggtacagttgtacacctctgatcagagtaaaactattcgaatagccgagcccgcggttatgggcggtcaaccagattcaccgtgattagtcccatcttaataaatcgacccaatacattgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacatctgcatcgttggtgtggcttgctgagtacggtggttgtactcagtcttgctattatttcccccttttcagaagtgtagtgcttctgagctgaagatggagttagaggaccaaggctcagaccccagttgagttttgcctgtggagtggagctgaagctccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacaaagcaccctaggtacaagaagagagaaggggtgcttgtatttgaactaggcatgaagttcaatggcaagaagcaatttaagaaagccatgacaaggtatgtccttgctgaaaagaaggtggttaattttatgaaagatgatcacaagagggttagggtcacatgtgactgggatagctatccatgggtgtgtttattgtccaagaactcaaggtcagatagttggcagattgtgacttatgagagtttgcatgcatggtccaccaaggagggataataaaattgtcacaactggcaggatagctgagaaatactggaattcatagctgccatcccttcatggaacttgtcacacatgaaggccacagtacaagaagagatgtttgctgaggcctctatttccaagctgaagagagcaaagtctattgtgatgaagaaacagatggatgccacaaaaggacagtatcagaagctgttcaactaccagcttgagttgttaagaagtaaccctgggagcacagtggtgttttctattggactaacttttatgtttatgtagggaattctaaatgctattgagaaatgtgcccctgaagctgagcataggaattgtgctaggcatatctatgcaaactggaagagacatttccctgataagcagtaccagaagaagttctggagatgtgcaaaggccccatgtagaatgcttttcaatcttgcaagagccaagctagttcaagttacacaggctggagcccaggccatcctcaacacccatccacagcactggagccgagcctggttcaggttaggttccaattgtgattctgttgacaataatatgtgtgaatcatttaacaaatggatattggaagcaaggtttttttccccataatcacaatgctagaaaccattagaaggaaagtaatggttaggataaatgatcagaggaagaagctaactagatggaccactgtgatttgtccaggcatactaaaaaaactgaatgtgtacatcattgagtctgctttctgtcatgcaatctgcaatggtgacaataaatttgagatcaaacatcatgacaatagattcacagtccaactagacatgagagactgttcttgtagatattggcagttggctaggttgccatgccttcatgcgattgcatgcatctactacagaacaaacaacctagatgattacattgccactagctactctgtggaatcattcaaagccacatatgcacattgcctagagccagtagaagggatgtctgcctggcctgaggatgatagggagccccttactgctcatgggtatatcagaatgcttggaaagccaaagatagagagaaggagagagatgcatgagccagcaaagcccacaaaaatgtccaggtttggcacaaggctgagatgcagcaaatgcaaattagttgggcacaataagtcccgctgtgggaaacaaaatagtgggacgggtcctagcacaggaggttctaagccaccaacaactcagaatcagccaccatccatttagaatcagaacctggttctgtctaacacaactcaaagctatgctcaaagtagaagaggaagtcagttgcactaagtggacagagttcaagccttcaaaccatgcccaaaaaagctaagacaaaggtaattgtgttgcactgattttacttccatatgcatgaaaaataccattactgctgctgtgtgtcatactgtcttacttcaatatgtgttgtactggtttttttgcagactcctatggattcctagaacaaggtgagggtgaatgccaaggccaaggtttctgcccaacatggtggttcagctaggattgatctacaagcaattgttccttattcacagagttctaccagtgcatcagtgagagtcacttcagggagtgcttctatctgcgtgtcagctgaggaacctgcatatgccaaatcaaggaggaagacagcggtgccttgctgctattgccatgggagtctgacaaactttgatgaagattgtaaccttgtgatgttatgcaacatgtgtgttgcagggcatgcagcccttgtatccagtagtactattgtttagtccagatgttatgcaaccttatgtgctgtttggctgtgatgtttggccatgtatcaagtactctgtcttttgtattgtttggcttccatttaggaacctgtatgaacccctgtcagacatatttatgtgcttattgccagacttttgcttcatacttgtcaaattgctactatgctgctatatgtgaaacatttcggttccatgcagatttttgcttcatacttgtcaaattttgacttccatcctgatatttgtcaaattttaagttccatcctaatatttgtcaaatatatatcatttcatttcatttgacaaattttgagttccatctgtcaaaactatttcctttaggaccacaactgtcaaggttacagataaggtataccctctatccttggatatacgttgtataccgagacggtatacccgcgcgtatacggatagttcctgtatgcggtaaggaaatctatcacgtaatagaaacgaagtccacagatagaaagaatcctactcggataaaactgggtcgttaccatatcgtgaggggtccgatatctccgagttctacttggagatcaattgatccgcggtataaaagggaccccccgggtaggacctaagtcatcgaatatcactgccaacacatccaccacagcctacaaagccggagcctacaggagccaagtcgccgggtgatctagtcgaaccaactcgactacgatctcgtcgatatcatcgaatcccactattccctttgtaatctgtgatttccatcatataatcccatatcaactggattagggctattacctacaaaggggcttgaaccagtataatccctgtcttttattttgcttgatgtcgtactacgtagatcctcgttccaacgtacccccaataccctctatatcctgtctacgggtatcccccgtcaacaacaacagcaaccattcaaccattcaaccatttcttttcattaggaccacaagattgcaaattgtgactttcgtccaatagcaaccattcagccatttcttttcatcacttcacaagattgcaaatggtgacatacaagtccagcgtacacaatgccactttcacctcacacaatttagcatttcatcaaaagacaacattaaggtccaagcattcatacattgccagggggggttcatccatacatacatggacagcatacaaaatgtgctcatacaacattcatacatttccagctttcctacattatactcttcccaaacatgacaacaaacaacacaaacacacatgccacactacatattaccataatatttctctctctctctctctctccacctttctattcctatctttcacacaacacaattctttccaaatttcaaagcagttttgcctaactgctgcaagctcagcccttgtttcttcaatcctattcgtatcctctaccagacgctccctgcactcctctacctcctgccgcagctggtccttctccatcctaagcgacatcacagcatctctcaggtcattcaacaactctctaagaaaactgctcgtcaacttgtcgcaccaatcaaaaaaatcacatcccccatcctggaacagtaaaacctaacattgaactcaccaaatccaaccaaaatcgaaccaaaaaaaccaaatcactccaaatcgactgcttacctgagcattgcgacacttaaaataccgccggccaggattatctacgctccaggatatccatctcgctgctttcgccttgcaacgacagaacaccgggggttgatactccattggacctacccgatacgggacaggagcaggccgtcgagacgaagaagacgacccgtcgctccttgagctcgccatcgctgcaccgcccttccccgagccctccgccgcctcacgccttccccgccctcgaggtcgcccgccgtttcgctcaagctcgatctagggttttcggctgaggagaacaggagaagtgataaatacacgcgcccttttttccgtctcatttaaccccacaccaactgccactcccagtcaacaaggcccacagtggtcagcgtgccacgtcggatgctcaatacgccagctcagctgaaactgccctccatactgccataggacgaggattgaccggttttcgtaagttggaggacgggtcatacctggttttgcggtcaaaggacgaaaatcggactggcaacaaatagagggacccaaagtgaacttattacttttagatttacagacatatagttggccaaaaggcccacagcccgatggcccggcccatggtatggagatttagcccggcctaagcacggtatggcctaactgttgtccgggccatgtcggttcgacctaatcgttgggtcgtgcctaggcctcttcctcggtatgacttgccggcccggcccagcatggcccaacgataagcataaccgcgacccgacatcctccactcctgtaggccatagcttgtcagtggccggcccagagagatgagggaggcaatatagactttattctagccatatgtaaggtgcaaagagatgagggaggtaaaatagactttttccaaggacaagcacgttgggcccatcatgccttttggcaataggtgcaacccgcgtgtgggaacagcacgacatggcgtgtcggtcaggccatgctgagcgaccaatttggccatatatatatatcactagaacttcctggataactttaattggagttgatcttggcaaaatttgctataggacactgaaaaatctatggcttttgctacgagacacccaaaaaacgcatatcttttcgtggacatcataaaaatatgataattagccgctggacacccctcacattattttattatattcgggctagatggagagagaaacttaagtaaaaggcaagtttgcccttgggccaatgttgtttaacccaatcgcgacatgtttgaaggttgaagcagacccattcgcccgttcagtctcatgatcccctctcctccaaactgtaagtttaggtgcgttgatgacagtgttgcaacgagctgcatcgagggtggcgagcactagtgagggcggctgtggtgacggcggattcaattggcgctttcatattcgaggagagcggggcggcagaatcaaacggctattcaggcagcggggaagaatcaagcagcaagatagagtgcccaccgttttcttcaccctaggtcaccacttttcgggcgacttcctcctgggaaacgacattccagcgacatcgcctgcgaccctgagctcacatctctatcaatgctgaccccgtaccgcttcaatccaccactgccctgactagagcttgctaggggtggcaatttctccgttggggccgggggccaattttcacccgcgggtgagcggggacaaggccccgcatgttttcggggacgggggcggagatctatcgtcagccactcgcgggtgacccagcgggtccccggagtataagataagcgtcaaaatgtagcctattccaacaatacaagcccagttggcccaataagtgagtcatgtaaaatctaaaccctaatttctcaatccccacatcccttactcccactcccctcacccatcctccacagccaccaccgcatcgcctccgcatccgctagtcgccgcgcacccgcgccgcctctgacttcgctcatcgccatgccactgcctgtcgccgcctccattcgttgccacgccgccgccgtccctgcaccgcctctgccccttgccgtctttgctccgtctccgcccgttgccgtctcaattccacctccacccatcgctgcaccacctccgtccgtcgccgcacgacgtccgcctagccacgcctcctcctgctggcgcacggcgacgcctccacctgctgcctcctcccgtcacagcgggcccccgctcgggtggcggggccccggaggggccgaggacggggtttgatttcgacctggccaccagtccgaggacggggccaggtggacccacaaaggggcg

SEQ ID NO: 65146 - DNA, 8853 bp, Oryza sativa
ccccgccccgttgccatccctagagttcgccaccgttgacgcagcttgcctccgcaccgtcggtgctgccccgaaacatagggttatagcaaaggggatcgagtgtgtggggagtgggtcgggtctggttggaaccagtggcagtcatctttacaagccgaacgacccgtgggacaaaatggtactttcaacgttctttctctctccatctagacgtgatataataaaataatgcgaggtgtgtctagcagctaataccacatttttgcggtgtccacgaaaagatacgtgttctttggatgtctcatagcaaagaccacatacttttagtgtcctatagtaaattttgcctttaatatatctagcaattatgcccatacgttgcaaaaaaaaactaaaattatacggagtagtaaacattagatgatttgggtatattttctatgatatagatccatgtcaattctatgggttcaacataaccttcatcacaatctaacgcatagacatgagcaatgcaaataatcctaaagcaaatttcagcaaaaggaatagctaaaacggagatacaacaaaagaaaacggataaactgaaaaccgaatagagattcatatgacaacaaatcatttataatgttagaaaattggaagtgagaaaaagcttgtatttatttttatttaaaggggcgcgataaaaatattggcaggggtaggtagacaaaagtgctaggggcttggacttgtagagtcactgtcacaggcagacgatagagtgtgaacgacgaacgaacgttcatgcgcgagaaaactgcctatctaccattccaaaagaatggattcgttgaaataccatcgctaaaacaggcttcaataaaataccactcttaaccacgatgtattagctgaaatgccatcttggactattttaccattggggttcttcttcctcccccaactcctcatcttctagttcgacgccctcggtggggcggccatggatgaaacgacggcgctcgctacttacagccagccgacgcggtggaggcagtggacggcgacggtgacgcccgttacttgcgcacttgcccgacgtccttggcggtggtggtggacggggatgggggacggcgacgcctgtttcttccaccggtgcttgtttagcgccctcgcgaaggcggaggtggacggcgacgacgccctcggtggcggtggtgacgatgatgacagcgcccgttaatgttgctacttctgctcttgcctggcccctcggtggtggcggtggatggcgacggcggcggcgaccgctactcccatgccagcccggcgcaatggcaacggtggatagcaacggcgccctcaactagcggcctcggtggcagtggtggacagcgacgatgacgcccgatactctcgcgcctatgcccaccactactagttgcaaaactcttctcctcgtcaactcagctcttctcgcagccatgggcaccagtgatgtgtatggaggaatacgagcgaggaagaagtccaggggtaaaaatggtctaaggcctgtttagttggagggactaaaactttagtccctaaagtaaaactttagtccattcactttagtccctaaagtcccaaacaggggtgactaaaagagaataaaagtgtattagtcaattagtctctatgggaggagcgtatagagactaaagttgcttctttccacccactgccccacgcacaaccctctctttgcatgattttagaggtaacatggtccttgtacagtgtaattaatgacctttagttccttttaatccctacatccaaacaggtatggactaaaggatccaaacaccctctaagatggtatttcggccaagtagtcctaattgagagtggtattccatcgaaacccattttagtaatggtattcgagcgaacacattcttttgcaatgacaaatatgcaattttctcatcatgcgcatagcgagtcaaacaaaggacgaaagattgacgaatgtacgatgaaatcgatctggacttgcgaatcacaatgatgatgttcatgaagtcacttgatgctatatgcattttatctccaacaaaacatggacttttctactgtatgttctatatagcatacaattaagaaaaccaaataaaatatagtactctgtttttatcaccatgcatatcaaagtaacatcagtgtaattaacaatacacgtttgcttacaaaaaaacatgcacgctagaggtttcataagaaagtcttaattaaaagtcatagttataatgataatagcggcagtcgatgcatggttctcttatctagctgtttcaatcctgacaaagaaaaacgcccatcacaacagtaccaacaacgcatccagaagcagccgccgcaatcacaatcctgttttgcctcctccgaaatgccaccatcggttccgctaccactctttggatttagaaagagtaacaaaaaaaaagaaaacagatgttatttcaataaaatatacagtaaaagacaattacaatgcttttatatagcctcttaccgtgctctctcattgatgttctcaaacataatgcgagcgtcctcctcagcattatggaaagtaaggggcttaatcttaggatttgtgttgccactcaacttatcctacagttccacacatgaagagtaaatataagttagacagtggcttatcctacagttccacacatgaagagtaaatataagttagacagtggcgaatccaagatgaaaatggaggatagactcaaaattagtgaaaatactttataaataaacaataggagtgttaaaagtatatagtgttatgcaaatcaaacttaacatatactacacgattggatgggccggagaaaaaaaagaacctcaccgatacatggtgtatccactttgccattaatcaaatacttttcaaaatacgcagaacaaatcactaaatagcctcatttgatcactactatactttttattgactgcctctgttcaatcgctgtggcctgtggataaaaagcatagctcatcgttgttgtcatcattctctccagcgcaactccaagccgaatggaccatcgttctcacaagagatgggccaaattgggccacctgctgggcattaattttccccaaccagcaggcaacatggcagcaatcaaaattgaaaacccaaaccctataaccaatttgagctgcctgctagcgtcataaaaggggggccaattaactgattaatcagtatccccgcaaaaaaaaaaaaactgattaatcagtagataatgagaaacaatttttttgttgggatagggcgatgcctacgctcgcccctcatgtggctcctccactgcaactcatgctcatgcagagcacacctttggcataaacaaacggaacatggctgtgtatatacacctttcttggtgtagagtctgggttttaatccattatcagaaaacgaaataagttaccttcagaagagacaatctaataagatcctagaacaattaatagcccaacattgtatggcccgggtgaatcactaaagccgcagctatctctccccaaccctctacagcccaaccatataccaggttagagcagctaccaaactttcagtattccacccctgtttatatctcttgtaaatccacccccatccctccctctctatatctgtctctctcaatccttctttctttttataaccttgcaaccttaaaaaactctgtaaacctcatttctatcaattgaatgactacaaggtagagccggctctaccttcttacgtcaaaagaatttgaaaagttcatattttttttctcgcagggtgcagaaataactctacagggatacgttgcagtcacatatggttgattataatcattctcaagacaaattaattatttttgaaaaaaaagactgatttttttctcgaaactaaaaactcggcgaatcggggtctaattaaactgcatggggtgattgaatagggaagacaaagataattagggaggaggaggaggaggaggagggagggggagaaggggagggaagacgaagaacacctcggggtggagggagcgcgacgccggcgcccggcggagggtggatgcgaccagcggcctgagcttcccggcgagagagcgcagcgccttagccatgccgacggcttccggttgcgggcgtcaagatctcgggagggagcgaggctagggtttcgctcgctttcatcttctcctttctccttctccttccccttcccctcccttccccttccgctcgctgtcgtctgtcgcgcacgcaccaatcaacaaaacttacggctataagcccggtctatagaccgtggtcccaccagtcagtccccagtctatacaagttgattagagaaaattgcttttttaagcctccaaagttaacgtttttagatacttttccctctgttttgtttatatttttttaaaaaactagcaaaagtgcccgtgcgttgcaacgggtgattacggagtgtgtatattaaccaaaagtgttgtttggtttatcaaaagtgtctgtgcgttgcaacgggaagcgtacagatcagaaaaatatgcaattaattaaaatacaaattcgctgaaatatttggtatttttaagtaggtatgtgtataattaaataaatttacaagtaaagcaattgtgacaaataaaatgacatggttaaatttaattttattaaattctccatgattagttaacgctcttagaaattctattggaattttcagagcttaattgttaattttcatttaacaattatttaattggaaaaagaaagaaaatacttccttttaggtttgcttcgaaataaacacattcaacaactataattgtaatgcttctgaaaaaataaagtactaaaaatgaacttcttctctttttcttcggcccgagagacctaaaatagacttatttccgtcccttgccggtcggcccatggccttttgtgcacgcgcaggcgcagttcccctctccaagccgcaacctgggcttgggccggaaaagtggcctcgctctcaatccctcttgggccgatttcggcccggccgacaccggccgtccaatctctagggtttagatcggacggccgagcgtcgagatcggggaaacaaaaccctctccctctcctcagtcgccgaaaaaaccctagcccattctctccccccccccaatcgacccagccgccacccccgcgcccgacgccgcctctccccaccggcgacaccgctccctctccccatctcccgcctctccccctcacccaagccggtcacctcccccgtcaccggcgccgtctctcccaccaccggcgccgcttctcttcccttctccctcccttctcgccggcatggcgcacaatggcggggtacggcgtcagcggcgtccgcgctccctctcccgctctccttcccgtctcgccggcacggcgcagctgcggcggagacggcggcgacggccgtccctccccctctccctctccccgtcggcctagacagcgacgacgccttctcaacggcggcgtcgacggcatcggcttcgttcgcgggtggatccgtcggcggcgtcggccactgtgggtggatccagcagcggcggctccctccaccgcctctcttctccctccggcggcggtggtggcgtcggcggccgccgattttttttttttttttgcaatttttttccatggctattgctaaccgaatcggattgcgtacgaacgagacgaaaaatagatgtgacgaaaggaaaaatacgaatatttatattagttattatagatatagatttgtataatactattgtcttatatcctatttgtataataccatggaggttgaacttgcatgtttgtatagtgatatatcacatgttaatacatcttcttaattttttttaatttttacccagtgctaagtgctataaggctgcatatgattctttgttatgtgccgtgattctttatactatgtatgtatatatgcacttgttatcttggtgatgccaaccgaataggacttggacttgtataattcaaaccaattcctattcggccaaaacagaaacaaagtcctagtcagcccaaacggaaatggattggagtttgtttcctatttttatggaatcagacagattttttttcccgatttttcttttaccgcatcgatggaattagattcgatttgttttttttatcacgtcgcttttttttaaaccgtgccacatataatatgatttgattttttttaccgccacatataattcctttttctttggaatcagactgtttttttaaaaaaatttcgccctttttctactgcgttgacagagtcggattcgtttttcttttcccttatttttgccatttttctggatcggacagatttagtttttctttttttttccggttttttcgtccggtttttttgactggacagatttggttatttgatttgatttttttaccgcgtcacatgtaaatccttctttggaatcagacatattttttatttatttcgccctttttttaccacgtcgacggagtcggattcatttttctttttcgcctttttattctggatcgggcagatttggttattcttttcttttccggttttttttcgccccggtttttgggatcggactgatttgttttttttctttttttcgcccggttttctccgtttggtttttcttttctttttccggtttttcttcgcccgttttttttgatcgaacagatttggttttttttctttcttctgtccggtttttttcgctcggttttcttgatggacgatggaagtacctcttattttttaagtagtagagagatatccgtgtgttagtaaactaaaattataataaatataaaaatattatccgattagggtttagttttacattatatgcgccctttaataaaatatattcgtaaagaaagaaagaaattttataaaaagaaaagaaaaaaaacgaaaggtaaaaaaaaaaaactagttgtacctcaccaaccagctagggcatcgcgcagcctatgaagcacgcgtggctgccaagggtggaggttcgcagcgaagatgctgtggtggtggtggcttcctcacgagatagggtgtgatggtagcttgacggaggctgtggaataaactgactaaaattgagggggtgtttatatccaaatttttgacatgtcatatcatatattatatggggtgtcgcatgggatatttgggcactaataaactaattatagaatctgtcgataaaccgcgaaacaaatttattaagcctaattaatccgttattagcaaatgtttattgtagcaccccattgtcaaatcatagagcaattaaacttaaaagattcgtctcgcaaattagtcgcaatcagtgcaattagttgttttttagcctatatttaatactttatgcagatgtttatgtttaatgtgacatagtgaaaaattttgggtgggagcaagacagagcctgagtgccagtaaacaaaattgacgagcaacgtttcttgagtctataagagctcagttgtagagtacatccccggttaacatctacttccaacaaccttgtgtaccggttcagaaacaggtcacatacacatctacttacaacctgtgtatcagctcataaacagatcacaatacagggaacgctgattatattttacggagatccctgcagacgataatggatcaccaaactagcaaattaattcaatgctcaatgaaaattcccattttctaaagaactaaaattgattttcatgtcaatttttcactccagaaaccatgagatgcgctgttcattgtaaggcaccacacagcgcgtatatatatacagtacacatgtatattccttccttccacttccagaagttgtgcctatcaatggcaataggaaaataccatacacacacgaagctcccttcagaggtttagaggattgctttctgcactgaaatcaaggaaagttgtcggtaccatattatcaccacaagaaagcataccgtatccaaagttcagacctgatattcatcagaagtttaagaagtgttgctattctcaacagaaatgggatctgctccagaaggaacggcaatagctgacccatcatcagaagttcccatttgtttggaccatgttgcttaacagcttgacactgaaacagaccaaaaaaaataagctactaggttctagtaatatgacaaaaagaaaaagaacaatgctatacgtacgactgttccatccgaccggcgtacaacagaatggcgtgaggcttcatatgacgttctacttcttgttgacgccgtgcacttcatagtcgtccaaaaatcagacactacaggtcgtgtgtgtagcatttttgaaagaaaaattgccatacctcacacatatagtgccttgcaagcctgctggatgcatttattggagcgaaggacatgcaatcggcaagatgtgtggatgtggaacattttgtccacagaatgtctagaaagagatcaagaaaatcagtccaaagctcagttgacccttaacaaccatccttagtcgacattcacatgccctcaaaaaaattaattataccaggaaagagttaaataccttggcgttgacttgtgtcaccaattgctcacatttctcatatcagcatctctttcttcagaagccatggtttgaagctccaactcaaaggccgcattagccatgctgtctgctgttgagttctctttggctcatttcatgtagagaagagaaaagggctgcag

SEQ ID NO: 65147 - DNA, 953 bp, Oryza sativa
caagacaacggcggcggcggcggccttctccgggaatccatagggcgggggcctggggccgccgccagggagcagcacggaagcgggaggcagcggcttctcgacggccggggcgggcttggtccagccggccgtgggcgccccggatcggacgggcgcggaggcggccccgccgcccgcggccgcggcggcgccatcgaaccgctcgtgctccttgcggagcgaggggaggttcagcggcggcgggacggagagcttgggcggctggggcttggacacggaggagccacgggagcgggagagcacgaccatgccgccacccccacccccgccgccgccgccaccggatgaggcggaggggcgcgaggggcgggctccatggtgcgagggcgcgggctggccgtaggatcggttgaggttaacggagacgaacttgccggggtgcgacatcggaggcgggggcgcgcccgcatgaaaccctagccagccgcagccaaggtccggcgcgcgcccgcgtgggccccctgggagtgggggtggtattattactacccacgcggccgcgaggtgcgggaggtggcggcggcggcggaggtggggggggacgcgccgccgacgaggaggcggcgacggcgcggcggtggcgtgggggatttgggggggaggagtttggtgtcgggccggaggaggaaagggaggggaagggagccctagagagagtagagagagagaggaggagcacggtggcacgaatctcaaagtcgctggttcggttcggttcggttcggtgcgcgctgtgctgttggatgccggacgaagccaggtcggcaaggaggagtggtggcctacaactgaatcaggaaagagagaagaaacctcaacccactaccaaagaggtaaaattagatttacgaccctggctgcgcccactatcaatcttcatggaacatgaa

SEQ ID NO: 65148 - DNA, 1844 bp, Oryza sativa
ccctcggtcaccatgccgagacaatataaatcacttagatcgaagtatatattaatagtgagattatagatgttcatagcatagccgattaggtagatctagcatgtataggctaatactccgataccactccatattaagatattaaggcaagtaaaatatatcaaacaaaagcctaatatacctaaatgcaacaagatcttaacatagagggcagatctagcatgtcaattaagcatatacgatataaaactaaatcaggtaagatcggctgaaatcccaatactattctaatcaacaaccaaaagcaggctagggattgagattctaatcacgacttataaggtcaaactcaactgatgcagttataagtatgaaaagaagaataatatcgagacaatcaagccgttggatgtttcatagagtagtggatatcctgtataatctaagccaacatagatatttaacctaatcggctgccttccaataatagatgttagctggttggaggttagataacgatattgtcgaagattatacataatatatgataactcgacgaattacataaacaagattagagtatcatgaagatggaagcactaatcccgagaatacaagccaccataacaagttttacctctagttgaagatcgaaaccgatgcagctcaacccgaaagcaagaacttgtcgaaacaaaacgaaagtaaaagggtggcgatgggccgagattgtattgaacgtgtgttgttgtattacatggggctcggggtctatttatactcgaaaatatgtccgtgtcggacacgactcttatctctaacaaactctaagatatcataagtctttacggcagacttttgcccaaacatatctctaaggaaattacatgaaatatcctaattaatagatacaattgccttttgaggactcaatccgtgcatggcaatcctcatgaagcacattaactcaacccgacaacgtgtaacgagtcactttgtcggaatcggcttaatcgaccgaccttgtccgactcgaactctgtcgatcttgatcgtagccgattcggacttttagcctattcttgctctgtttccggaacgatctctatcttggattccgcctcgatttaactccatctccgatacttgaattaccaaatttggttgttaacagatagatggttactttcttctttgtgaagaatcctagtactaaagcactcaataataatactaagcgacgaacccgcaacgatgggaatgtatctcacttaagcaagtaaattaaataccaaaagagaaatcacgaatacttagggtgtgtttgaggagattggggagatacgcaaaacgaggtgagccattagctcatgattaattgagtattaactattttaaatttcaaaaatagattaatatgatttttaaagcaactttcctatagaattttttttgcaaaaaatgcaccgtttagtagtttgaaaagcgtgcacgcggaaaacaagaatcaatctcccctatctccccagaacgaacagagccttactttattaaagaagcatccgttgaggtaaaagagagaagagagtgacgatagctctggcactcctctagaccttctcctcactctttacctatttcctccacactactaaagtgatgtctaagatatgaacttaagttgtactccattttgttgtgcattttggaaatgagtgagctccttcttttatagcctccaatgacggttgtggaggtcggagcaccacaattgtcattgggaggtgatccagagcctacacgtggaaggtggtgatggatggaggcaaggtctgatcagt

SEQ ID NO: 65149 - DNA, 4698 bp, Oryza sativa
taattagtgaatttaaaatgtaatatgttctactgtcttgtggccaacacatatggttatggactattttagtaattaatgctataaggactaccttcatagtgtatagagtcagcccatatggcttcatatattgcacaatagccacttttgtaatacatcgtggatgcccttataagattgcaatgtttacaaatttgcaatgccatcactttccatcatcgttttcatatttgttcatgtcgttctccaaatgtgaaatgtttgcattgtcctatgctccttgctctaagctcgatctaatatttccctagcacctcttctcttagtcatctcgcacctgacttctcacacgccacctccaccaaggaggactgcctgccatcccactctctttactactatacgctgaatcccaccgttgttattgttccattctgaatcccaccgctaccacactgtctccttaaccaattattgcttgttcattggactagaacatcaagactgtataaaagttagtcgatatagcggaaagacgactaaccctcctgattgcttcagtcattgatcacccaagacatgccagatgacgacataggaacacacgatatttgttaacaagcttcagttgaagcctacatccccggggctctgattatgggcgctcctccccaaccaatatagctcctagccgctacgagtccatggccacgccgccatcctctccctgcgtgtctatgctacattgtagtcgccatggttacattgtggtgcccccctctctatttaagagagatgacgggttacagagtccgactctaactccaccccctaacacctattacaacttcaagtccaactgtaaccaaataggactagtatattcgatacctaatctaacaaagacattttgctatgtcatgttatatgatggttatagctgcaacaaattctagacacctttttcacattgttccaaccagtcgtgtagcagatcaacaagattaaagcagtgcgttggcatgaatcaacgtgtggcggtgggaattgacacctattataacttcaagtccaactgtaaccaaataggactagtatattcaacacctaatctaacaaactccaccttggcaaatatacgccacccagaagtagtagaatcaccatgccgatccatctgtcctccaaacttgggttgtctcctttgcagcttcaccgtaagccgcccgacgagactgcgccagacccgttgccttgaagagactctgctatctctgtaacttcttcctctggactccaccttctctcatatcaccacagtcgtcttgccaagcgaaattgaattccttcctagctgttccatcatagactccccgaagaccatgttcaactccatctactgtcttaaatttgacttgatctaatccatggccagataaccgatgtcatcaccaaatagataaatcaagctcaccagacatgaagagaacactttcttccttgccgtcttatgaatcgagctaataaatccaacatccacgccttcccacatccatagactgaatccatgatatttttgagaaaatcaccgttgccttgaatcacgcgaagaaattaccaccatagcgcttgctctttccccttcagtgacacagattctatatatccccataatacaaaccccacagatcctggatatatcatgtactgccaaacaaaccgttgactccatcaacgatttcacccgctgttgcccgggtcttttcttcagttctggcacaactccatatatctcaactcctcatcaagtcccagatatatcatgtcttcaccagataattacatatgcgtcttgaccagcctgttgccgccaatctactcgcccttcacacttgcaaactatccatctgtagaacctttttgtccttcttctgaatctgttcacaagtttctgcaacgaaccacccgtccgttgaacccggtctaaccgtccaaactccgcagtctaaccagtccgtcagtctgaccaccttgctggcccggccgaatcacattagaactatgcacattgttctctcgagtagtaacatcctcagaccataacactgttgcgttgatcctcacatggcttcaccacgctagctgccttgtgcccacgagccgctctgcgaaatcccctccttgcgccaaccactgtgtcctagactccaccgaagtctgtttgtacacgttgatctccacgcactgctggaccgcccatgacacctttgcacaatcaattcctagtggttgcattgccacatcaatcaacccatgcagtgtagtatgcatgcacacgtactgacaaccaaccatgtcaattaacgtgaccatgcacaacccttttcctcggtctgaacacttgactcctcgatttgggcttgcaccggcccactgctcaacacacaccacatgttttttcttttgaacagagccgaaaaatggttgctcttcctttgaccagatccacgcatgcgctagtttctcgataaactgccgtcgcccagcgccaccagcccgacgaatccgccgatgcctcctgcttccttcacgccgccgccgacctggtcagcgccgtcggcctgccttctgctggaatccatagccgccgctcccaacagaagccccgctgcctctccctgcttgaaggtcgccgacgcgcgcgcccttcctagttgccgctgcccccagccgccgggaacccctattacgtttgttgctctgaagcttgagtcttgtgatttcttgttaaaactatcggtattagtcctctcaattcaaaggagtgccaccccaatacgactcggtttgtatcatagattgattcatatggactccaccaatccaagtcgtgttcaactccttgttttactgttgtcggactcaacgccgcctcacgtctaacaagccgaaccacatctccctgcttcatctttgcacccgtacccgttctgctcttggataaccattgtgtgtgtatgtgccgtgcctccgtgcacagcgtccgtgcccctgcacgcaccgcagtcgcagccctcgtgttcaccgtccacgacctcgtcgtctcggccctccacgtccgccgtgccgcgccacgctcgtcggctttgcccttccgtcagtggcctccctgccaccgcggatccgcgttcgccgcgtgcgtcgggcgcgccgtccatggtgctacccctccgatctctccgatcgccttcggccacacccggtctcgtcttccggtcacgttccgccatcgccggtctgatcgcgagcgaggtcgtcgcctccgcgacgtcctcattgtcgccatcgatctcatcgccacgactgacgatctcctgtcgatgcgcgatccccacctcgtgtttcctcctccacatgtcttcttgatccaatactgaaaccttctgctctgataccacttgttataaaagttagttgatatagcggaaagacgactaaccctcccgatcgcttcactcattgatcacccaagacatgccagatgacgacacaggaacacacgatatttgttaacgaggttcagtcgaagcctacatccccggggctctgattatgagcgctcctccccaaccaatatagctcgtagccgctacaagtccatggccacgccgtcatcctctccctgcgtgtctatgctacattgtagtcgccatggttacattgaggtgcccccctctctatttaagagagatgacgggttacagagtccgactctaactccaccccctaacacctattacaacttcaagtccaactgtaaccaaataggactagtatattcgacacctaatctaacaaagacattttgccatgtcatgttatatgatggttatagctgcaacaaattctaacacctttttcacattgttccaaccagtcgtgtagcagatcaacaagattaaagcagtgcgttggcatgaatcaacgtgtggcggtgggaattgacatgcagtagtagccgttgacagtggtgggaatcaacatgcatgccgtagttagaatcaacctcggatagcataggttggcctgatcagtgtcaggtgaaagcagtgaaaatcaacgttgtcaactggtgggaattgacgataaaaggttggaatcaagggtaggaggtggaaatcataaaggaggtggatatggcggcataggccaaggggagaggaatagagcttagcacaaaggtgagggaaatatattgagtcaataaaaggcaatgaagatattttgcattcgtaagaacgagaaaaactccaatgcaggaaaacatggaaagaaggtgacaaaatgttaaatttctaaacgctgaagtatttagatggtatcattgtgtactgaatgaagcttttttttctatatttctaaaaacatattatttccatatcgccaatccaattgccctcaaaaaaagagatatataaagtttgtcttgaaaaactttgaaattatggcatttcttggttaactaagtttgagatgagatcacaagtgacagaaatattatattacaataaagggaaatgacgtcatttgtgcctattgtatattcgtttttaatatttcctttttaaaaaaacctgaccatcaatctaaattactcctcaaaacataaagtgtgtaattcaattggttagcttt

SEQ ID NO: 65150 - DNA, 3296 bp, Oryza sativa
aaaaggtaagacaagacacacctaaatccaaaccacaacgagaaagcaaatcagcaatgagcctagagcacactagtagagaaatgatttttctggacaccggccccggtagatttcagacgggccgtaagtagcgttgtctggaaaaaccgggcgaccggtgccaggctatcgcccgcataggaaaatgcattatcccgtgcaggcgtctaatccgaccgtacgggataatcctcgttatcttgtgcggtcgacttaagaggaccgcacggaaaaattgattttcgcgtgcgggcctcttaagtggaccgcacgggaaaatacctctccctcttttccctcttacccacttcagaattttcacatcatcactcttccttttccctctcacccacttcaaaatttttcacatcctctatcttccttttaccttttattctccctcactcactcctctctctccctttcctctcctctccccctcccctctctctctctctgcctctttcttctcctcccctccccactgagcgcacggggcgtcgccaccgccgccgccggcggcgcgggaagcggcgacggctactggtggaggcggcgcagcggtgacggcggacggtcgtggtggaggccgagagcggcggtggcgcgacgacggcgaccacgagcagcggcagtgcggcaacggtgacaacgacaggagcagcggcagcgcaacgacggtggccatgagcggcggtggggagcggcggctgcacgacgacgggagcggtagcggtgcaatgacggcgacgacgaggacgatggcgaccatgagcggcggctgcgcgaccacgacgacgacgggatttttttgattttattttttttcggtattttttcgtgcgggtggtataatttgaccgcacaggatagtcgacttaacacaaccgcacaggataatcaattatcccatacggttggaccgcctgcatgcaaaaaaatattgattttcgcagaccctggatgcagacgggcgctacttatgtacggaaaaatggatagtaacaacatggaaaaatggattatgtaccggtggcagtactaacaaaccatactgccgttagtattaatattaatattaatgataccaatggtccatcgagtttgtttttcaactcccttatctaccttatctaccttgacaatataacttacttttaaatatagttttaggcaaaggctgaccagcggtgaagtttaagtttaaataattttaataacaattattaaaaaccgagcgcgcgattactctctaatgcgcgctctaacaaaatgaaaaattctacgggatgtttttcctccgtatgataaaagcatattccgctgctgcctgctggcacgtaaaagtggaaaaagaaaagaagaaagaaaaagaaagtggtcgccaactgcagcggggctcacttacgcaggcatcacaggcagcgacggtgtctccctaaaaagtcagcgggactagcttgtcacagtccacattccaacctcttgtcctgcacagtaaacgccgtcctctcgtgaatttttccacccgctctgcatccgctataggagggtaaacatgcggtacgaaccctaacctatgtaaaaatttgtgtaaacccccgatcaaaaagtcatgtaaattcgttaaccaaatcacacatgttagatatataaggggatgttacaccaccacatagaatttcctattcaaacaaaaaataataaatttcgaactgggactttgtttggtaaatttaaattatccccttttttttatcaaggtttacacgagttttcatctagataggtgagggcttgcgctatatatttacctcgctatattaccatcggccaggacagatggtttctgtataataaccgaacagcgtctctttgtggcgtttttgcactctattccttttatacttgcttacaattatgcatactgtataatgataaaatattgagagaattattagtgtagattacctgcttgaatataacgatacattaaatattataagtagtagtagtagtagaaggttatttttggagtgtggagtaaataatcggtaaacaattttaaaagaccaagactatagggcataatccagcagctcgtacagctcaactacaactactcaccctagctaaggccctgtttaaatccctggcaaaatttttaaccctgtcacatcgaatacttaacacatgcatggagtattaaatataaataaaaaaataactaattacacatattgcgtgtaaattgcgagacaaatcttttaagtgtaattgctccatgatttgacagattaattatacttaataaattcatctcgcagtttacatgcggaatctataatttgttttattattaaactatgtttccatatatcggtatatccgatgcgacatgctaaagtagtttttttatttttttgctaacaaaaattggccgatcagaatttcattaagattgtgagggggttgttacacagattggttacgtttcgtgttaaactgtcgagttgggggattgtttagtggaatttaccctttcctttttcttttccagcaaaataaaagaccaagcaccttgtacatacattttcattaaaccaaggggcgtttacgcaaaaccccccataataataacaaacataacctaatcctccacggtttaccgctaatccggagctgagggcggcgcgcggtgacgcgagccgagcccaagcaaagcaacaaggacacggacacacacacccactcctccatcttcctcttctagaaacacgacgcgcacaggcagacaaagaggagaagaagaaaagcggcaaaagccggaaaagaatctcctaatcggcggaaaataaaaaagagagagtagttcttgcaatcttgcttcgcctgcaaggaatcctctccggctctccgccctggtaagaatccctctctctctctctgcaatcgatgcttgattttggtctgtttttatccaagaaggtcaagcagagctggtcttgctgtgttgtgttggacttggatagatgagatgagcggtttcttgatttctttgcctgggatggggtagggagcgttgtgttcttgggggggaattgggagggttttgggtctaattggtgtcactttcctgatcaccgagtcgtcgtccgcggagaagactgacctggtattcgactgttcattcatcctgtggtctgagatgagacaagtaacttgttttttctttttttttttaaaaaaatctg

SEQ ID NO: 65151 - DNA, 1282 bp, Oryza sativa
tgatgattctttgaaagataagacagactttcctacttcaacaagtaagaccgaagtgaacaatatatctgaaaatggttcgaccaaccagagcactatgctatcagatgaatcgagaacaaaagaagacaagatgaatcatcacgagaacattgctgccaccacaaacaaaaaggcagaaacagatgcgagacctgaaagtccatacagaggtctcattgacactgctgcgccatttgagtcagttagagaggctgtcaccaagttcggaggaattgttgattggaaagcatacagatctcagacactagaggtaatactgatttgtttaaaactgcaaatggatcagatcatggttaaagatgcaactttgttgtgtttcatattaatttccttgccattacagaaatacactttgtttttatgagaaacaatagagcacatattatacttctgctcactgctgttcaatcaataacacggtcaaaaattttcatcatatagactgctgttgttaaggaatttgctttttatgcagaggcgcagggtcatgcagcttgaacttgaaaaggctcaacaagagattccacaattcaaacaagattcagaagcttgtgagatggccaagttacaagtggttgaggagctagggagaactaggagacttgtagaggagctgaaacacaaactggagagagcagagattgatgtggaccaggcaaagcaggattcgaacttgcgcagctgcgggcacaagaaatggagcaggggattgacgatgaagctagcgtaatagcccaaacacaattggcagttgctaaagagagacatcagaaggctgttgatgaactgaagttggtcaaggaggagatgagatcaacacacgaaaagcataccgttttagctagcgaaagggacatagcagccaaaagagccgagcaagctatttctgctgcaaaggagactgagaagagagttgaggaactcactttagaacttatcgcaatcaaagagtctctcgagtcagcccatgccgcgcatcatgaagcagaagaacacaagctcggggcggctttggcaaaagagcaggattgcctggcttgggagaaggaactgcagcaagcacaggaggagttgcagcaactcaacatgcaacttgtatcaaaaactgatgcaaagtccaaaattgatgaaaatacgcacatgctacaaatcctcagtaaggagctggctgcctatacagaaaacaaaatgagtgaagaagctggagtgatcgaggagg

SEQ ID NO: 65152 - DNA, 723 bp, Oryza sativa
tatatgattctatttttagcagtaagtgtaatcctgatgtgcaaaatatggtgctatggagaaacctcataacagtttacttctttgtaatgatgttgtggttttcttcgtaggagatgggatcgacagaacacaaagctgatcaagctgagattgagagattggaagaacatgcatctgctttgagaaaggtactatcttgggaatgttctagcaatataatcaatatcattttgctgtattcagaatttttccctgaaccagttggtaactggtgcttatttagccatgtcaatcccaaatatttcccaaacaacctgttttgaacataatgtgtgtgtgtgtgtgtgtgtgtatatatatatatatatatatatatatatatatatatatgttccttttatgcttcaatcattttaattcaaaaagtcctgagaagagtgtaatccccaatttttacctgaaaccattttagatagccaggatctagtttggcaagctgtgatactgtgttgcttgtagtgttttggatagtcatgttcatctgttgaactcgtcaaaaaagcgttccatcttgatctttcctggcaatattcatgcttgttaagttgttatcttatcattgttttttctgcactggatactgcatgtcattattgtttgcatacttggatttgcctgctagtttagaacttactccctccgtcccaagggctgcaggaa

SEQ ID NO: 65153 - DNA, 1327 bp, Oryza sativa
aattcatggcaaacaagccggcagttcctaaattacaagcaaggccgtactcgctacatgatattcaataaagcatacctaaatcacaagcatctagaatggaacatgcatgtgtgtcagcagcagccaacagtactggaagagattcttgcccagtcatgatcattgagatacaactgaaccgaacagggccacatgaaactattccatagtttcataaattgagtaaaatgtggtctaatatttagtttacttggggtatacttttgcttatcaagtaaaaaaaataacaaacttcgaggaagggcaaggagggtgaattaaaaaaaaacaaaatgttaatctagatttcactcttcttctcacctgattaagcatccattttaagccaacagcagcagtgcattcattcttagaagcactactattccaatccaaattgtacaccttatccagtgtctttgttatagatgaaatgttacttctcctttcttttgaagagaaaatttcaccattggagctaacattcatatggctgttaagaagagtttcaaaccagccacttccagaacgttgtgacgagataatcgcgaagaaccggacaggtgtacacttgcattcactcctaagaaaaaaaaatcatatcaaacattacacaatcaaagtatatagcatagcataaaccactgcagcacaactctcacctgctataagttatcggttgtgggtaatgcacaaagtgaacctctgaatgcaggattgcagacttattgcatagctgttctgcaacctcgatcttcactattctagacaagctatcacttcctagttgcttcatacacatcgtgcatataaatatcccgcagatcatagtcatagcgaaaacaaccattctcaatgcgaggggtgatttcttacaggacttcacaatcaatgcgtcctgcgaagaaggtccaatcaatacaagttaatcagtagaaacaaaacagagctactcagatctataggcacatcacaactaacacttgatttattttagctttctgctccagacctacaagttataatccatagatataatcaagagcgattacataatcatttttcaagcatatgaccttagaagcatctatgttggcatgacagggaaacaaacaggaaagatcagattttgaaaggtaactggtccttcattcataaactgaactaacccaggtgttacctccaaaagagggcaaatggcccatgtacctgcccaacatcatattccttaatcaataatggatcacaagccaaagaatcaaaaatcccctttttctgtgtactg

SEQ ID NO: 65154 - DNA, 1409 bp, Oryza sativa
cagcggctttctttcctctgcgtttcttggattgcagcaaaatcgatcccccccccccccacccccccgtaccatttttggtggtggattgcagttcttgtgccatcgatttgggtgggattcgggcgccgcgtggaaggaaaggtttcttctggggtgcccagttgggctaaatttctgggtagctcccgccattgtcgaagctcttcagttcttttgcgtttcttgggccttgtatcagatccgtgcccttgcgatttcttgtaattggaggtgagagagagagagagagagagaggtcgatccatggaggtgcagggagaggtggatggatcgggggtgcccctggcggtgctcctgaagcgagagctgtgcaaccagaaggtggagaggccggacatgctgttcggcgaggcgagcaagagcaagaaaggggaggacttcacgttcctcttgcccaagtgcagccgccgtccaggtcaagcccaggctgacggggaggatgcaggaggcgccggcgacgacgacaccatctcggtgtttgcggtaatgcctcaatggcctgcgtgctcttttttcttttcccgttattactgtctctgagaccaatagtccagtttgttgttgttgttgttgttgctgcgtgtttgttgcgataatgccattgatttagacctataaactgaaaattcggttggaagtcagtgtttataatgcctaactaggatagttagttatcgcattatcttgttaagctttcttttttttttcctcctgcaaaataaaatgtttggtttttttttcccatcgtcaatctctgtgcctaacatggtgcgtttgtttgttgtttgtcccttgcatagagtagcatgattgatatgtcagcctgattttgcggtgtgtttgcatcaagtcacatgggggacatatgtcagctaatattttacttgccttaactgtctctgtgtcaattatttcggtggtcagaagaccagtggtttaggaatattcaaagggagttttaatgtcaatagatgatagatctttcaggcctccaacagttagcattatatattcggttctactaacttgtctatcaacttaacatggcatttttaaataaatcattgcagtgtaaatggtaatattcaggccacaatgcaatactgtgtgatagtgctgaactatgagtctcactattttgtttcgatttttaaacttgtgtgttataacaactgaagtggccactgatcttgaattatttatcctgtcttctcttcagatcttcgatggccacaatggatctgcggctgccatatacaccagggagaacctcttgaacaatgtgttggctgctattcccccaaatcttacaagtgaggagtggacaactgcattagggctgcagg

SEQ ID NO: 65155 - DNA, 704 bp, Oryza sativa
tgctatgcttgctcaaaggtttgatttcatttgatacatgaagcgcatatttcttagacatatcacttttacttgccattatgcctacctatgagttttacttccgatagtgaaaaggtttcctcttccccttacttgaaatagttacgcacttacacttgcccaaaaaataacttatatagtcaagttcatcagtcttccccaaatttgactatagatttgtcctaattttttgcctcttaagattttccaacgaatgtatatgaatataatttcatgaaatgttgactaaactcttataacttgttcacagattaaaaataaattatccgacaggaaatatgttcaaactgcatgattgtgctgtctgccaattggtgatgaaacctggtgagggcatctctgttcatggtagcattccgaggaattcaagggttgatccttggggtggcccttttctatgttcatcctgccaattgaaaaaggaggctatggaagggaagcaacatttgacaagtatgaatgccttcatctaaagattttttttctctttgcattaggacaataattgttgaatgcttttttatttttaatttccagattctcaaccgacagtccaacctgttctcaagtagccttcaacggtgttcgatacttcagtgaatacatgctaatatcactaagaccctaacaggggtgcagga

SEQ ID NO: 65156 - DNA, 703 bp, Oryza sativa
attcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcactt

SEQ ID NO: 65157 - DNA, 703 bp, Oryza sativa
cccccccccccccccccccgtgcgcgcatggatcaggcgggctgggttctccccctttgtgtggatcccgccgcctctcctcttccctcacacatggtagggagggaacgacaaccgaggtggcatggagagcccaccaaatctgcagatgacaccagtgggagggtggatctggcaggctctccccctcttgtgtggatcatgtcgcctctcctcccctgcacatggattcagtgggccgggccctccccctccacgtggatcctgccacctcttccgccccttcatcgcgcatggatccggcgttgcgcatcgacggcgaggaggagaaacaatgactacggcaacggtggccgggagagcttgctggattttctggcggcagcgacaggaggggcgatgggagacatggagaccgggaatggcatcggcggtggcaatgatgatgatcgttgtcacaccctgaagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaattcactaacaggatttttagtggaattttcagagccctagaattttaaccaattaaaattgagcaagcaatattttaattccgggctgcaggaa

SEQ ID NO: 65158 - DNA, 1076 bp, Oryza sativa
ccaaagttcgatcgatggtagctcgtccatggtcgaacccatccattccagaaggtcggacctgtcagagcaccgtggcaccccgtgcgacgacgcgactgtggtctgtgggcccccaccctctcaaaaccctcacgccactgacatctgggccccaccccctacttttctctcccccctcgctctcccatccacgcgcgcggagtgggacccaccacccaggcgttcgcccttatcgttgcgcgagcccttcttcttcctcctctctctctctctctctctctctctctcgccaaccaatctcctcccccctcctttcctcctcctcccgaaccaccggaatccgacgcggcgccgccgcgccaccccgttccgccggctctcttcctcacctctcctccccaggagatcgtcaatctcctcggtaagcaagcaagcactcgggtggttcgagctgtgccctgcgatcgatccccttgcggagttgcgacgcgaatatggtgtctaagtttgatgttacgttagggtttggttggttcgtttgcggcggtgttggtgcctcgtgtgtgatgtgtgtgtgtgtgtgcgggggttaatttggttcgttcgtggatgggggggctgatctggcatcgtgacggtgtcggtgttaattgttaaacctttttcatttctgttccttaacttttgccgtgatgggggtgatcttggagcgctgcgctggtgtaaatcgggctagattttggaggaacgtcacagtgaaattcgtcaataatcgtgtcgttttcctgtcgaatttttggcgcacggtttgatgctgttggggacctaacctaacctcgtgttcttgatgcgatgcaggtcaggtgtttgatcgattgcctgtgggaagcatatgggcggttagattcgtgaagttgagaggaatcagaagacgggaattgtttgaggggactgaatttgatctggaaaatggggtggtttcgggctgcgtccggattggctcgggtggcgctgaggaggaacctggcgcgtgctccggcgaacccttttgccggtcctgcgccacggtactt

SEQ ID NO: 65159 - DNA, 711 bp, Oryza sativa
tgttgttacataatctgatgtattcaagaatcttaacagttccctgtcagagtttgctgttttgggctttgaattgggctattccatggagaatccaaactcactggttttatgggaagcccagtttggtgatttttccaatggagctcaagtgatatttgatcagtttctgagtagtggagaggcaaaatggctccgccagaccggtcttgtcgtttgccttcctcacggatatgatggtcaggggcctgaacattccagtgcaaggttggagcgtttccttcaggtaccatttttctgtttctgactgcagaaatgtcgtcactagtatcttgtgttagtattagttgcattatcttatcatctgttgacataaaaggaacacaacataacagcactgcttttcacagtgttgctttctcataaactgtgttggcattgccatagttctacagttcatatattttgtataatatatgctgatgccatgtggtgatacaaagttgcggacttttaacacttcactgaaattcagcattttttttgtttttgtttgtttattagttttccttttgtcataacttgatgactgcgcatagaaatattccgcactgtgactaaccatattatattgtactaactctacttttgacttggaaactgcaccacatcatccatttgtacatcatttattctgcagggctgcaggaa

SEQ ID NO: 65160 - DNA, 5873 bp, Oryza sativa
ggaaaaagtacaccgaaggtccttcaacttgttagtcagatacaaaatcgtcccccaaccgtaaaaccggacatccggcgtccctcaacttacaaaaccagtcacaatagatccctcggcggttgtgatcccggttttgtcccacgtggtggctgactcagcgtgggacccagatgtcaggatgccacgtcatccctcccttcctcctctctctccctctctcacttctctcctcatgggcaggtcatgccgtgacgcgcgtcgagtgccgcggccaccaccactgtgacctgtggcagcgaggggcaggcgcagcggagcgggacggtgaggttgtcgccggcaacgaagccgatggctggtgctgctgctcgtcgtcgtcttcttcgtccacaacttaccggagcacgccaggttcgacggggtgcccgcgagcaccattgccatgagctcaaccgcaaggtgctcgagcttgccccgtgcaccgttggcgccagcttccagctgccgaccaagatatcaacaagcgaagagacgacggcggcgaggaaccgccaaggcgaccagaaggtggggacccagatcgccgccgtcttcctcggctgccccgacgaccgggagtcggtggcgttcgcatgccacctcgccaagaacgacggcgccatcaggctgaccgtcatccgccttgtgctattggcgtcgtcacgcacgacggcatcgccaacgctgcatgcatagttagctaaggctttgtgctatgctagtacgtgcatgtgttgcatgagctagtggagcaagtctatcggttggttagcttaatttgtgcatgcatgcagctggtagtggatcgactggagcatgcatgtgtggcacgacctctgctgccagctccaagccaaggagaatctcgccgtcgcaagcaagtgtagaaactcacaccatcacccctccaagcacagacgaaactcactgccgaaactcgccgggcacctcctccagctcatgcacgcggctgggcggcggccggagatcgaactcatcgccatcgtcatcgcgaggcggcggtgaaggcgtggctctccttgttcgcggctgcgcaagttggccagggagccgtcgcacgtgtggctccagctccgccaccgcggtctcccgcagctccgcccagccaaacggcagccacatcggcggcgccgtcatcttcgatctccccttcctctgccgcctctcccggaccggctactggcagtgggagaactgttgagaatataggcatataatgatttaatatattccataaataaatcatgacattacagatgtatactagcattaacgcatcattagatctacacatgtaaactaagcagtaaaacatgaacatatcaaatatgcgcaacatgtcgaacacgtaccgaggtggcggaaagaccggttgctcggcaggaactactcgcggttgcgagcgtcgacgaaggcgcgcagcacgcgagcggagaggaaggcgagctgttgcggacaaacaggaagcagtcgcgcgaagcgctttccaaaaaccttattgctgccttctcccggtgcaggacgtcgaaggcagaggttccggcgacctgctctcccgatcgccggtgcacgctggcgagcgagatggagtagtctacgagtgacggcgcaacacagaggaggaggcaaaccctagattgatttcgcgtgtgttgcgtgaaggcggtggcacggtttatatagagataggtcgcttgatcagggcgcccgcacgatctccactctgcgtaaccgagccggataagtcgcgcgtaacttatccggactccacgccgttttcacgcaccggattttttggaatgtttccaacaacaaaacaaatccgaattttcctgcagcaaaacaaaactgcaaaagaaggctgcatctgcacaagggtgaggagccaattttgcggaccattcgacgcgtacgtcatgcacgtgcgccgcctgccctgccttgcagggccgagctgggcctgccctgcgagatgagcgagcgcgcgcgtgttccccctcttctctccaccacacatgcttcaagtggctaggagggcatcctcccttttaaggaggtccccctcttctagaataagtaaggtggtactaacatccacatgcatgccatcccatgaggtgggcttttgtgattttccaaagaattaatcttcgaatgggccttagcccatctattaattccaacaagaaccaccaccgccggccgaagctagccaagggcaccagcggtggccgcctcgccatctccatcagcagctacggcgacagctagatctccactccgccgtcggccgcgtcgaccctcttccctaccgcgccgatggagctgccgccgctgcattggccctcggatctcctctcagtcgcgctcctccttcgccagccgccggccgcgccggtgtcgccgcctcaccccgacgacgaccgccgcgctcctccccgtgcgacggcagccatcggcggcgccgcccgtcccatcggccctcctctccgcgccgctccttccccgtcagccgccggccacaccagccctcctccacgcgacgctgccgtcatccacgcccagaggaaagaggaagagagagaagaggggaaaaagagaaagggtgatgacgtggtctatctgacatgtggggcccacatgggtcccatgctgagtcagccgtcacgtgggataaaaccggggtcaaaaccgccaatggaccttttctgaccggttttgtaagttgggggacgccggatgtccggttttacggttgggggacgattttgtatctggctaacaagtcgagggaccttcagtgtactttttccaccagattgatgcactggtactatagctactacttgaaggcccaacgcacaaatacatttgggtctaaataggtttcaaattcgattcatgggccaattttatagtctggaatgtcagccttacacggttgttgttgcacgtacaggtctaacactacagatgtttatttatatgttgtgtgatgactaaattctgttgggtcgttaagttttatgcttgtaaatgactaaaaaggtatctcttcgtcatttgcactgtcatagaacggggaattttgctactgaaaagcatgtcatgtccaaatcttggaactgaattaagcaggaattttttttttcagaaatgccccaccaacccgcataaaggatatactaccttttttgcgcacagcgagttttgtaaggagctatagtaatagaccttttatcatgcggtattatcaattgatcactaattaatatacacaataatacagtcatggattggttgttagacagaatgatgacgagctaaaagtattgtaaaaaatgtttagtaatgtatgaccacattccttcactgtttctgccaaagagagtagaaagttcagttatatcgttgagctaatttctcaaccacctacttatgttttaggatcccagcactgtacaaataatttgagatcgcagtactatattccctcagtcgtaaaattaacataaagaattttagttggatgagacacattctaatatcacgaatctgaacaaagatcatatccagatttatatatgtctcatccaaccaaaatctctcgaagcaaaagagcacattgcttgtgttgctgtcaaaatcctccagctgcctcatgggctcatggcggtcctcaggaaaaaaataataatttgaagaaataaaatgatattgtgtccctataacttcttaaatttgtagttggcttgctagctaaacaagtatagatcgaacgaaccgaaacatgcgagaaaactaaccaaatgaacaaactgaactactactctattttttaatatatgactttgttagcttttgacaattaaacgtttgatcagctatcttattcaatcttttctaaatataagaaaaatttaagtcatgcataaaaagaacttttgatgatatatcaagtcataataaaataaatgataattataattttttcgaacaatatgaataatcaaacatatttttcaaaagtccacactgttatatatatcaaaagacgaatagtttcgttaggctaaccacaatcagagccacgctatgtcatgcctcaatcaaccatttcagtctaggaacctgtcaatccattcatgccatagtgcagcatgaccttgaattagaccttggcagcacagggcccatcatttactgtcctgacagcaccaggaaagcgtaacttcatcaggctgtgtttagttcacactgaagtttggaagtttgattgaaattggtacgatgtgatagaaaaattgtgtatgaaaggtttgatgtgatggaaaattgaaaaattgaaaaaaaaactttggaactaaacaggacatgagatccacggctcttcacaggggaccaagttatgcagatgtgggtacgaatctttgagctggcgtatcgaagtaactcgtcacatattcgcactgtgaaggcccttcattaaggacacatttcaaactgattgaagaaaaaatgcattcattctcattcatttttgttcttttggggggaaaaggacacatttcagggactaattaaattaaagttagataaactgaaaccaactactagctggtaattaattaaatcaaagtacttatagttactacaagcagcctcctgccaaccccatttttgttggtgaaggcgtggccggcgccgggactgtgcccgggcgccgtcggccgggcgtcctcgacgatcccgacaccgccgccgccgccgccgccgctctcggcggcgtcgggcgagagcgtgccctgggtcatcgccgtcgtcgtccccttgccgccgccggcggcagcttcttcgacgtcgccgccggaacgcggtgccgacgacgacgacgatagcaggtgtctctgctgctgcgccgccgccgccgccgccgcctccgcaatgagaggtcttccctgtgagcacacgatgatcatgtcggaggaaaggaagaagatgatcccaaggacgaagatgagattcagcttagaggaggacatttttttggcaaggttagctagtattagctctgaagcaaatcacagtgcaagttaagctaagctagctagtgatgagcttaatgaggagtgttatactagctagctagtgtggggattgctatgaggtaatcacacccactaatcctttgctatttatagcatatgttgtgcataactaggatatatttaatggagttaagataagcttagattgggagcatgtacggagaaggaatctttgtgcataattaaatagggctgcatatgcattagcttagctatgccgaggaaagctgctagtactatacggcttatagctaaagtcgaacacaaactctcctttttttgcatgctgcatggtaggtatttatggaactggccacaagtgttcatcagcaatgcactaaccgcgcaccatgcatgtggcaccgttacgttgcaaaatctagctagtgttatactgtacttatatagaacttgatgtatatttttgccaagtgttcaaaaagtaaataaagtaaataagagagaatgaactaatggattctagtatactaccccctccgtttctaaatatttgacgcggttgacttatttttaaatatgtttgaccgttcgtcttattcaaaaagtttaattaattattaatttttttatcatttgattcattgttaaatatacttatatgtatacatatagttttacatatttcacaaaattttttgaataaaacaaacagtcaaacatatgctgaagagttaatgggtg

SEQ ID NO: 65161 - DNA, 713 bp, Oryza sativa
aacgcgtggtgcaggtcctccgcatcttattaccctcctctacgacttaattgaagcattatccttctcaacgacttaattgtatcagcaagcaaagctaatgcacacacaaaaaaaaaagctacccgattggatacgactgacaattcagcaaaagattcggtctttatccgataactcgtctatcattctgatattaaaatgatagaattaatcaaagcgaccgccaagtagattaagcacagcaaaacggaattgctattatacaatcacatctcaaaaagtgtgccgatgctataatatccattgtgaacgcacaatgcgtgcacgaatgcacaaaacagaataatttctggagaaggtgtggagacagcacgttgaaattatgatgacacttcgacagtaagtactcaaaaactccacgcacaagagcaaaataatcacaatcatccaaagatcaaagggattaaataaaaggcgagctagctagtagcaaacagtgctgggtaacagcagcaaggatttatgacaaataaaaccaccatatggtctttcaccaaacgtgacttctatgcaatgtagctctggataattatgagggacaaacattacgcaccggcactcaattcccaacgaattctttcatgctcttcaaccaaaccagatactccttctcatccttgctcatcatgtactcgcacagccagtcatgc

SEQ ID NO: 65162 - DNA, 950 bp, Oryza sativa
aaatgatcttttgggatgttctggagtatagatggcagaccatattggtaatgaagcacattgctggcatcatgcatcatagtgtacttgagcatctccgcgaagatctccgcatcgatttttgtcagtgatattgtttctgacaacttaattagtgtgagacaccaaccatgttgcctagaatgcttgccaaattgaattgttcagcactcggtagtatatgctacatacttttacgtatggctctttaggggcattcagtacctctgtttggaactttgttcaatcactgcaacagaaactgcagttacttacatatcatttatgcaattttcattcagatgtttacttcaggaaaagtggtctggaacgctcagctagaattacaaaagatttggagtggtttggagggcaaggaattgcagtaccagagccaagtactgctggatcaacatatgcaacttatctgactgaacttgctgagagcaatgccccagccttcctttcccactattacaatatttattttgcacatacaactggaggggtggctataggtaacaaggtaatgctattcccatattggatttaagtccccattaagttgtgtaatgaactgttgatatatatactcatgtttcatacctaacctgattaaatatccattatatgtctattaaactataaacaaaatataaaccagcagatttaaatgaaatactgagttcaacgctactttcttatcagatgagatgatacattgtgatttcattgtttcatgtctcaacatgtttctcattaaatggattggcagcacggagctttttgtatggagttgacaaaagagtgtaaagctgaatatctagactgatacatttctattctgggtatcagatattcatatataaagttcctctgttagctggtgatacagggctatttaaacattt

SEQ ID NO: 65163 - DNA, 726 bp, Oryza sativa
tcctgcagcccagactgtgccttttcattaaataaagcgggagaaaaatacagcccctatgggcaagaaaagggaaaaaaaaactctgtacactatacagtgtgaggcgaaaagtcacgtaagcgctttgctcctgtcattgcccatgtttgcgcctcttcatttattttggcaaaaaggaaagacgtcgtggcctcatcatgcttgaagattcgttggttactctccttcaaatctccaaaacaacaaggaagatgagagtgcgcagtccatttctgtaactcccgctgtgtttgctagagattcccaccagtctgggtcgcctcccattctctagggtcaagctgttggtaagccacccagacagctagcatgctccatattctttttgtgtatctacaactgacaacaagatgtagagccgtttcgccttctctacggcagaggggacaaagcctattattttgccatcctctaattgcgagccagtcgaaggtccaaaccctgttttggatgacaagccatgcgcggaatttacatttccccggtgccaaactttccaaatgagcgagtgaaaaatcgtttttgcgccccaaggcactatgctgacgacgccgagtattagccaaaatttattaattttgtttctacttattgaatttgaatttgtatgttggtgaatgccatatctcatattgatttatcatgtgattttttaacaatttt

SEQ ID NO: 65164 - DNA, 711 bp, Oryza sativa
attcctgcagcccgggtgcttagggttcttctggtttagcggtgtagactgtagaggggagagagaccctcacctcggtagtcgacgccggagttgagcttgacgacgacggggcgtcccctgatcgacttgaggaagtccgagggcgtcttcaccgcccctccgccgccgccgccggacttgtccgcgccgccgccggtgctcatctctctcgctgtcgccgcgtgcgtgtagagttggggttgggtgagaaagagagagggacgccgcaaggagggaggggtttgctttggttaggttttgttgctttgggcctctccttgcctttcagtgatgggccgggccttgggggctgggtttctcgctcgtttgctcccttcatctgatcctgaccgtttgcttgcgcccgatccaacggttgagatgtgctcctattataaagactttcaccgtgatatattatacatgctccctccgtacttgtaaaggaagttgtttaggacaatgtttaagtcaaaccttgggaatataaatcatgataactctcaagttgttgagtttgaaaatataaattttatataaatagatttgtcttgaaaaatactttcataaaagtacacatatatcacttttcaataaatatttttatagaaacaagaagttaaagttgtgtcttggagatcgtgtcgctatccaaaacgacttctttta

SEQ ID NO: 65165 - DNA, 1794 bp, Oryza sativa
ttcctgcagccctcctagattcgttttttagggacggaggtagtaagtcagttagctcagagcgggtacaatagcagactataagccagctataaacacatttcgagaagataaaataggagagagaagagcagcgggctacagattcgtagccagctgcagtataggctccaagatacatgtatgtatgataggtgggatcaactataaattgtgtagtatatatttataggtaactattgtatgaatcggctattaaattgactataaatgatttggagccggtagttggctataatattaaacttgctctcacaccttatggtgctagctgaagaccccaggttcgagcaatctataggtagatttttgcaacaatttcatcaaatcagagacaaactcacacgtttcaaggccactacttcaaatttaaacagacaagccattcgtttcaataattctctatggccccagcccccaggcctctgctgccattgccattgctattgggagcagagccaatcccacatggcggggaccaatcatcaagcgagagaccatctcatctcctctcttgtgtgggagcctcctgcgacaaatgctcagctgcagctctggagaaacaagctgaatcggcagcaagaaacaattactgctagcattttggattttggcagatacacagataacattagatggatatacctggctcactcactcgtgacttgagttccaacaaccacaacacgggtatatatcaataccattcacccccgtgatgatgatgtattgatatatgcgtcgtacatttaaacgcatatacacacagtacttgtacatcaatttccagtccagcagaaactccaccaggggttggtacaggcaaaagcaaaatattgattgcaaggataatgtaagatggtagtagtagtagtagctaggattggtacaagcaaagcgaattcattgcaaggataaatggataatgtggtgaggtacaagaggagacgaagctttggcaggcatggggggatcctggctggctagcatggtgttctgctgctaagtgaattgtgtcaggctggcatcattgcgattgaacgcgtgagatcctgatcgacagcagcaagcatcttcaactttgcacagttcgaagttgctgaaagcaagagctcactccaacgagcagctccaccatgcaagccagaaaagaggctattgttgtggcctggtgttttcaatctccaggatagtgctcgctgatcagcttcagtctcacaccagaagatccttctgtaccagacttcaacatagttaagacgtgtagtcttcgacaaaaatgactgcactaagcctcaagtttaatatatctctagctttcctgtcttcaggaatagattataggttgatttgatcagttgctcatctatgaggaactataagatgattaagcgaacaatccgccccaaatgctggaaacattttgcagcttctttcaagcacaagttcctgtccttccgagaccaatgctggacagcatgacagatagactaatcaggttacataagcatataacttctgtggcaaattccagtttcgagcttacaagaaaataaaagaaagtgatcttgaggcggttaccttgctaagttcgttaagcttctccctggtatcttttagcaaaagttctacatcagaatcccatttgtaaaactctagctcccttccttccaaaattttcttggatatctgttacgtttcaaactaatacttcttcagagagcaattaaataa

SEQ ID NO: 65166 - DNA, 3135 bp, Oryza sativa
aatccatacaattttcatttcacgccacgacttcacaccatgcatcaagttccatcaaaataatcacaaccttaaatttcaaccttgcatattgccaaaataattgcaaccttcgccgcatacccaagtgagcactaaaaatggaattcctaccacctagcttgtatcccccaaacatgttcttaccgacacattttaccatcctaccaacaagtcaatatgtcatattctaaatctataattcctgaaaaattaggagattccaattgcattggaaactgaagactaagctgattaaggaacaacattgaattaggatattctaattgcattgggaaggcggggatttggagagtaggaatcgcaactcacaggcgacgtcggtggactcggctacgatccgctcgacggtgtcgaagacgagcttgctgtccaccaggtacttgacgaacccctccatgctcggcatccactccccctccaaccccgctccctcctcctcctcctcaaccacgtcgtcgtcgtcctcctcctcctcctcctcctctgacgccgacgcatcctcactgacgccatcgcccacctcctcctcggcccccgtatcgtccatcttgagggtggtccgcttggggttccggaggcgcatggcgacgaaccgcatctcctcggcgacgcccaccgcctcgccggggtactgcctcgggtaccgccgcggccgcggcttcgctggcggcgcctcatccaccgccaccgcctccgcctccgcctccgccgcgggggcaggaggggagggagcgcagcgggccaccgttagggctgctaggtccctcgttagtattagtccagtaaaggagcgcaagggccgcgctctccgcggcggcggaggaggcggccgcggcggcacgaccgccgaggcggcgacggcggcggcgagcggcatcggggggtttaacgggttatccactcgggcatcctgcacggcactgtgttgtgttagctgcgaaagcggattatcggttttccgccttcgcgtgacgtttacgtatgtcgactgttgcactacttctggtacgcgaaagcgtaacgggttctacgcgttccagggggaatgcagattggggaatccaagagatatgatgggccaatatgttttgggcttggccatttttagttttcctttctcaagaggaataagttcatttcgtctcccacaactatagtgctaaccgcaatatcttgcgactagtaataatattttgcctcctccaactagtaatacctgttcaatttatcttggaattccaagtagttttgatagcggtttttatcctacacggtattacatcaacccaaaaaagtgtaaaaaaatgcagcgtgtcccatatcacaatcgacacactggctttcttcttcccctttaccgcgcctaaggctgtgtttgcaaccccttgtttccaacccttctccctcgttttccgcacgcacgcttttcaaactgtaacagtgtgttttttgcaaaaaaaattttatatgaaagttgcttaaaaaacaaattgatctatttttttaaaaaaattagctaatacttaattaatcacgcgctaatggaccgttccgttttccgtgcgtaggtgataggttcccaacacccaccaccgaacacacccttatttgtctccatagccagtattacatatgctgatacgtgtggaggcgagctcaagcttgcttggaaaagctccctccgccggcttgccgaccaccgccccatcctcctaattgaaggaggttgtatgtttgctttaagtttgggggatgaaatgtagacttgcccctatagttgagggaggcaaatggacttttccctctcaaaaaagatataatggttttaatacgctctgtcccaaagtcccgatttgaagcccatgtatatattaaagatcaaacaacgattgcctgtttggcacatagcattctagagctggagctcaactaaacaatttcaactcaacctaaaagggagatgaaatgggttggagtgatgtgaaaaaataaactagagtggtgcacaagagttcggaccgctccgtagctctactgactccactcgtggagttatttaggagttgaaatcctgccaaacaaatcccatatagtctagtaaaacatattgaaaggaaacattttttaagctatctcaggctttacaggattgaatgattttcacgagaatttggaagcttcggatcctttggaaactttttctaactaggctttttggaacatataggaatataggttcataacttttcttttagaatgctttcctatgtagtaccaattccggaggaaatttgtatatcagcctcaaatctagttttttgtttttccttgtgtatctttttctcgcttctttaagcaattacaagttccaatgtgtaataagtcatttgacttttttttcctagtcaagcttctttaaatttaatcaagtttatagaaaaatatagtagcattttcaataaaaaacatattatcaaaatatattcaattttagatttagtgaactaatttgataatttagatgttaccattttttctacaaacttgattaaatttaatgaaatttaactagcagaaaagtcaaacgacttataatattaaacataggaataataacagttgtgtcaatgggacatcatcacatgtataattttggatgcttgtacacattatttgattgagagacacaaacggcagtttgctatagtctgcaatgctgccaaagttatacaagatcctagatgatgggcaaatcaacactataatcagatagattccaatgaatgtgcaaacagtgattatattactttattagtctatttaattatatattgttttttggtttgtattcctctttgccctctcaaagtggtctatatatacttacatagcatgcaaaatagaaatatttgcctgtgcacagcactttacgtgcgtattttatagcacaaaatgatttgtgattgtcgcctttttacaatgtcatgtactcccttcgtcccataatataagggattttgacattttgcttgcactgtttgaccactcgtcttatttaaaaaatttgtgcaa

SEQ ID NO: 65167 - DNA, 803 bp, Oryza sativa
cgaagttttaagtttcttgaaacgaaggagaaaacgatgaacttaactacaaggcagcggcgaatgcaggcagaaatgacaacaaaggataaagtttgcaaggattcgtccttgaagctagcaaggaaaggtgggtggaacactggaactgaagcaaaaaacagtggagaaaaaaaatgagaaaaataaaaaggaaaaagaaaatctcaccttgttgccgaactggtagcaccaccaatcctcgccgccgccgccgccgccggcgggcttctcctccgccttggaaccccccatctcctccggcaggaaacgtagctccccgccttgaacacgccaccgcccacgccccaaccacccgcacaaaagactcgctctccctctccctctctccgccgacgccgacgcggccgcctcttcacgggcgcattaactccggaaacccccgccgccgccgccgcgcgcgcgggggaggaggaggaggagggcaccgcactctccgctgcagcagcgtcggctctagcgccggtggcggcggaggaggcaaggcgaggcggcggcgggcggcgcggcgcggcgcgagggcgaatgggcgatgagctgtctctcgctttggagactgggcgagttttggaggctttagctcctcggctcggctcaggctcgggatcgggatcggctcggctcgcgtacggtggagagaagtactagtaggagtggaactgactactgctgctgacttcgctttaaaagagttctctagtccgttttgtgcattcgggtccttgtgcaaatagcattttcta

SEQ ID NO: 65168 - DNA, 1161 bp, Oryza sativa
cgctagctctacaacttattattaagatgttttgtcaattttactcgtacatggagtccttatatgccatggagtcctttctcatggttcatgaatatcatgatgcctcttcccctctcgatctctataaaacccgtatgggcatgagagaaaggtgtgttatctaagcagccgatcaatgataaaaaaaataattattgttcaggaaaaaatattattttaacttgtccgggtgtataattaattagaaataagttttaattttgacttaaaaaacttgaggcagatactccctttctttaaagagaaaaaaggaatagaggttggtagtacgcgtaaggggaaaggaaaactcaactctgacgcatccgtcctagttaattaaaccagagaaattccacatcaattgggatattttgtgtgaactggatgaatataattaacaagttggtcggcaacaaagagctggtggtaatgtcatggtctcatggagtagctagcagaaagtgcatgccagaaagctgagaagaatattaccctagtagctgatcaaagatgaaaaattcagatgatgtgtttcactgatatcatttgacatcaattcgatgtgtgcgctgctgctttttctccacgactttgcgttattctcaagtagatcccatacactcacatagcaaaagtgcgatgatgcgtttcgttataaactagtatatataacgaaactaaaagggtataggataatggaagcgtgcacaaagcagtataggagctttagagtatttaacctcgacaaccactaagacgacaaccactaagaccctgtttagctcccataacaaaaattttcacactgtgacatcgaatgtttggacacatacatatagtattaaatgtaggaaaaaaacaattacatgtaaattgcgagacaaatcttttttaagcttaattgcgccatgatttaacaatgtggtgctacactaaatatttactaataacagattaattaggattaataaattcgtctcgcagtttcctgacggaatctatagcttgttttgttattagacgatgtttaatactttaaatatgtatccgtatatccgatgtaatacccaagcccaaaatttttttccagctaaacaaggcccaaggggctgcagg

SEQ ID NO: 65169 - DNA, 1625 bp, Oryza sativa
gctgtgtcttgggtgtacagttgtacacctctgatcagagtaaaactattcgaatagccgtgcccgcgattatgggcggtcaaccagattcaccgtgattagtctcaccctagtttagtctaatgaaattggatagtataggtggagggttgggcctgttgcaacgtgggatagcgttggacagcggatgatcaatattaattaattattgcaactgtttaattctttcaacttctgtttataaatgctcgctttatgcaaatgaaccactctagctctcctttgataattccctgcatcatacccctattccggtatgacttgctgagtacagtgggtagtactatgtcttgctctatttttccccaaccccagagtgcgagtatgtgtccgatggcgggttctccgaggagtagacttcgtccgtgccgtcgagggtgcctgtggagtggtgttcccgctgcagttcaagtccaggcttagccccagttatcttttgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacagtcgtcggatagggagcatgacaacaatgaatcctgacagaggcggatctagaaaattggtccgttggtgtcacaacgtgtctatcggtgtcatagtatgctaattatgcttagagcataatgttatagtatatgaataagctgttttgttataggttttgtcgaaagtcgtcggtgtcggctgacaccgacgattatactgtagatccgcccctgaaccctgagcatgggagcagcagtgggatctacctagggttttggaattttatttgtgctttttgctgattaatttctttcctaaagcatacggcataattctcgcgtgaaaatccctttttgtgcacggttgtgctgttcatctgcgaaagtttctatttttattgacatctaggggtaatcggttgctttctccgtttgcaaaaatacattttagtcgctttgaaaaatcgactctgtgctagtgtgaccaccttgactaacctgaacctcttaattacttataaaactgtagtgatttgtaagcaattccgtttgaacaaatcatcgtactattttaaacaggtatgtcacacgcatagggatgaaaacggtcgaaaaaatcttatactattttttatttccaacaccggaacaaatcttatgatcggtgcaaaccggaaaaaaaacgttagaaatttccgaactgttttcacccctaagcacgcataccacgcgcggttccatgtccccacgtgttgacggcgaaccggcatttccacgtagtcactgcaggcgggacccctctttacgaattacgatcaatgatctgtgcacaggaagcccaacaacctcccggatcacgatctctcactgacaatggggtccaggatgaagtgtgacccacatatactagtacacatggccacgtcagctccattcccgtcgcgtcactgcctctcgcgactgcatttaaattcaccaaaccagtgatgag

SEQ ID NO: 65170 - DNA, 1387 bp, Oryza sativa
ctcgccatggtccgcgtcgaggacctgccggtgaaggtgatggtgctgaacaaccagcacctgggcatggtggtgcagtgggaggacaggttctacgacgccaacagggcgcacacctacctcggcaacccggcggcgaacggcggcggcgaggtgtacccggacttcgtgacgatcgccggaggcttcggcatcccggcggcccgcgtgacgaggaagggcgaggtccgcgccgccgtcgaggagatgatggcggcgccggggccgtacctgctggacgtcgtcgtgcctcaccaggagcacgtgctgccgatgatccccagcaatggcgctttcaaggacattatcgtcgacggtgatggccggagttcgtattagttctgaacttcaatatatgggactatccgtacatttatcgtctaaaaatgtgttatctataaatatagtaccatagtaatgtaattacattgtaactatatataattgttctataactttcgttagttttgaaccactccttttctcaatggactaagcagtgttgtgctgattgtggcatccaagaggcaaagctcaaataaattcatgtggtgtatgatgttgccgtcggaatgttctctgctctcgttgctaaaaacttagagtaaacatttgaaatcttttcatatatctactagtaatgttcccgtgctaacgctacggtctcacttgaatggcttgctaccaaaaccagaaattgataagcagtaatataggtgatatagcaggaaaagataccatgtcaaaatgcatataaatattattacaaatttggtcattgacataatactacatttcatcagagttactggtgaaaaataatgtctcgcggttataaagacaaggcaacaaagataataaatggatgaattcgtatcattgaaaataaacccttgttttgccgcccaagtcgttgaagatggtaattgatggctttgttgcattatttaacctccctttctatgatcaagtcttaagcaatcatcataaatatggaaggcacgtggattaaaatctgggtaaacaatttgaaaggattaaaaaaatgaaatggcgattaagacttgagtcctagtaaaaagcaaccaagagattcgtctgctggacattctgtagaatatatctttcaacattaagctggcacctataaaaatgacaataccaaaaaatgtagtagcagaccacttagtttgtttcatgtagaagtagtgatgtcattagactagatataagacacctaatatatatacctgtattaaaaagtgaactccaaatcaattgtcttgtgtttgtgagctgaatcaagaagctcatggaatagcaataagtggaatagtcacacgggggg

SEQ ID NO: 65171 - DNA, 4846 bp, Oryza sativa
  unsure (1)..(4846): unsure at all n locations
ttgagtcagggttcataccaagctataattgttggacatcccacggagagcaaggtgttgaaatggaagaagatgaagtggaagacgacaatattccggactttgctcagtacttggatttgaaggaaatcaaacgggcgaggaggaaagggatgctgatggtaactacgttgcggatgatcttggtcagatattgcaggacgccaaggaggactgcgaaagtgaaaagggggcccataaattggacaagatgttagaggaccacagaacttcgttgtacccaggttgcgagcaggggcacaaaaagttagataccactctggagttcttgcagtgggaggcaaaaaatggggttagtgacaaggcatttggcgatttattgaaactcgtcaagaacattcttccggagggaaacaaattgcccgagacaacgtacgaggctaagaagatagtctgcccgctaggactggaagttcagaagattcacgcatgtccgaatgattgtatcttatatcgcggtgaggagtatgagaacctagaagcatgccctgtttgcaaagcactacgatacaagattatacgagacgatccaggagaagttgacgggcagctaacaaagaagagaattcctgctaaggtgatgtggtatttccctataataccacggctaaggcatttgttcaggaacaaggggaatgctagaatgatgcgatggcacgctgaagagcgtcaacaggacgggatgctgaaacaccccgccgatggttcgcagtggtgaaacatcgacagaaaatttaaagaatttggaaaggacgcacgaaacatacggtttggtttgagtacggatggtatgaatccttttggagagatgagcagcggccatagcacttggcccgttacaatgtgtatctacaacctcccctctggctatgcatgaagaggaagtacataatgatgccgattattattcaaggccccaagcaacttggtaacgacatcgatgtgtacctaagaccactggtcgaagatcttaaactgttgtggaagaaggaaggtgtctccgtgtgggacgaggacaaacaggaggagtttaacctacgagtactgctgttcataaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgtagcaaaccacccggtacggaagaaaggcaagcacttcgaacataaggctgaccaccgtacgaagcctaaacatcgcagcgggaaaacagtgtttgctatggttaaagatcttaaagtagtgttcggaaaggggcctggaagccagcctatagagagcaaagatggtcacgcggcgatgtggaaaaagaactctatattttgggagttaccctattgggaattcttggacgtacgcaacgcaatcgacgtgatgcacctcactaagaacctttgcgtaaaccttcttggcttcctaggtgtatacggaaagtcgaaagatacactggaaacacgtaatgatctgaagcatatggaacaacgcggcgaccttcacccggaaccaaaggagaaaggaagccattacttgagtccagccagttacactcttagcaaggcagagaaggaaagtatgtttgaatgcttggagagtataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgtagaaggtcatcgatccggatagattagaagcccttcagaatgatgtggtgcaatgtttcgtcagttttgagttgatatttccaccttcatttttcaatataatgacacatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattccgtaaagcccatttcatggttctgcaacaatcttcattggtagctccttacatcgaggagcacttggctctagttcgcgccaggaacatcggtaagtccgatgcatggattacacgacatcacattgatactttccccgcgtggctacgacaacatcttatgggtaacaagtcgatcaaccaacaacttaccttcctggcgaggggatcgtctgggtcgatcgcaacattccagggatatgagatcaatgggtacacattctacacgagagcccaagacatgaagagcacgaaccaaaacagcgctgttcgtgtcgatgccatgggacacgatggaacaactggcacgtattacggtgccatcgaggacatatgggaacttgactatggtcctctcaaggtccctctgttccggtgccaatggtttaggttgactggtggaggcgtaatgattggtgacagtgggatgacaacggttgaccttaacaaggttggatactcggacgaaccttttgtcattgccaatgatgtaacgcaagtctttttcgtgaaggacatatctagcaaaggaaagaagagcagagggcctgacgagcctaagcgtcacgtggttctcccaggcaaaagaaaaatcgtcggagttgaggacaagactgacgaggattacgatcagttggatgggcaacccactttcacggtgacgattgaccctagcatcctcctatcaaatgaagacaccccttactcacgtagcgatcacaaggagggaacaatagtgaggagaaagtacgtgcggtcaaccgtcaccgcgatctattgctgtaattattatgtacacgatgtaaactattttggatgtattgattatccatgtaaatcaattgatgtatggatatgttacttacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgctaattatatatgactatttgaatttttaaaatttttaaatcatgcatgtggcatttacatatgttaattagagtttttaacaattaatttaatataattcctatgctaagtatatatgatgattacaatttttattaattttaaatcatgccgtatgtatttgagttttaatataagattgttaaaacataaatgtctcatgacttagcagatgtttcctgtatgaacagatggctgatcgcgatgaggaacagatattgtacgatacaatcgcggagggaagcagccagtactggaacgaagaagaggggaacgaggatccaaaccagtatttgaacgaggaagggaacgtggagagggatgcggaggggaaccaggaggggcacgtggaaagggatgtggaggggaaccaggaggaggaggctagtggaagtcaaccctccgttggacagaagagggcacgcgggcaacgaggtgccgcgaagaagcttgagggtcggcacatcataacggaagtggaagaagatggacgacctagtgccccggcagaagccgccaagaactatgtacgtcacagcggttgggttgtgtgggataacgtgcctgtcagtacggtgtactagcgaagaacaagggcacgcggagatcatgagagctttgtcccagatttggagaaagagatgctgtggaccacaatgctcgagacattcacccttcccgcgggtacagaggacaaagtgaaaaggtggactctgaagaaaatggcagaacagtttcagaacttcaagggagatctgtaccagatatatatcctgaaggggcagacaccgaacttcgacacattcccaaaactaagggatcaatgggacgagttcgttgcatataagacaggtgaacaagggcaggcgatgatggaaagaaacaaagaaaatgctgccaagaagaagtaccatcaccacttggggtcaggcggctatagcgtcgtgatgccgaagtgggaggagatggatgctagcttgcttgagagtggtatcgaaccggccaccgctaattggccggaacgatcgaagttctggtactatgctcacggtggaacgctcaacccagctgatggctcactggacttcggcgatcagatacgagatgctgcgcgtcgactaacagacgcagtggaagcctcttctcagggcacgttccgaccagacagagagagggacgagctgtcactcgccctgcagactccagagcatccaggacgaacacgagggaaaggggtgattccttggaagattgggttcaaggaggacatgcacatgtacaggagtcggatgaggagcaagagagataccgagtcgaagattgcagatctagagttcagggtatcgagctacgagcgcannnnnnnnnnnnnnnnnnnnnnnnnnnnnnnnnnnnnnnnnnnnnnnnnnnnnnnnnnnnnnn

SEQ ID NO: 65172 - DNA, 1426 bp, Oryza sativa
caacccttaacaacaaatttaggtgtttaatccaccaaatttgcaacaaatcatgtattatttaaatacaagcacaagtcattacctcaatattgtagtgcatgcgcaatgttctataagttatctcacttgggctctccatttcataatacagagatatataaagagaaaagttcccaggagttgcagcatggaaccaaataggccaggagaacgtggctccttcttgaattttaatatcctggcaagagagtacggtgaatatttgcaaagaaacagagaccatgcatgatttttgcagcatacaagggggcatgcttgaaccaactcacttgagaaaatgtaaagagcaaacccttggcatctccctgagtacgttttgtcgatacagtactaatttctgattgtacatgctttcttaagcattggggaaactcgaaatcaacttctgataaatcaccaggaattacaaatcttggatggctaagcttcatcttaatattctgcacaacaagattgggaattattactacaaaacaagctgctgaaaaattacataaaggacaaaattagtgtaaatgtcatagaacttcaactaaacttagaccatcataaaatccacactttcaataaaaagttctcacaaaaacttgacgtcctttaagaccatcatagaactctcaacaaattatgaccaactaggcccatatgaaagtaacatatggtaacatctgatattattccaactatacggtgactaagacagttctatgcaggccaagtactgccttgtgaattgtcatcctgatggcatagcaccaaggggactataggctttgggctactccactcatccactgtacctttgccacattaaccagaaggtcatccatggaccatgaacgtgtgtgtggtccatatggcacacagattaccacgtataccttactaatggtctcagtcagaagtctgactagtgtaaattcataaaaaaagtagttttgtggttctgaagaacgtgtagttttctgaaagccttctttgaaagtgtggtttgtggtagttggttcaaattgtgtagtaccattaaatttgctccaaaagttatgctcatttgagcaaacctcgttaaatcatttcaaattactgaaaaagaagggaagagagttgcaaaaatatatagtttggaccttcacagcatattctgactggttcctcagattcagcttgagtagccgtaaatctccagcaaacgcatttgttggcaagtgatcaatacaccccgtaagtttaggtaaaccctggaaataaattaaagttactcacttatctcagaacaaattatgtgaaagagagcactggacaagtccgaaccttgattacaatcagggtgttgctcaaagtacgacgaggtcctttttccctt

SEQ ID NO: 65173 - DNA, 2254 bp, Oryza sativa
tttttggatacaataaccactcggtaaggagtaattgaaacagcaaagaagacaaatgacaaagtgacacataaagctttcctcctttttgtttgatcgcctaatataccattgatcaatatggttacaaatagaaatagttgaaacagtatttgctagcgccaaatcattttaccaagggtagaaattagatttactaggaaaatgggaagcaacctaacagaacttttgtaaggcgataatactgagtaaagtggaatgacaaagaaggcatacacttttagtttcacttcctcctaacacaatgtccagctttgaaactgtgaaattatttccatcatcctcaaatctgtagtgttaaaccagaaacatcatcggtacccatgagaattaaggttgggatccaaagacatacataaataaagcctcaataattagcaaaaaagaaatattacgttgatatcgcaggctttgtgttagctatatcttccccagcacctgtggtcagcacactattgactgcacagtaatgtgatccattaaagaaatcaatgatcaacataattttctggatatggggttcttaagataaaattttagatcagagaaaaaagaagtaccagcacttgaagcatccaaactggtggaaagctgacatattagagagatgcaagaaacaacaacaggaatttgtagaggattcctaagctcaatcctcacttttactgcttctgcaattgacaaaaaagcaataattgaaacactatataagagatgcatccatatttccctctattgtccgttgacgtttctattttgataaataaattattttccttaatcctttaaagtgacttggggcagatcgagtttgaactcatatttggctgcaatcacacaaacctccatttggactgttggatgtgatatggatggatcagattcttctgggtcatgagaaggtaggcctaatctttatactcttttaaaaggagaagctggatgatggcactctctacacctaccactcaactcaagatcatttggggctgcataaatgtagacataagtgttctttgcaatatccatttcttaggaaacattacattctttgcacatgtgcatatgtaattgattgtgccttatgaaatagtgtattaatttttagttttaatcaatattattgcttgttttaactctacatcatatagcatatatatttgtatctctcgaaagtcgaaatgcatgggcatggatgcttggaattaatatttccaaccgacaaaggggatacgagtcacccaaactagtctgttcatctcatcgagtggtccacgtggaaagcttccacaattacactcaagctgcgctagatatgccccatgagtccattgctaataatgttggatttactttgccattttgctggtttccagctgaaagcagcttaactccaggaaaattcagatgaagttaagttgatccacttaggagcagatttatggatattgaagatgtattacctcccacaacacaaacacaggaatccttgtattttctcaagtcaggagatttttcaagccagttagttctaacaatagatgatgatgggatcatttcttcctccagctcctgccaaatgctttcactaacattaacctgttattgaaggcaacttatacaagttagaattagactgctttaatttctagatcacaaagacagatacatttattgttagagaaacaaaaggagtggttgaatctcatagttattatttaattgtctatcatcagaaatgctcaatacatcgattcattttggtgttcttttatttcagtttcagtagccccacaagaaataagatatattctacaccctccgtcccaaaatataacaaccgagtccaaattttgtcccaaatatagcaacagtacttgtaaaatgtaaattttaccgctaaactacccacagtaccccttggctttattatagtccaacttgtccggacctatacctcaccaatcccaaggagacaaccaagtcttattccccctcgctttaatacccgtgccaaagactaaaaacttgatatattttgggacgaagggagtattagaggaaatatcataaattcaatgtctgattactccggaaaactcaatggtaaataaaatgtctgattactctggaaaactgaatggtaaataaactagatatagtcctacagcagtggaaagtacttacatctgca

SEQ ID NO: 65174 - DNA, 2008 bp, Oryza sativa
ctccttgctaagtcaatgttaatatcaatagtcctgaaaatcagatgcaactgtatttaatagacatggaaaactgcttcatacaaaactaaataggaactccttttctctttgtgtatgacatattggacagtacacagaacacaaatttatatcgatggagctagcatgttaggttacaatttagaaagagaaccatttaatttagtctgagaaactagaagtggacatagagatgaataccagatatgtactaaaggcactgtccaggcaatattcagcatccttccttgactggtccaacatgaaatagcacagtccactcatttcctgcaaaagacacagacattatcatgaagtgactacctacttgaatatttggccactgcactcaagcttgattcagtactcaatcaatcatcaaaacaaattcaggaaccatgtgctttaaatttggaagcatacagtatgattctgatatggtgtacaagtaagaaggtctaaactcgtgtttgaggtgaaaagtatgttaggctgttaacgtagctggtcccaggatattccttaagaatcgccaccttgattgctactttatttcaaactcaacaacactacataagtaatgtcatatgtaaatcaaggcaagaagttaaaacaagtataaagcacctgcacaccagcaaagcgcttccaagctttgtcaagcttataatctgttgagagtaatctataattggacaaagcaagctcatagtcccgtaacatgaaagcatagtcacctagaactctaatctgtgactctatggaggtgaacgtatacctgttgaagaaaaaaaaaagtgttacagcaaactacagaatttttatatagggaaaagggcaatttgtaagtaaccacttgcattgggccatttgcagcttctggaacatcatctctttttctccaccacaagttctttatttgattcctaaagcccttccttgttgtggctacctagaaaaatgcttaatattattattattattattattattttcaaaaacagaatggttaatcttgttgagagaggtaaaaaaaaagtaatggaataaagaaaatacctgctgattgaggacacggatcttttgctccatgtagggaattatatgattagaagccaaatcttgcatgaagtcctttatctgaaaaaaaacggcttatctagtaagtatcttgtatgggttggctctcagaaatcaataattgcatgtgacactggatactacagaggaataactaaagttcattgatctaataccatacatctgcgagaaatattcattttgtattcttagcatcgatacccatgaaaaccttgcatacactgagtaaaaactaccaagtaggctactaatcttcccaacaatacctaccagggaacagatgaatcattaggtgctacaaaatgttggacaatggtttcatgacattcaatatgcccaagaagacggataagcagatgacatgatattcatcaaatggggcaatacctcattcaaatcatccgtgttaagccaacaagctccgtcttggttgtgcaaaccatgagatttctgtagtttagtcaagaaaatactgtaactagattgcatatcggctgcactacgtaaacactaatgcaatttaatctgaagtagttctctgtacttacataaggtaaccatgaattctcagcatctgcacatctgcttctgtagaagaattaatacacaacaatttacaatcattcaaaccaagagtgctcttcatttccgctaaaatgttcatagctcttcaccaaaagaaaaaagaaggtcagcaaaaaagaaggggaaaattgcatacatgacactgtaaaatgttggcatttggcatatgacattatatcattgtttggctagagaacactataaaactgagagaacatgttcattagtaacaggttgctaggctatgcaagaactaatgtaaacataataactgagtgaa

SEQ ID NO: 65175 - DNA, 6277 bp, Oryza sativa
aaaatataatgcacacgctcgtttggtatgatcactttgtaaagatacttccactaccagcgcaaaattataacctaaaattattctgcaaattaaacaatctgaatagaagattattgctgctcatagtaagtcacagtttgcttctaatgtcaaggtgatcggattacgctactttaagtgatccatagaattccaactacggctccataattttgctcaaagtaaatatgcccacaggtgagaacataacaaaatgaagcagtaagggatctcactgctaagtacatcttctagctgtggtgggtctgaaagcagatctggaagagcactctcattggcctcagaaactactggcttgatcctctgatccgccacctgctccaaaacagccaatgtccatcaagagattcataaaccataggcatccatactgaacaagcccacagcacaacccagaagcttccagaaagttcgagaatcacctcgtagtcctgcttccggacgtcggaagcgtagaccatccgaatcttaaacatctgcagcctgtaaggctggtcactcgccgtccgcacgggcactgcatacaggggattccccatgaggtcacagaacccaatcgaatgaaatgcgacaagcgtcatacacacaattatcggaagcggagagcatcggggaggtgaatcaccgtcgatttttttgaagagggagaacggcgagagcatgtcgacgacgctgaggccgctcttgcggcaggcggcctcggcgagcggggtggtgagcaccatcaccaccggggtgatctcctcgaggaggagcctcccgaggtagctcctgagcggatccatcgcgccaaaaacccaagccggtgtggcaggcgcgcgcgcaggcgaagcgtaatcgcaggagcgcgatctagggcgggtatagaggtattcccccaccttcgccggtgcctgcggcgaagggggtcgccggagaggggtcccccggcgacggggcgaggcggcggtggaagcgggcgccggtggtgatctgatctgggaggaggagggcgcccagagacaggggaggagacggcgactagaggcgtaccgtgtagctggctcgactgcgtctgctcgactgtgtggagggggaggggagactgggcttgggtgggcccgtttaatgggctgcaaacttgaagcccaaagtatgaagcccaattaagcctagtttgggtaggcttaaacatggggatgggctgggctatatctgggcatgtatattgggtggaaaattcgtaaggccgagccatatagctttaaattgttggaattttaaggcatgttcactttgttaccaaattttggcaagatttcttatatagctatcaaaatttgataacaaactaaatgtagccacttttttagcaacattaccaaaatttggtaagattgaaaataacatcaaagtgaacaggtccttacataaactttatcagattttcccgaaattcgattcaactttcacagggttcaagaaaaattcctcgtttcaacgatgtttttttttctggcagggccccaaaacagaccctggcataaaatattggctgttcatcactcatcaggaacacatgtatgcatgatgcatggctgatattatcgaaaattcatttttcttgtatacagaaatgttgcgattgctacagcttccaaggagaaaaaggtcggaaaaacaagaggtagacatattcaattactactttacaatgtctctgacaatgaaatgaagacgacgagctttcatgttatgatggcaagcgctgtcaagccaggtaattgtagatctgggggttactcctgtctctctccaggtactccctgtcgattaggctctctattcttttcttgatatccgatggcttgattgggaacttgagctgaaagaaaagaaaacgatatattttaagatatcaaaattgtggagtgcgcaaaatggaatgcatgcgttgaaaacatgtctaacctgctgaaaaagctcagttattagaagcgtgtggctgagggttttacgtgtcttcattattcgaactatggcagcatccacctgcacggaacaagaaaaggaacttgtggcattactctcccgtgattgaattcatcattagatttgcaccaaaaacattccagaataaatttgtttggaatggtgacgttaaacctaaaagatgcagacattaattaagcaagaaaaatagcatgtaagataacaatatgaactaacaataatgtgttgcttcaatgaataaaaagcatgtgagattagaaactagctaccatgtgctgagtgcaaatagagggtaaaacttctacggcgtcacataagaaccagaggaagcataagcacagcatactagtttagctaacatcttataccaaaaatcgaggataactaaacggggacaagtgtaactagaagtcctcaaaggatgttcttgtttgcaagtttagatggttaatgcacctgatactgtctgtcctggaatactctctcagttgtgcttgtgttttcttcaaccgtctccttcatctgaatagcattcacctggaaacacacagcattaccttagttaagcctgatgacacacccaaactcgacgtacccaccccaccccacacaaattagatgacgaatattacctttatgcgatagagaggggcactaaattcttcattaaatacaaattcgtccttatcttctacgtctcgcccttttggcatctgaaaataaaagtgacaactgaacaagctgctactgaaaattagttagacatttggataaaataaagagccacaccttttggagaacccgaactttaccgcatgcaagtgattgcagcgttcttcgcaattctttatcctcaataccagtcgattccttgatatcgaggaagcttagtttttgtgcatcattgaacaacatcaaaaccacactctgaaaaacagaataaatcagtgattttctaattattgatcagacagttacagctacaataaaccaccaaagaaattgggaaaaataaccctacctgaaatagtgacaccgcaagttcctttttaccttttgggaactctgcttttaatacacagtgacccaatgagttttgccacatcaaacgccttccactatacttgctcaaatagaattctttaaatatatcctatcagaaaaatagaaaactaaattaatttccaggcagttaatataaatatttactgccaacaaacatagttttgagaacatggcctgacctgatagacattaagttcatgggggagtttcacatccattggtggatatgttggccaatagctgcaatgcaacatatttaatcagaaatgcacatttatgatagaaaatatcaagttgcatgttaacatgctcagcaaacgcctattataaagttatataatccattgcccatattccagctacatgtcatggactaagaagcctatctatcagtattaggtttagacaagtgttgtgtaaacagaacatgctactcagtaaaccagcacacatgtaaaaatggcaaggcacatgttacctaccctgttgtaagcacgtgaacactcatttcaatgccagatggaagctttgtccttgcttgagatgattgcttgaaagactcatttatttctttggataattcaatgtcctgagaacagcaccaaagtcattttattttacaagagtattaaatccaaataaaagaaattgatgatatcgtgtacgccaccaatggatagaggcatagagcatatataagttagcaacatttgagctaaatatacatagggcaagagttcgcaaaaaggctagtatactagcaaaagtcatttcttctatagcaaattgctaccttgaacattccctccagcttgttggtaaattgacttccacactcagttttgagctgcaaacagaaaaaaaaaaactcaagtatgtcagcaagttggatggcatgtaaaatattattttaaaccatcagcaaataaataattacctttgttatcattgatttttcagcatctatcgatgcactcttccccagcagcaacctcttagccagatccttcttgtagaatgcctcaaatacatcttttccctgaacataattaagaatattaaccttcttcaatcttttatttgttactacgtactagtaaattttatgtgcattagcttctcccagaagcttcatacagaggactataggtctataggactctataagaatgacatattataaccatgtttgtgaaggaccagacctatagcatcatcttcaatgcaatgcttaaaccatccgcccacatgctcatggaaattgtttttctttaatatgatcaccatatagggagttttactattttatacagttgactagttgaaaaaggaggtgtcccacatgtataactgaaattgaaagaacaagatgctgacaaagaagaaacttagtgatataaaataacctagtgacttacttgtataaatcggaacagaaccaaaactttatccaatattccctccagctcttcttcggaggtacctttatttccagctcgaagtttctcatcaagaaacttcgcaatcaattcagcaggtcgattctgttggaaaaaagggcttgagctgatctttcataaaataaaacatagtacaaagaaagaaaatgcaggataaattacacatctacttaagtacaaaaaagcaactagataacaatgaacatcagaaacaaaatgtattggtaccagcatatctcaaatctaagaattgagctttctgtttatcaagtatcacagccaaactggactgcgataggaaaccaacataaagcaatatgtacaaggacagcacagttcttaaacaaatggccaatatcaacatgtcccagcaagtcaaaaatcaaagaatcaaacagtttagcaggctataaaagggaagactgactgtagtaggaaagcaaattacaaaatattgtgatataagatatgaactcagtacacaagaaaggaaaaaaaatattgtcaagcagaatcataaatatggcctacctggcgtaaattgataagatgttcgaatgactcttttattgtattggagaaagcctcatttttggcaaaactttcctccaatattctatcaagcgatgccttaaattccagaagaaagggcaccagttctttgtccttttcttcatccatgataatgccctggcctgtgccccgaatatatgaactaagtgcttgctttagcaactcaatggcatcaaccctctggaagagtgtgtacatcctcgagaggtcttttacacgatttgcttccataagcattgtgaatccctgaacagtaaaacatcatatgccaggtcatgaatgagacagtggctaaactaaattagtggccaacaaatataatatattgataaagtaaacacctcttttctatatattgatctaatgggtcaactagaaaatgcaccatcacattcttattctggccagataacaaatcctacagttgtaagagcagataatcaccttctcaagaattgcagatgtgtgccgctgcaataattgcttttctgtagctgttataagcggcttcctagtgttagcttccaaatatagaatacacctttcatgttcctcttgcaacgttgtctgaataattcatgtgaaataccaccaattgcataagtatacctgaattttgtgtgaacaaaatgcaaggggaaatacaagaggtttatcaatacctccacatgcttgagatagtctggaatatcagactgctgcaaatatttaacaccttcagtagcataaaattcagatgtacactccagaaagggcttttcaaaactctcagaatacattccaagagcagtaaacatcttcagaagatgactaagtaatgtcctgtctattgcttcaccaagcctgataaggaagagatggttaatgaataatcagttacatagaagaatataaaataaattgacccttcaagtccacaattttaataatttaaaatggacccaatacatacactatgatcgccagctacatcacacaaggtaaatgcaatgacaaaacttttctcaagtaaactgattactctttgatatgtaatggagtatacaatacattgcactaagtctgataagggtactttttacagttgaccattcaacccagatctctgaacgggctgcaggaat

SEQ ID NO: 65176 - DNA, 1572 bp, Oryza sativa
tttatacccatagacaccgttatgtatgttgttaattccttttagaattttttgtaactatctacattaaatttggaagagagaagagaaagatataaattaagttgtgttcagggattagaatccattcacacgcaaataccctacctgtcttcgtcgtctttctgtctgattcgccggattcgcgatcattgcctcagcctttggtacagggaaggaatgcacccacagaagttacaaaaaggttcaggcagaagaataatacaaaatgaaacccgtccaatttaagcgcacaaaaaaaaaacaattgcattgcatcccatagtcttcacccgtttcctcaccatttctcgctcagcaggcacactgaataagcttggccagaagcgcaaaatatgacaacagatttttcgcgatcaaaattcattgctaaaaaccgtttagcaacacagctgatagatatacccatcagtcacaccctcaagaaaagtgaagcattacaaacatggaagaattgagtggtgaaagcgaaacgtgctcaggttcagtgacaattaaggttcggttgccaatccaacatcgccgtttttttggcgctttgttgaaggttcatcctcttcattcgttgcatctcctccggtttctgtcgttggattatttggctcggccaccttttcatcttcggtgctggcagcaccgttgataacacggttgacaacgtctggacctaacagagaagcatgtttacttgtaatcttccgaccagctctgattttgggaccccaatgacgttctgggttcggaaggaaccgcttgaccttctttgcttgagccctgctgagggcagcagccgctctagagaaatttgcctatgaaaacacaaaggaagttagaatgccatctaactgaaaggcataaaaggactgctgcacgttcaagaaatgcatacttcaagcttgggtgattttgaaaggatcgctgtccctacagagtcatgtggttgttcctttacaggatgattcttcacctgtatgcgaatgtcacaatattagtcagaatactaaaaaaaaacagcatttctagtaaactacccacaatttatactagcaaacacaatatgttaggaaagttatggcaaaaggaataaatgaatgtacccagcagcgcatgatgtcccaaataacatcccaaggggcatcagtttttagtccaagtggattcacatgtgtgctagaaatccgataacccgcatttaggactgcagatcggaacaatactgcagatggagatgtgcatttaacattagcacatatgttgtggagactgaagaacaatgggatgtcatgtaactcctgcatcacaataataacaaaatgaagtttaaagaaaattttaaagagttcgtaaactataaataatttctcaagagtaaatgagtgagccatgacaaacaaatgcagaactagatggccaactaatttattacttgtacatggtttaactaaattactgcacatttgggcaataattttcctgttgaagtgctttacatatctatgttctagtaagaaa

SEQ ID NO: 65177 - DNA, 5639 bp, Oryza sativa
tttgcagaactgcataagatttcattgtgtcaaatttagaaagaatatttcaaccaagtactgcacaaaagaacatagtcctgttgcataaaggaaaagatgaggggaaaaaggaactcacgtaaatactcggacaaaaacacggatgtagaaatccatagacacagagagaacaggcacaatatatcgtttgtatcgatttgcatgactctggtattgagaaatggaaaagataacaagaatcaagatacatgaaggatgaagcaatggaacttcagagtttatgggtcatttagcaaagcaaataattcaaacttaacacagttctcctgcgttttcgagaaaacttctaaaaacagattcttaaataggtattgaaatttgcacatcctttaataggaatatacttcatcttatgcagttttttaaaccaattatccagttatatattgatccaaactaataagttaactgagtgatataggtacctcaatactggcaaggaggattcgcaaagccatttcatggttatacttccctttggttggataggaaccatacctacaagaccgacttgatggttagaacaaaaaactagatttagatttttgcttcaaaccagtagtaatgtccatacttggagtggcaaacttcaccatttggcccacatagaaccgccatatcagtggcagtgcacattaatagcccaccatcagcaacagcctgtacagccgaatcaaggaaaatagaaggtgctccataggggtcaatatcaacctgaaaatgaggcaggtgtaagttgacatagaaagatacaaatggagtaactgtagtattcatcactttctaatgattaaaattcatttctttcaacttaataacatacaattgactgtttggcacaatcaacagtttgtcaataggggaaacaaatcgattaaaagggtaaagcatgaaaatctaccatttttatatagtaaaatgttgctaccaaaaacaatgctataaagatatcctcgtaactaccagaagagaaaggcttaccacatcaaactcttttggatgtgtgagcatataaactcgagcatcagtcaaatgaggctcgatcttactcatagcagaagcaccattaaactttatattccgcttgcaagcttcaatacaagctgaaaaggaagaacccacacagtataatgaatacaagcagagaagcatcattatttagaaaggaaaccagttcagaaaattgggccattacctttatcaatgtccagagcgaccaccttttctaacacgtctatttcacgagcataacggatagatctcaacccagaagcagccaaagcctgcatttagttttgttagccggtaaaaactgaaaaactattacatatcaggtcaggcaacattagtatggaaccgtaaaactgatgtaaacataacacagtaatgatttttttattgtcaaaactgcataacgtattatgacttgcagcacatagaaccaaatattatggtcctcaggttgcaaaatatcccagccctatttaaaattcgaacaatataacattcagagtacatatttaactaaaagtccaaactttcatgtcagagtgttttatgtatttttttaaatattgaattcttgattaagatgattaatttaactcttaattaatttgctaaaattaactgagatttgaacgaagggtggggctctatgaaacccgtagaccataaacctgggattatgtgccacaactcataatatccttgtttttctggaatgtcaaccattaaacctgcatttttttagatttactctatactattcatactatatgtctcacctcaagaacaactggtgccttaagctctctggctactttccgcgaaggtgtctttgttgcttctgttgacagatcttctgtttcatccgcaactttatttgtttccttttcagcatcaacatccatttcatcatgctgtcctgttgacccattctctccatttggaccagatgatttactctggctcactttgttatgcgccttgtccctcttatccatcattgccttatgttcttcctcacgcttggcaatgaaagtccttaaaagagcaactgacatatctctattgtggacctaatcaagcaataaaattgaattacagaaaagcacagtagctgataggagattagacataattttaggccaaatataattactctgcaacttttaaaagcgatagatacaggaaatattaactatgaataaactcatagtaatttgccgatgatatcacattcccataaccaccctttactcaattcctccatagcaaaagttcaggctgttagtgacttgaaaaagttatggctagagatactaattgttgagaatgcagcataaacaagcccgagtggctgttttgaagcttcacatatattctcctagcaactgcaagtctacaaccttaaactgattataacgtgtcgtgatgcgctaacacaaatgaccaacacaatgcaaacaagtcgtaaagaaaagcaaagcaactagtactctagtggctacaccagagaccactcacttgaaacgacccaatcacatacaaatcaaatagccaaaacccaaacttatagtcctacctatgcacgattggtgaagctcgcagctcacaccattcgatcaattcgaaacaaaccaaccactaatgatgcacgtattctaagaagatagaggagccgacaaatccatcatacagcatcaaataacccccaaaaaaatcgcatacagaacatatacacaacaatacctgcacgggattgtagaacacttcatttgctgctattttcttgttgatgatgatctccgcctcgccttccctcacaatctcatagtcctttagcttgttctccacatcctccatctctccgaatccaatccaatccaacaaaaacctcccgattcaagcgacctaacgagagacgcagaccgtaaagcataaggcgtgggcagagatagatgaggaaggaggagcgtgagaacggatgctcaccaccagatagacctctgatgcagcgggaggacgccggcgaagataggcggtgctcggcgcagaaggcggggcgagctcgcgaagaagagacggggaggggagtatatgccgaggcaacgaaggcgtggaactagggtatagggtagagaggaaggaaggagacagtatgggcccaagtatgatgtgccgtgatcactatgggctttttgtatgaattaagttcactttaggtcccttcgtttatcgcctagtctaaaattcatcccacatgtcaatggtcagcactttcttcctcctctcttgccacctatcttcctctctctttccatcttcaggacgccgcctagcaagtggcgtggagagcgcgtggtggacgacgtggagaggggctgcgagagcgccacccctgctccaccttcctttctggcttgcacacgactggtgttcgactggtttgctatgataggctctcctagcttgcacttcgccccaatagcacggacatgttgccaaatgctataatcagcataaccagcaccccacacatacatcacacaatcaaagacgcgtactttttgggaataaatcagaaggatcactcggatcacaacgtttcaactagtagtaaacaagaggaggaggagagatataaaaggcacacctttaggacggaggttggccttattccctcgggacttgaacacggggcgatgattttgggaagcaagtctccgtgagcctgctaaagatggctagtccccagggccgctgctcgcgaggtggcggcggtggcggtggagaatgggcgaagcccgatcaaatctattacttgataaatagctatgcaaggacaaagagagagaggagaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctagtctgcccaagctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggcccctcgcgatacggcggcgggaggcgcggctcctcccacccctcgccgtcctcgtccggtccatggcgtacgtggacgtgaagatgcgatggaagaaggacgcctccttcgacgccgtccccgtgctgtcccaggcgcgggacctccgcccgctcgtgtccctcgccggcctcctctcgccgtcgccgacccccgtctccgcggtctccaagcttcgcatcccgctcgaggtccccgaccgccgcgtcatctccttcctgcggcggttccccgccgccttcgtggagtccgtcgggccggagcacaaccacccctggttccgcctctcgggctccgccgccggcctcctgcaggaggagcgggaggtcttcaccgcgcggcgcgcggacatcacctcccgc

SEQ ID NO: 65178 - DNA, 1901 bp, Oryza sativa
gctgaagcagaagatcgaggcatggctggaggggtttcagaagctgccttatgtctctccctatgaggatttcagcggcatttatcgcgacagcgatgtttcggagaagcgggtggtcggggtgcttcatgagcttcttagtctgttcgtgacatgctctgccgagaggaggcggttactttgcctcaggcagcacctggggctgccacagaagtttcaccgtgtgtttgagcggcatccgcatgttttctacttgttgttgaaggagaaaacatgctttgttgtcctcaaagaggcatacctggctcggggagacactgcaattgaagaacatcccatgctggtggtgcggaggaagtatgcagggttgatggaggagtcgcgggagatcataaggtgccggcggagtgggaaaccttttccgtcgaagcataaagatcatgagcagattgaggattctgagggtgcaaattctgctccaattttgtcatagaaagctagaactttgcctggtcagaaaaaatgagggcatatgcagtatgattttcgtgataataccaagggggattctactcttggaagtatatggctgcttgttaggaatatttgtgtagaaagacaggagggtgtacaaacaggttggtgactgatgaaattaaattgcattatcattttatctgatctctgcaagtcattttggtttgtgcacagtagtacgcactggcggcactgcaaagccacatttacatcaagcctttgtaaagtccaactatatcatttagccaccacttactcacaatcttttcatcaaatcattgcaaatctcaatcacctttcttaaaagggcatagattgctgaatttgattttgtccatactttttacatataaaattcaccaagtatgctgcaacttgttgctgatttgaattttaattgtcaatggctcctgtatttatgtccatgcttatgcctcatggttggtattgcacttttacagttgtcgtaactcagtatctccctttttatggcatggagataactggatgcactacatttccttaggctgaggtcttcacttcttggctggcaaatgttttatggtgtttgtttggttaatgtggtagagttacaaaacagataacatgatttccattgctggaaactttttgtgtaacattatgcgtgcaattgtcagtttccagaatgagaatcaagctttcgtttgcatgcaccagtggattatttaacttaaatttctctgttgaagtacttgtcctgttttaacatctacacaatcggatgaacattagttgtttatattgcgccttaactaatttagataatcctagcttttttgtttgtttgtttttgttttttttccttggcagggagatcatagtttgttttggtgctgtctgtcttggtagtaagcagtatgacaatcgatcaattgcgagaaattagatagttgtgattggcagatgccatagtcagggcattagctctttgtgctattctgtttgttgtgattgctgaattagatcaagaccacattcagttatgtcaaccagggaagagtgttcgttgttgtcaatgtttctgtaacttgattttcttgtataaattttctccaactactgattagcactctctccactcgcttgcaaaaggtacagtgtgagattttctgatatcacatcttctccttcacattttctaaatttaaagctaacaataatttcttcatttcttgcttttgcagagattagtatatcactattcccaaactggtgtctactctttaccgtctttcctggagaataattgctgcaagctttggaatgtgtagtttttttttcatcgagtaattcatccacattttcaaaagcgcggtgcttct

SEQ ID NO: 65179 - DNA, 2181 bp, Oryza sativa
cggccactcctccccccgccgcagtccccgaggggccatacctggccgcgctcaagggaagccacagctccgcctgaaagcagcagcaggagacgctgagccaggcgcgcaagcgtcccggtgggtcccaaaccctagccaccccaggtagcggcagcggcagcggcggcgcgcaggtcgcgaggggcggcgcgtgcttcaagtgcggggactcttgccactgggcaagagaatgcccgcaatccgtgccagctactggcggcggaggaggaggcggggcctttggtggaagcggaggagggggtggtgggtatggggacgcgggtggggcggtggaggagaaggcttgcccctgcggcgccgggagttgcctagtgctcacatccaacacgcccaggaatccgggccgcaagttctacaggtgccccatgcgggtgagcattacgaatcccatcaccctgtactgtaattgggtagtatcgcttcaaatctatgtggtctgataacgatggttcgcaacacattggatcccacttaataaaaacatagagcctagacacacttgcaattatgtagaggggatatgagacctctagggggtttagtttttcatgatgttgtgccaaattgtcaaagtgataaactgattataccgttgccgttagtgaggcttgctggcttattggtcggtgttccccactctagtgatctttatttatcgtggcacatctgtatatgattgaaatcatactttaaaatatcttagcacacctcagacttctaatcagaatggtgatacatatttgcgatatgaaaccataaacatgataactattaaaaaaaccataaacatggtatgtgtctctgccttagtataatttcccattctgttgtcttaaggccagttcagcgtggtactgttgttttgtggagtgtaatctaattagagagaccggtcaaccaattgtactaggactagacaaatttcctgtgcaactgagtggagtttgattgtaatttattgaaagtagaattgtgtttgctatagaacacctgtttatttattctgaaaatacaattgtatatattatacagttaacatctgtagcagtgatctaatatatcatgtcaatctacaccattaatacagacccaccaagattagtagcataggtttttcttattttctatgattagcgtgtaaattctagccgctgagaatgaacgttgtggcttcttttgagttagttttaatagtataataactacctgggtcttatacagccagcttatatccatttactttatgttatatctattacgaattatagtcatacctagactgaatttgacatggactcttattcttagatctgaaaattcaattattttgaaattttatttttggcacgattcattttttttttcaacctaaactgttataatttggactaaccacaaaactaatggtgtatattttattccttttctcctatcaactgataagttttagaccttgagagcaagtgtatattatttgttactatttttatgagacaagcctgttgtgctctaaacaagaggttatgaatttgattgcatatcgaaggcagtaaacaaaaatgttgatctaaagccaccaggccattctaaaatactccctccatactcgtaaaggaagtcgtttaggacaatgtttaagtcaaaccttgggaatataaatcataaataactctcaagttattgagtttgaaaaggcaaaagttatatgaatagatttgtcttgaaaaatactttcataaaagtatacatatatcacttttaaataaatatttttatagaaataagaagtcaaagttgtgttttggagaccgtgtcgctgtcctaaacgacttcctttatgagtacggagggagtattgatttggagaggctatgaagttctgtttcaccaatcactacttgaccacattattactcgatcatctgtcttgatgggggaacttctattcagttggaacatgggatgcacatcagctccacatgcattcatgcataactactttgtatccttaatacgtaatcattgtttaatatttctgatgtgtatgcatgtaccgttgcacctccaaagccttacactgcatgatcatactctggtgttcatgtggctgatgccttg

SEQ ID NO: 65180 - DNA, 11095 bp, Oryza sativa
tcaccacaaagacaggaaagaatgttggaaggcagttttatcgttgcccagctaatcaggttcattcatgaccctgtttatcctcccaccctctctcttcctctcttctttcctcacccaacaaagcagggaaagttgttttactgtacaatattatgctgatatcccctataaaatgagttctggtactgtgttgattatctacagctgtctcattcttgctaaatgagtgcgtcatttgctaggcccagtatgattatcatcaataactatagtacctacagatggaagttactttagtgctttggattgtaccatgggaattttgaactgtttatcttgtgaataggaccaagatactgctcaccttatgttagtctagaagatgtggacagtatgatggttacagttgcacagtgcattcgtgaactaagattttttggatcagtttgccgctgttgtgttgtgtgctgccatgcttagtatgaaggtgttgctgaaaagcagttgtgagtaacattgagccggcttataatatttattacattatacaaactgttatccaccgctgtgtttctccacctgttctgcatttgaaatacccaaatacgtccattaagacttggtttagaagacagcagctagccagctgatttagttttggttcaacttggttccagggctggttaacacgattattcttgatgatgatgatagtttgcttactagtttaaatacgctcaatataaattctccccagtttccattgattggttgatgcatttggtgtgaccccatagctggactcaatgtcctacttttaatgctttatgtccaaaacccgtagtacttctaatgttaacagtgcgttcttcttacccttgcaacttcgtattttattgttacaattctatgtcttgtttgctcttcataccaaaatgttcttttgcatttgctttaagagatatagtggtaagttcctatgtgtagttaaatccttttgttctagtggagcacttatttctatctgcacctttctggatagcaattgatgctaggatatgatatcatcacttgttctgttttacctttttcattattgttatattcttgtatgcatttttttcgaaactagggcatttcatatctctttcttaatgtacgatcgggacatatctccagggaggtagctcttgtggctatttcaagtggtgtgatgaacaacagcttaggacagctgctccactgcaagcttcaacacaatatcatactgatgttgcttcaagtggccaaattcccagcaagaggagctcctccgcctgcttcaaatgcgggcaagagaaccattgggcaaaggactgcccaaatcaatcttcagatccttatcctgacaaaggtgggagaacatttacttctgcaagctctcccgatgcgtgtttcaagtgtggtaagagcgggcactggtcccgtgattgccccaccgcaaattgtggttctagtaccgtctccagccatgtcaagtcctcttctactttgggctcatggaacagccacagatactgatagccggtacctgtgaactcaattgaactgacatggacatgctgtacgaaacttggacaaatgcacatgacacgtgttgcttaggtacgcattcttgccaaattccttttgctacttttaagtttggtaatgagtttttactgaggacatttccgtcttcatgctggttgctctgggaatcttttgtcatctgctctagacatttccactgatgtagatataagaaaaatcagcactatgttcaattctatgctctgttttcgtactgatttcatgttcattttcgtgctccttttgaaagctttatttggatatttacatgagttagattgaatgcccatttaaaagtttagaccctgggacctgtagggtagttaatagatgaggtagatatggtgcccttaaaactttagggcctggaccctgaactacactttaatatacaaccttaccttctgacaaggctaagtgaaacacccacaaaaagattgggaacagttgttctgttgggttggataaacttaatactatcacccactgtgccattcataggacccgtctattaaaggataggaacaaaggctgaccattcactcactgcgccaagtggggagaatgctattcactcaaggccacagaagctcacatggtcatgagctcgtgagggcaaggaatctcctctcccctggatattagttatcatcagtagtagcagcagcagcagcagtagtagtagacagccgtagtaatcatctttgcacaaggatgtggtcctggttgctggtgcccagccaattgaactgcaggatggttggtgccatgacatgtgcttattgtttgcccctgcaaggctttgaatagtcactggccaacactacctgccatcacaggtcggtttccctcagcgatcttggggtcccctatgcgtagatctgagatgcctccactaacctcgctgggagcttgatttgctgtttatttgtttgctgtctgttcggtcggtcttttgcagttgttactttgcactcagtgcttcgcctctaggctcaagggagggcctgatttagttactccatagtcaactagatagaaaattttaaacatctctctggtaatttatatatgcccctataacatactcagtgcttccgtatagtctggtaatttttgcttggtctttgactagaacatgaatccaacggtttatactagttgcctgcatccaacggtgcttgatttgtggcctacgtggctcaaccaagatccgagaaagattttattctttcactactttagatcagatagagttcctccaaggaaatctttcagagtcactagacaaagtgttgtcatgattcttgattagtccccatagcctgcacttagcggtagtgaacctcttgaaattctttatggccccttgggagcacatgaattagttcaattcctacgaacttcctcttccccccccccccaccccaaaaaaaaaatgcctatatcctgactgtaacagtcagttgttgctacaaatcctccccggtgtgactgtaacagttcgttgctgagttgcatggttgcatgcatgcatcaactcatgagtcagtcattacacgatgggaagcatttaggagtactttcgtggcacccagcaaaacatgacaagcagccgaggacgctgggcctgcctgttcgagctgccactgccgcctgcatcatcccaaggaggaccaccacccgggagaagtggaactggatcgattggcaagaacacgaggccgcgggggccacagccgtgaagcgcagcgagacaaatcccatggggcctctcctgcctctcccctctcttaaatgcccctttggcctcggcctccccggaccccggtggtggatttcgctaaggccttcttcggtcaatccctacgagatcttattcggttaatccctgtgaacaatcccctctaaaccgaacaaaagcgaaccaaaggcctaagtttgaaaaggatagaagatgtagtacagtactgtagcaaagatgccggcgagcgacacgctcacccaccctcctctgcgccggcccccagcctacaggggcatatggctccagcacggcgtgtacaacaacgtagtgctcggggcatccactgtgcgtgccggcccgcccctccctgtccctgtggatgtggcctccagctgattgatgcctttgcttgttattattgctgctggtaggagaagtagtgcatcccgttattttcagccacttcactctattattgccgtggattttttttacctctatttttttttctattgcatagcttagccccctttcctaagctactccctccgtcccataataagttacattgggacgaagggaataattgtttactttatttcttaaaatagttaatttatccttacaattaagtagataatttgtatcaataatctagtaaaaaaatcaacaaaattttgagatgtggtctatgagtgatcagtcagtgagaatatgaagaagctagagttaactggctcctgaataccgatatgagtaagaatatggattatttggggataattggagattatagggataacttttgctgtcacaagttccccataacatgggtttagactttagagtagcatggtttggccatttagggtctcttgcctgctactccttcggtattattattgctgttgacttggtgcttctgctgttgccgactttgccatgagccatgatgattgtgctctcatacatggggtggccgggtgggcactcatcagggggaggaggcatccttccatcttgtcacgccaaatggggttaaccccggggaattttttccccttctctcatcactcacctctctgaagccgatccacatcggtgtgtatgtcacatctgccgatggtctcttcgctccctttctccccgtcacactttgcttctccctcactcactcacaacctcttcttcaaatgcctctgttctttttgcgacttctactactgttgcgtaataattgtagtactagtaattcaatggtcgatttggccacagtaattcctctttaatttaatggactagacatctgttactatcatcagtgaactgtagtactccctttcagaatataaggattttttttcttgcgctgattctcatcatttcgatttttgcaaagccaattaaatatttggaaaggcaatctaaataattcaacaattgacaattgaaatgaaacattactgtttgctaagggcccctttgaattgcagggtagaaaaaacggaggaataggaaaaacataggattctgacaggaattgaagtgtaaaacagaggattgcaaaacacaggaaaaacacaggaatggtcgtttgattcgagtgcaggaaaaacgcaggaatcggatgagagagatagactcaaaggaaattttccaagaggttggagctcttgctaaatttcctccaaaatctacatgcaatgtgtcattccataggaattttataggatttggaaagcttcaatcctttaaatcaaagggccaaataggaaaatttcctataggatttgaatcctatgaaattcctacataaatcctttgatttaaaggggccctaaacaatgtagaaactcttatattttcgaacggaggggtttacgatttttttgagctccaatccagacagtgtgaggattggattggggcgtgatgaattatcaatcagcttgtggagcacagttgaaggaatggtacaaggagagatggcatggaccactactcctttcatcctttggccattgaaaggtgaagtgttgggagattgagagagatggggtaagctgtaataacaagtgagggaggccaagacaaaacaagccgagacgcgcacataaacaaaatttcctttcgctttgagttggaaacacgtcctttttggactgaaacttgatggatgtgtccctgttcgggacaaactcgtaaggtggacgtgacagcgcgacgtgcccatccagatctgccgagattttactactaccatcactcgtgagggagaaacaaacctttctccctattgcttcagatcatactaagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcatattttggaggaaagttagcaagaggtctaacctcttggaacatttcctctgagtctatctctctcatctgattcctgcgtttttcctgtggtccaatcaaacagctattcctgtgtttttcctgtgttttgcaatcctctgttttacaattgtattcctgtcagaatcctgtgtttttcctattcctctgttttttcattcctacgattcaaaggggccctaagattttactactaccatcactacaacaccaacctattgtactactactaatgaattccacttggagccaatagtattcctcccttctcctgcactttaggaggtaataatgagttgctaactaattaatccaaggcctccatggctccaactaactagtaataatcttttgcaagagtctttttttaatatatatatagcggataaaatttggtctttgcttcgtaatactccctcagttccaaaatataaattttttttgacctcaacgcagttttcttgatactactttgaacaataatatctataaaagtaatatattttaaataaaatgagtggcatatgttgatagtttgttgaatgataaatctactagtaacatcaaagttgcatgattgatgttttttatttttatatgatattaatagtcaaagttaaaaatgtttgatttgtcgctattctaaaaatccttacattttgggatggagaaagtacttattatggtctgtttggtacaactctagagatggagctgagtctatccaaatagtttcagcttcgtctaaaatggaagcagagctagggtttacaaaaccgcacggttaccatgcggttatcgcggttaccatgcacggtaacctttttagtttttgaaaccacggtatgtctcgcggttaccacgcggtaaccgcgcggttaccgtgggggtgcagcaaccacgccaaaaagagggttactgtgggggtgcagtaaccgcgccaaaaagggtaaggggaaccctgagtagagctaggtggagcgctctcataatgtgaaccggggtttaggctgctccacaattctattccagactcaactcctagagtaaatttaggagttgaagctctaccaaatagactcttataaagtacttagctccagacaagtataaaagattaaaagtatcttaactagttatcctctgtgtcttgagtgctaaaagagtttatactgcaagtagcgtttagattagcagtctcacgtggtggcctctctgaactctcacaccctagaggttctgctgccaaattgttttacttgcagctttctacaaagggtaactagcagatgttatgcgaccaggaaggacaggtcacatttggcatcttgcgagggatagttttgtgggtctgctttggggacccatctaggtatcccctgttaatgaccagcttagagaatcccttttggtgctgaattagttagctacttgttgtagatgctcctgttggaatatgtgtccagatctttatatgatgcatactccacgactagactaaagataaccagtaaaggcttttgtttggattgatgcccaaaagaaccttttataacaaaattaagaatactacaagcgttcaagtaaacccaatcatgcaaaatacgctagctatcctgctagtgttggtaatgattgtagaatttatccttagctaccagaaacttggtatggaaacaactttaatgtaaaaaaaaaaaatcagccctagcaactttcaaaattctgactttaatttgtcagcaaaattgttcaactttattaaccttttttggtaatggtcaacagatcaaatcaaacaacccataaaatctctcaaaattgggtattttctactactgatgtgtgttcgtggaggagtgcatgcgtgcgtatagcacatgaccttcgcgtccatttattattattattgtcctggctgttggatgctaccaagatcgcggcagcagaacagctaagcgagctcctgtagctggataacacctctcgggccagttgccgcgaacgcatctccttttatctggtgaaataattaggtaatcagagtacaaataaatttgatgtgaatcgttttatccccttgcacttaacatcacttaggagcacatatagtagcttttttttttgttgtttctctctttaaaacgtgcattagtaatagcaaaaaaaaaaacgacttgcatgaaaggttaataaaactctgctgttactcgactctgttgggtgtgagtgtgacttttgtgttgaattcctttggtttttaaggcatttacgttcttggtaaacgagttttactttaatatatgttgcaaaagataatattattgtttagaaaataaaaataatcaggagaggcataacatttgaatacattctttttttgtataatcttagattgatatgtaaaacaagctatagcaattactcccttcgtcctataatataacaacatcctggatacatcctaaaacaaactatgaatcctcatagcccctgttcaaatcgatagcagtaggatatgttattttagatgttactgtctctccattttgtattataaaactacgaatctcgatagccctcctgttcagattgatactagtatgatatttcatccgattctagtttactccgtttagtattataagttgtttgacttttttcctaatcaaactaaatttatttaattttgactaaatttatataaaaaatataatattactttcaaaacaaaaccttccattttgtgaagttagtagaagaggatagatccagtaaattgtagtacatacgaatgtcaatcttaattattgtagattaatacactggtaagggtcgatcaggcaaataccaaagctgactcccgaacaaaacaaacatattatcaaactatattcaatggtaaatttaatgaaactaatttcatattttagatgttgagatttttctacaaacttgatcaaacttaacaaagtttgactagaaaaagtcaaacgatttatgatatgaatcggatggagtatattttgggacggagggattacaatcaaggcccccccccccccccacacgcacacacgcgcacacaaaagcatggtgcacgaaatcaattataaaatgagttcgtactcttgcacgtgttgtatgtacgacttcggtacagaatcaccaagtcgttacagtagaccaaattcatttcactatgcacacagctctcctgtgtgttcctgctaatgattcagatccacttaattctgttgcagcagttggctaggcaaaaaaggtagtgggcacctctcgtaccacatttaccaaaaatcacatgcaaatgcgggcaatgtatcaagtactaacattatatgggagatgccgatagttgcagcttcaagaatctctagcttacttaaacaattcagattttcatttaaattttgagaactgtagttattgaatttagaaaatgaattaaatttggttgtgtgtctaaaagtggaggccgaaatgtaaataattttcactatctaaaggagaaaataaactagaaacaaaaaattagaaaacttattttctagattttcatcagctagctacttggctgttttaccagattgttggttatgagtgagggaactccaactcgaataattatatgcttggtttatcaagcttgatttttttttctaaattagaactagcatagattaatcttgttggcacgctttttaaattgttaaatgcgttttttttaagtaagaggttgtagggttgagagtgtcctacctcgttttaggtgtgtctgaaaaagctaagccatcgtagtcaaactccatacaccattcttagaccaggttttaaatactgtattttagaccataaactcaatatataatgatgagctaaaaaagagtttgggcatgtcagtagaggacccaagcacaagctctgtttggcgtgcaagttggcaccagtcctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactctactgtgcctcacctcttgccactactatttctagtagtcgtgtatcatcatttcagatatcatatcgccacctctcgtttttttaataatatcagcggcgagcgagcgagatggactccccgtcgcctatggcggcgcaggcggccgacctgtcgctgacgctggcgccgtcgggagggggtggtgggggaggaggaggcggcggcggtggtgggtc

SEQ ID NO: 65181 - DNA, 5470 bp, Oryza sativa
gtgagcagcgggcgcgcgatgctggcggcgcccgaccagccgggcgccgggcgcgacgacatgatcgacatgctcaactggaggcgaggctcccacggccccaccgcctccgccgccgccaccacgccctccccggcaagcaccaccaccacgctcaccaccttcgccagcgccgacggcagcaacaacggcgaggagaacgaggagctcgacctcaacttgagcctctagctcccaccaccaccacctcctcctccgccgccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatccttttttgtcttctttttcattttgccgtcgatttcttggcttctctcttcattttacctttcatgtttgcctctgctgctgtatatatctgtgactgtctctgtagtctgtacttggatggcacttgcaaccaaccgcattgcaatggcctgcagaggctcgatggtcacactgttcatctcatgctcgaatcgccattgacatgtccatctacttctacttcttctcatcgtatcaaagcgttttcttttcttttcttctctgaagccgtgagttttctctggttgcagctgcatctacgtgcctgtcaatccattcaactacgttcatatattctcctcgttgcaatttttttaatacgttttctcatactgttcatggacctggatagattaatatccgtatacatatactgtacatatttggtggtactagtgtatctatctatcgtctgctgcactaattcatcatatccaacggctgtgactgctagtactagctcttgtttgtttgttcgattctgtggctgcagaatagtagcagaaggatattagacaagaagttttcaatttttttttacatacgtcatgcaaggtgaacgtgcatactactacggtgtatggtaaagaaggtgaagtagttgctggtttttactactactgtactattttaatccttgtgtgtcccaaaactgttgctgctgtttggcgtacgtgtgcatgttgcgttttggtgacatgagatgagatgcaggtttgggagcggtgggtgttgaacagtgatgcaatcaatctcgctatgtatatactccttctcgtgctactgacatgtggggacatggcatgagtatacagtagtagtatactccatgtgtgtgaatgttcaggtcggtgtcccatcgcgtcggatcgtgtttcacagttgcgagagctttttctttatttttggctactgcaacgctttctctcttcttcctcttttctgccatgaaagcctactatacgactagtcatctcctgacttgaaaaaaaaaaccagaagaaaaggcgagagagagagagagagagagctcctgtttcgagttatggtgagaggtgacgcgactcacgcaccggacggacaaatccgcgccgtccaatagccagccagccagaccctctttgcgggccccacctgtcagcgccacggtccaatccccgtgccccggcccgagccggatcgtctgcgcgccaaagcccaaaacgacccttgggtggttcgaccggtcgggtcgggtcggcaaactcccacgtgagccgttagatcgggttgtcaggcgatcacgaccgtccatcgcgagggctctctgttctttccggcggttaacagtagccatccgggaaagctacgtcgacgtggaggaggaggaacatgtcgacacttgcatattccgagactcgtactcgcgtactagtaccgagtacagtactaatttttgttcgtacgtacacgtgggcgatacggccagctatacgtacactcgtaccgccgcaccgcgccaatacgtagacgtacggagtgccgggcccaccggtcggcgtgtgtgtgtgactgcggctgtttccggctgggggcaggaagcagcagacagcggcaaccgatctggttcctcgccgtctgcacaactggcggggacgacgacagcgtggacacgacacgcgcatgtgaccgcgccccaccctctggggcggcgggcccacctgtcagtgcctcctgctgttgcgagcgcgcgtataattaacttcggtactcctccgagccaatgctaaaaactcgtccgttaactttttacatcatgtttaaactataaacaaaattttatgaatattatttattttgttgtgatatattttactattgaagaaactagtatggcgtattttaatacacttattctatttatttaaataatataaatgatcaaagttgtttcacaagttaagatttttgtcgtgtactaaaatctggaggtagtactagtaaaattatggcgctgatgaatggtgatgactgccggagccacagctcagagctactgccaccagcagccattttcaactcagccgcagccaaagcgaacagcccgtacattaggaactttaaattaaatcataaagtttaagggcctactatttgtttgggaggaaaaccaagggactcaggggctgtttaggatccctcctatccaaacaccacctcatatttctatggattaatatctactagtgtcatttggttcataggaatgtagatataggaaaaccaaataaaaattttctttcctacaagttgtaaagagaaaacataggaaattttccattcactcaaacctattgaaaaattcctatatattgaagtgtgcatgttttcctattcctatatattaattcctccaaaacagataagtcttaaatgttggctattgctaataataatctactactccctccgtcttagaatatagtagtaatatagtaccgaatatgatgtaccctactactacggatacggatataggccagaatacgtctaatccgatactagattgctatactctgaaaattttatttttgataataatatttcaatccaacaatctatcatcttaatgactttctcggatttaatgtatgactcttcattcttccacataagattggctatacgggcatcgagaaatgtaaatattaatgaatcgcttgttcacgaggaatgactagtagcatgtttaaatggatgataagtagaattgcttatccttggtctgtgtggcaagatgaaatttaaccatgagcttttgttttcgtgtccaactttaatcgtccgtcttatataaattttttacggtttatatttttattgttattagatgataaaatatgaatattactttacacatgacttttttttaacttttaaaaaatcaagatgattaaagtttgacatgaaaactgatgaccacacttaggccccctttgaatcacaggaatgaaaaaacgggggaataggaaaaacataggattctgataggaatacaagtgtaaaacagaggattacaaaatacaggaaaaacatagaaatgaccgtttgattgagccgcatgaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttactttgaatcaaagggggccttaaaatgggaccggagggagtaaaatgcagacgatgagactgacggtcacaggaccagccgcggcggtcccggctgcggcagccgtgttgtctctatgcgtgcgtagctgtgtgttggaacagccgccctgatgattctctgtggcgcaacatctgtgccacccaactccctcattggccgcctcagttatctcttgtcgcctagcgtcctcgggaaaggacagggatgaacagtcgatccaactaacaactgtttcaaaattatgtatgtacaaataaataaataaatttgttcttttttttaatcaaagaagcagataatttagcccactggatttggtaaaaacaaatatgggaaaataatatatgtatccgttcgtatctgagacgattgcaacagcagctctggtctgatacactgatgtgccatctgtgtgtgtgtgtgtgtttttcttggattgttgcttgactggcacggggcagctacttgctttaacttaattaagcaggaccatttctggataaactcgtaatttagcaaaccggtcttacttctttttgtgattgccgtgcttgtgtgtggtcatcaactcatcacgagtgcacaacaagttacatgagtataaatacaagttgtaacatctgtattaaaaaatgtcattattaatttattggtaggtcaacttacacgcagtgaagaaaatgagagagagagagagagagagagagagagagaggggctgcgtggtcttaaaataatttgtcagtttacggaaataaataaataaatgatgagcatgcagcgttggtcgtatgtactggttaattgcaattatacaaatggtataatcactatagcatggcataagaagaaaacaccatgcatttctctctctctaaataaagtacaaaccctctttaataattcgattgtgaaatacgatagtgaaacagtgattgtacgttagccgttgatgcacagtacccgtaatcctagtggagataatgtgatcatgtgcagagctactgttttgcatatgtatcttttaaatatttgcattatatgcatgaaattacattggtagattaatattaaaaaaatattccatatcatattgttttattaggttttagaaatacaccacaattaaaaaaaatacatggatttacattaattagtccatttgtatgctataaagaggacatacctaggtcatgtttgatagagcttaagacattcggttgtattttcttttggaatctatagctcatcaatctatattctaataataatttgtagatatagaattagaatccagaggatgaaaacttgatttttctatatttttaccatctaggcacctacttctcgaaaactccagctctccaaacacaatgaaaatgtagaggtttttcccacctaagaccttatttgattaattcccataaagctttattcgattaatcccactcacaacagaattaataaaaaattggaaggagataattctgcacctattaaggtatagaattaatctctctgatgagattaaccg

SEQ ID NO: 65182 - DNA, 11948 bp, Oryza sativa
ccatatactacccccacagccttaaatctggaattacaacgatttaggggcttgtttgaaacgcaagagcaacgcctcgctctcttcagcgagctaagtcgatgttaaaatttaaaacttcaatgcttagtatgtgttatagttatcattagactaatcgtggtctcctttaggataaagattgaaaaacacataatagaaaaaaaaaaggaatgtgaaaggaataaggcagggttgcgcatgaaaaaccaaggaataaaaaacagagaaatttttgtaggatatgatgtttgggtcacaagattatcttgaagacatgatttatcctccatcctattccaatgctagctagtaaaaaaaaaggatgaagtgaatgtttgaaatactttggaattcttgcgttttttattgcaatgcaagctacagtattcatccataatttcattgggcagttcctgctacgtacaatggtggacaaaccctttttagtcccggttcacaaccccctatagtctcggttatacaaccagaactacaaatccgggactaaaaatgggcatttttagtccgggttgaaataactggaactaaaaaaggatctttagtcccggttggagttactaaccgggactaaagatctagtcctggttagagttaccaaccgggactaatgttttttttctttttcttttcctgctgctcgcatgattttgagccccacaaatcattcatattatccacagatcattcgaacaccacagatcattcacaaaatccctaaatacatcaagctgcattttctatctccaaatacatcacaaatcattcacaaaatcacaaaatcatctctacaaattcattcacacatcacacatcacacagatcagaaaaagaaatcacatcgcacagatcggccatcagaaaaagaaatccacatcacacagatcggccgcacacatcgcacagatcaggaaaaaaccacatcgcagagatcgggtgccggccgtccaccgcctcgccagcctcccgcccggccgcctcgggctctgccgccgcctggggagcgtcgccgcccgccgcccgccgcctcggcggccggtgcctgcccgctgccgcctcgagctccaccgcccgccaggggagtgtcgccgcctcactggccgtctgctcggccgcccgcctcgggcctcgctggccgcttgcctcgcctgcctcgcgggccgccgcctcggccgcccgcagccggcctcgcaggccgcctgcccggccgcccgccgctccgcgccctccttaccgccgcgcgccgcccggcctcacatggtaggaggaggaggaggaggaagagaagagaagggagaggaatgggagaggagaagggatggaggaggataaggatggagaagggatggatgaggctatttaattaatgagaggggaggggaaaggaagggggagagaccgaggcggccgggcggggcagtggcgccagctcggttgattttttttttgtcctggttggtataaacaatcgggagtcctgttgtttataccaactgggactaaaaaagaattggggtctaactcggtccgataactttttgaaccggaactaaatttagtcccggttggtattaccaaccggggctaaagatcaaaaattttttaaccgggactaaaaataatctttagtcccgattcctattcgaaccgagactattgtgaattttggacgaccgagcaaaataatttctccaccagtggtagtaaattaaaggcacctgaccaatgacaaatcttaaaaggaccataaatcctaaagagaaaaaaaaaatctgtggaaacaatttgtttcaaagtaccccttaatttgcatgattttactcgaaacaatttgtgatgacacaatactttcacggattttaacatattttctcttcgaactcataagaaccacgcacatcaatatattacagagagagaaaatttcgtacaagtgcactctgctgtgacggtcacgagggttttacatggaatgaaaaggatagcaaagactggcttaagagtgaaaattttgtaagacattgcatccgcgcgttcaattccacgacaacggaaacgacgagagcgcaatccaagcatccacaacgatgtctctctcctcgcatttgtacgcgctgcatatgcaatctacacagcccatgatgatcgagagcactgcacaatcgtctgagagagagatccatcccgatcgtacgtacgattcgcacagggagattgtcgctggatcgaagggcacgcagcacgtgtagcacacagtccggtgactctctctctctctctctctgagctgttcatggactgatcgatcatcagctgcaccttctgcaagctagctgcctctctgcatatcgatatactgtagatatataagcagtgttgtgcttgttgcatctgcctggctgatagctggagtgtatctggtctcaggcccaaggcccgaacggattattatcgtggattatcaacatgatagtaatagggaaaagattaatttttgaaaaaaataaacataatgaatagtttaaaacaagctgcttaaacagtgcagcaaaagaacttttttttagaaaacatggtactagtaggattgagcaaataatatgtttcaataatccaattgataagtgaagtgagtgtagctcaacaactgattaggttccttttggtggaactagcctacccggatccaaatcctatatttgacatggtgctcgcatttacgcctaattattcttttagtggtaggtgacgtatatgttgacagcgaggcgcccgtgattattcatcggattagtagtgtggattatctattcgattataaagataaattaaacaatttaatatataaagtaaatataaatagcctaaaataagtggtccaaacaatgcaatagaagatttttttttttacaaaacatattatgttacatacgtggagcagataatctgtggcaatggtttggtgaagtaggttgtaggctatttacgtgcttctgacctacttatattgcatacccatttgttggtctgagttatttcattacaaaaatattacctccttctctaaaaaaaactttcatttaagtaatacaacgaacctgaatactgcatacgaacctagctaaaagaagtactccctccgtgccaaaaaaaaaaaagacaaaccctggtttccgtgtccaacgtttgaccgtccgtcttatttgaaaaaattatgaaaaaaaattaaaaagataagtcacgcataaagtattaatcatgttttatcatctaacaacaatagtaattataaaaaaaatcatataagatggacagtcaaatgttggcacgagaacccacggtttgtctttttctggacggagggagtagatgataaaatagccattgttgggctaacagcaacacatttgtatgtacatagtacgtttgtgctatgcagccacagagaatatgttggatggcaggttgacagtcaatgtctctaatactgtttgcaacaaagcccaacagagcactgacttttcctcacaaacaaacatgataatgtatgaaactgaacatacacatattgcaactacttaattatctatttatgtgcctgcacatatatagcaatacaacatgttgctatacatagcctggtcttttccaaaatccagggatgtactttgggcaaaaacaaaaggcctaaaaaaagcttttttttaagatgggactaaaactttaagtcgcccctatcacatcggatgtttggacactaattataaatattaaacgtaaactattaataaaacccatttataatcttggactaattcgcgagacgaatctattgagtctaattaatccataattagcctatgcgatgctatagtaaacattctctaattatcttaaaaaatttgtctcgcaaattagctttcatttatgtaattagttttataagtaatatattttaatactctaaattattagtgtctaaatatagagactaaagttaagtccctgatacaaacaccactagatagctagggtgtgttcacgttctcgattcccttctttcatgctctaccttacctacatcagtttcatgctacaccaaccagcgttgtaaattcatgaatagtcaagcaatcgatcgcctgtttccatgtgcgaacagggcgtcacatggactcgtgtgccccacggcggtcaacagcgccagcggcacagtctagtccggacgactaatggcgtttgatcaactaattattttttaatatagatgacattcggtattgaaatttgatcgaaatttatttttaattctatcatttcatgtacagccgattgaataagttgtggataaaaatgtcatatatatttctttaatgatttaaagcctaatgctgagaaataaactgcaatggatgaaaaccctaaaatcagctgtaaagttaagttttaaattttagcaaaggcttatatgacgaataatgtaaacaactgtttttttagtgtgaacaatccttggtggcagtagcttattattttaagttctcgtgctaaataaggatatcaaaataagtaagaaaaatattttatacgtacagactatctctgagagcgtgatccaattgggactataaaaaaatacagacaaaagggcaacattgcaggatagagacatgactgatatatatgaatttatatgactcaatctgctggtttgtattttcctggaatacattactatacacacatgcgtgccttgaactgttgaacatataattcctccaagttgcaaaggaacagaacattcatgtcatcctgcaagtgtgagcgtggtccaaactaataaatttattccccttcctgtcaaatgggtctcactggattttcagttagattttgttcaaccacccatcacaccaaactttgatttcgaatccgatccaatcctctctttccccctttttatgccttttttttaactgatggtgccttttctattctcttttcatctctgatggaagtgacgaagtagtagtactatgtataagtagaaaatgttgtaggttggggggtcccactaacaggctgatgaaaagaagaacatcaccaaccaaatagcaggaggtgagggtgacagtataataatctctctagcagcagctattgataagcaaaaaatatggagacaatggggcctagtaatagtgcatactgcacagtaaggctttacttcttttgaatggaggaatttccctttgaaccgttcatttcaatcacaggattgagaaaaaaagaaattgaaaacaatgattttagtaggaatgcaagtcacaaaacacacatgaatgattatttgaatagaccataaaaaacgtagagatcgaataagagaaataggctttaaggaaatttctaagaggttagagctttaactaactttcctccaaaatctatttgcatcaagtcaatccctaagaattcacagaagttgagaagctccaatcatttatttcaaaggactaaggatttgaatgctaataaattcctccataattcccttgtttcatgggaattttgggaatcttatgaagaaaaaactcctatgtggtgatttgaatgaaagaaatagctatccaaaaatccaatgaaattcatctggattgactcaaaacataggaaattggaggaattctaacatgagcttcaacctctttaaaagaaaccgtttatgtttgtctctctcttatccaattcctacgtttttcctacactacatccaaacggtcattcatgcagttttcctataatttttcagtccataggatatatttcagatgttagggcacttcaatcatgcttttttttttctgttcctgcgtttcaaaggagcccgataatggagctgaaatgtcggagaattgaatgagatttcccactaaaattcaataaacctcttgtgttttgaaggagcccttaactatgactatgaaagcttactctctgaagtaggggctattcggtagtgcttgctgcactgagctacaccaggagagcaaagtttaactatcctggtgtcaaatgaagtaaaagtgacccctaactgttctgatgtcaaacgtagtataaaagtgtatcatatccggattccacagtctcacaaaagcggttatctcgttgggctgagaactacactctaatcgatcaatcacggatagcctagtttgctttcaggcagctggcctggcccattgctaaatatgggctaactgtagggtaaaatagaaataagtccactatatatccccaatctttttgtcaacattaaatgaaattcatgtccttcacaccgagaccacctgaatttctttggtcatttggtcaagccctaaggttgaagtggcatgcgaaatcactggaacagaaggataggccctggacgatggcgactttcaggcctgggaatgatgtggagaccatatttcgctcggcggctgttaacagtgaaatttggtaagctcggagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgtggcgtggcaagttatctattaattaggaatagtttgttagtttccttttatctttaggaaagtgtgtttagtatcctataaggactttatcttttccttttatctttaggaaagtttctttcttgtccgacaaggaattgtatcaacccgtgggtataaatatatacacctggggtctatgtaatctatcttcacgatcaatacaattcggcgcatcgccaccttttaccttttctactttattttatcgtccggcgggacttgacacttgacgcggggctgcatcggtgttcgatctctggctaaagggtaagtccaatgttccgccggcccgggcaattgtatcgtttacgtcggcgtcgttcaaggctgcatcagtacattcgacctcttggattgctctggtttggatgatatatttgctacctatttatcatgtctctgttaatctagtcttagcatatcaatttagctctatcggctgtctctcgctttagggtttctgccggtatcggctaaatcgccttgctagattagattagcctaggcatctaccaccctgaaaatttaacaagatgctgtttccggacgagctacaggacggattttgacagtgcattcatgctaatttgttggttgatttggaaggatcgtaatgcaagaatttttcaacatgtgcccaagacaccggaataacttgcggaggatattgaagaggaaattgctgtctggagggtggctgtttcgcgagtaatcgccatgactgtctgcggggtttagccctactttcttttctcgttcttggttggctggggtctttccctggcaaccacggtattgtaagtcgttgtaacattttactgtattttccccccaaatcttaatgaaattggtcggctaacttttggccgacccgttaaaacattaaatgaaatccataaacttaaagttcatctattttcactatatgtcctctcaatgcaaacttagacaactatatcagtttaaactcgatccaaagcatagtaaagtgagagagtagcactatttcgttcctgttcacatccatatctttcatgaagtaacttatatatatgttgaactccgttaattaaaaattaaaggagtatataaaccggttccgtaaatatcttaaggcgagatatacagatgccaaataggtgtacagtactcgaaattacaaagattataccagtataattaatcgttgggattaagagcatgaacgacccagttacgaggggtgcacggagtacgtgtgttgcttgcgcgcgtgtggatcgacgagattcttttgcaaaaattacctaattaattaatcggcgtgctctctggcgtcgtcgatattgtttattgtttggctagagttcgccggcggcggcggcggcgaggtcctcacaacctggggaaggggcgggcgaggcggtcggcgtcggtgtagatgtgggcgcgggtgatgtcggcgagcgaggtgcatccgctgagcgccatggtgagctcgaactcctcccgcatcatccgcagcacgttcctcaccccggcctccccctccgccgccagcgcgaacaccaccggcctcccgatctgcaaacgcaattcaatccatcaagacgacgacgacgacgatgacatgtatcacgccatagatcatcggctatcgatcgaaggacttacgaagacgccggcggcgccgagggcgagcgccttgaagacgtcggtgccgcggcggacgccgccgtcgaggtacaccgggatgcgccccgccgccgccgtgaccacctcctccagggcgctgatggtcgccgggacgtagtccagctgccgcgcgccgtggttcgacacgatgatccccgccgcgccggagtgcacggccagcctcgctgcgcacgcgcgcataaacgcatcagtttcctttgtgattttgtggatttcaaatcagtcaaatcagaagaaatgcaagaaacaggaagctatcctaccatcctccgcggtgatgacgcccttgacgaggatcggcagcgacgtgatgctctgcagccacttcacatcctgcatcatcatcaacaacacacaccgtcagaatttctcccgatcttagcatcaagaacagtaatttcgataagttaatttgctggtaagtttgttgtagcatcgatgagcattgatcattaccttccagctgagcgtgcgatcgatctgcccggcgacgtaggaggccagcccggaatcgttgctctgcaaatgccaacgaaatggttcaaattgctgcatagaacagaccattttttcttcagagaaaataactgtttttttttttggctgaattaaccgaccttgtccatctctgcgaggtccaggccttcgaaattcttcagtgtcaagtatggtggcagaacgaacctgcaacaacgcagccattgatcacatcacttaacatttacgacaactcgctgaaattcatttctagatcgtgccaaattcaggtggctagttaagaactcacctgttcttgatgtcagcttccctgcgtcccagtcgcggagtgtccacggtcagtgcgatcgccttgaacccagctctctcggctcttctgacaagctgctcaaccacattcctgtccttgtacacctgtagatgtatgcaagatcatacaagaaaatgagatacgaaaataaaatgtagccaaagtatgctacatgagcagagtgatatgatatggtttacgtatagctggaagaaacggattcctggtccagttgaggcgacctcctcaacacttgaagtagcccaagatgacagtgtctgaaacatgaaggcgataccaaattaacattggcgttcatgcaagtttgaatttctgttttggtttggtttcgttatgcatccaaggaaatgttgtttgctattgaacatgacaacatgtagatagcataccattatagttcctgctgctgaagctgccctggctgttgcatactctcctgaatacatatggtattttagttagcccaattctatgcaaagatcaatgtagatcatgtgcttgcttgttacatgctaacaacttcagtttattttcagtttttgtagtagtaatatgcttttttttaaaacaatataatatgctaatgttgatggatgaaattacttttggttttgagtttgggctaaatgtaaggctgtacaacaattaagcaacataattgaaatggcatatgtaccgtcagggtgagccatcttctgcatggcactgggagcaatcattatgggcattgatatcttgaacccaagaacagttgcggacatgtcgatctttgagacatcgatcaggatgcggggacgaaacctagccagaaaaggttacagtcagattgtgggctgaaaaattaacaaatgttcaacctaaggaatgtgattgaaaaatttaagtcatttgctaaagctttcgtaggagaaagtgataacgttagatgttgtatgatagatattctgggtctgggaataagattatgattagctgagagtttcactgattggcaattttactgaactaatgaaatgcccttaactctattttgaaaagaatacgatgtgctcatgctaaactagtctacctagtaaaaagaccgagtggtcaggattggacaactagtaatgttttgtcgatccatcctacttaactatgagctatcagattgaacttgtacatggtagactcatagggaggcatttacacagatgaaatatttgatgcacaatatggcatagggaggagtagtggtgcaattaatttgtaacatgtcaagcaatcaagtaattaagaattatggcttacaagatcctggagaatgcctccctgttctccttgagagtccactcatcctcagctccagaggcgtagtagtcgtagatcatcttcggaagcttctgcttcgcgatggcctggtactccatgacattggtgatctcccccattttctcctgccttgtgaaccctgcaccgctctacacccaaagaacagcactgtcaaaagaattgagctatagctttcctcctactaaaataacaatcatctacatgcatgatgataacttattcttttttttttctgatagaacacatgcaactatgcaagtctgctaaaagttcatagcaacaaggtaaacaaaaaaaaaaagactttccatcatcagagaaaccaagggactcctttctcttggagtgcatgcagatacccatttttttgtttctgcagaaaatatgtggtattcttttaacagaaatgataaacaaaaaaagaaatcttcatcatctgtaccaacgatcaaacgacgttggaactgaacaaatataaaaaaacctctcatcactcatacaaacaagagaactaaaaaatcaatcagaaccaaagatggcaacatgcaatagatcctaataatttggtcatttgaaactatgcgtgcagcaaattcttggccacgccagaagaactattacgactgaagaaatcacgaaagaaaagatgactcaaatcaaaccgatagaaaagcaaattctgtacactgatatgcatgtagcttatcttaccttgagagacactgggaggaaggagcaagaacaggaggagggagtggtcagtggtgttggtgcaggtaatataggtgagggagagagatctttgagtttctgcacatgaagacaaagatagggggggagacgtggagatttgttaggggagaagcgagagaaagggaagggaggaggttatggatgagcttttggaggttgagatgaaggatggctcctcctacactacttcctcatccacttgacatcaccactcccctcctcctgccatccaacatttctttctccttttctttatttaattttcaggagatgaacacacaaagaagtcattttttttctccagctgaattggagtggattatctccttccctagtcagggaagaaaaatgtatatataaattgttctccccttgtttagcaggataggggtgagtagaagccagaagagaacagtaggccagcaggggggtttctgttattaggtggggataagatggcaattttggtaattttgttggcatagcataggctgtactgcagatatgatgacttttaaagaccagacagatcatcgtccaacagagatggggattcagaca

SEQ ID NO: 65183 - DNA, 1626 bp, Oryza sativa
caaacacaacgcaaaagaaagcacctgggacgaaccacgctcaataaggagagacaggtaaatctgatagatgaagtcaccggaaaatgtgtttattcagtaaggttttgaccaagcctcccaactttagctcacttcataccaggcaccacacaggctttacaattgccaagagtaccttctacaagaactgaaacaattgcaagggggtgcatgcagcgaactcttgatcggttcgcctgttgcaaaacaattagttaacccaacttggtaccaccattgcaaagcccgtgttagaactttcagttaaaaaaaaagaaagtctctttacttttcagtttaaaggaatacattatatttctgtctaccttttttaagacggtgatatttactacacagatattgctatattactagcactctggcatttccagggaggtgctttaacagcttgtttttacagagctacagatgttactagggaagagcattacatacaaaaagcattagtgattacttcttttttttctctctcattcaaatgcaaatagcatatgaacagatgtcaacagattatttctcccccataaacaaactcatcatgattctctcacaaaacactcactctgcacaaacattgccttacttcccactaccatcatcagtccagacactgtcccaggagttgttagcttttggtgcctcagcaaaatgatgccctggaccttcaaacgaagaagtttctgcgccctgaaccccacccttctttgcttttgttttgatcccaagcaagcgtagaacgaacctcgcaagttcaccataaagcattccagtccgatcacatagctacgatgaagacaacggtggatcaggaaggttataagtataaacttggatcaaattcaaatcaaattcagaagatacctgcaaaagagctgagataaacatgtggaatgcctgtgtgttctggctaaaaaggaaagcaactcgcccacaaaaattcacaacaccatgcatctgcaatcaatgagaaaaggttaggaaactgtgttctccactcccagcataccaatcacagggtaaagttcactttttactacaaccgatctttttttacttgccatttggaatgtcaacaagatcaacacatttgaccactgttttttttatatgctcgtcaacattaataaaaatataatgatataaagtgttgccaatgtttttgaaatggctacggcattctaaaatgacatttttttgagaacagagttagtaatgtatatgaggcaataaattaactacaagttagacaagaattgctacatggactttgaattccatctactaggcttcctacaatagaaataaaaaaaaatcatgaacttcatatgtaacaataacatggtgatagcaaatacatgttatggctgcaaattaagttccacagaaatttaaacgtggcaatcatgctctagtttgttaaagatcaattaaaaacaataatcggtatcaaatccaggagtgacttggtagaaaatgtgtattaccactcgcaggaaggacatccaaaaaccagggggtggtgctgggggcccaaatgaatttggaccttggttgtaagcaccc

SEQ ID NO: 65184 - DNA, 703 bp, Oryza sativa
tttagacctattctacctttgagctcgttctacctattctaccataacctagagctcggctcgagccgagcctattctacctttgagcttttagacaagctcggctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagt

SEQ ID NO: 65185 - DNA, 1043 bp, Oryza sativa
ttcacagtaagactttgagaaatcatgagtaactgttctaggcccttccataaaccaccatataggactctggtcgatagcactgagaaacagcagatggtatcagcacattaaagtccagagcccaacagaatttgtcgtaacaaaggttctacaatctagcacttacctgcaatggcacacatgatgagagagtagttgaacgtctggatctgacttggaatagttaccacctactgctttcgagatcagaataaaatcaagaaggtcccgtggtccctggacagtgatggcaccaatatatatgtcatcatttgactaagtgatggtaaactgtatgaaaacaaaaacatatgcatccaatttctcatcatttttcgagccaaattttgttgattccaacttgaagattagggtaacaaatccttgacagctggaaaaagtaccaccaagtgggtgcaaatgcctttatagtctttaacagaactcaccttagccaaccttccctgttggtatctctcttgatagtggaaattggtaataggagattgggaaacatcaaactcctcagtattgctgttgccctcacgagataaaaaaagcatatcacttctacaagaactgttttcagcttctttacaagaatttgtacctaaatcctgaaaaaaagagatgcattttaaaaaatataatacagttttaaactctacaatgtaatgggcaaaaaaagaatatatagatttggaagacatggtatgctacaagtattacctttatcttgaagaagcacgacacagactgatttgctgatactgtttcaatagagcggatagaatcgcacaaaggcaacgatgaaattgcccatttactgtcattgcatgacaactgatgaagaataaatgactctgagggagtcctgttcaggatgtccatgcgcacaatatactctttcaatcttgatgagcacattcttatagcaaaggacacattaagtgatggaaaaacctgcagagaattgtttagagataaaaactcacaccaga

SEQ ID NO: 65186 - DNA, 4076 bp, Oryza sativa
  unsure (1)..(4076): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactaaccgccgcccccggttaacgttcgagttcgagtcggggccggctaggctagagccgttacgccccaccaggattttagcgggaaattatgtgttactattaagtcgtctcatttaagacggagaaatttgaagaaattttatgtacgaaaatcctgtaaaattcatatgttcgagaaaaacactatatttgtagcatgtgtaacactccatccgtcctaaaatataaacaattttgtattttttatggtgattaagatggtcttgattggtcaagttaaaaaaagtgcgtgtaagatggttataattggttaagataataagactggtggagaagttatattttaagataaattttagagattaagatggctagttgttgtactttaggataaatttttaaaaatagaaccggttttaccttatcgattacaattattagctattagctagtaggagttattgttacgcgttgagaaccgttatcgacaatttttgaagaaatttgttataggtgcccattgataacaccgggtatcgcgataacgcaaaaaccctgataagaacacataagtctcataagattccaagcatgtatgcactcgcattcacaaatagtgtctgtgttatatccgacgtccttacatgtataaaaaacaggtcaaatatccagaggtgacctgtaaatgccgagttgcatgaaacaaaaaccattcgacgcacgcggagcggtctacctaaaatttgcttggtagagctaataagcatgggcaagtgcatgctccacaacaaccgcatgtccgcatccaccatgatcaaacggctgccggttttgtgcttgtgcattagggtgataatggctagtcagcaagcaataaccttgtctagctgattgggtttagtcccaaccatgacaggtgatcgacgctgacaagccatcaaggaaatgaagcaatggtcccatttcaattcttccatgaaagcgaccggactccacagccagagcagagagacagatcaacgacagggcaatgtccaatcaagtatactgaacataagcggcaattgactatagttattgcataacaccagaagtagtaagatgttcaactcagggagattaaaccggctttagtggaacatgttgtggtaggactatgggagttctgcaagtacattgctgtgactccagctgaatttagatgagagcaagaggtgaaatgaacccgatgctgaacccaaacgagatgcaggtcagttccttgttgccgtcatctagtagcctcatggtgagagtgtaagaaccctgcaacacaatattatgttagaatgtcatacagaaagttagaagtcatataaggacatgttctctatcccctcttcttgggtagttaggaaattcattaacaaaagaatatcttcttcaccaacagaactaaaagcatgctgcagctatgcttactggtggggtgattgatggtaaagtctgttcgtgcgcaagcacgaattcaccagttactgggcaagaggtctcctcacaaaggttgtgactttctgaatggacatggaaaaagaagtacttgacatctatcacgagcttccccttagtgatgcttttatctggcagcagtcatgaaaaagtccccagtcagtactcaaaggcaagaatctactggcgtaaaactttatagtagtagcttttaaaaatcaaatatcatcataagaaaagtgagctaggaagcatatatttgtaatgtatctttgtattaattgaatactcatcattaacttcaaattatatgctatgtttgctttcctcaaacaaattactgaatgaatacagcctcaacaactcctcaattttgtttggcacataatgtcatgaaatatgagcaaaactcaaatattccctataaagaaagaatccacgcatctaccgaaatatagaaacaacacatgggaaaagacagtgacagcagctgtgctgccagagcttcatacattcaaatatccaagcctatgtactgtagtcatgcttaagccatacacacacttgacaaccataccaagaacttttgatgaatcagtacttcactgagtgttaagtgagcagtgccatgatacttgtcatgcaacaaacaaagttagtaaaatacacaaaagtaaccgacatgtcaagtggaaagaatgcacacaactttatcgacttattgttggttgatctttttcaactataaacggaggtattctagctttcctcacaagttatctaaattaagtagacagaataacaactagaaacttctaatgtgtcaaatagtcccagaatattaacggttaatgctacactatgtctaatgagatgaataagtattatgatgtttacagaaaacacgtgttaatacttttgttttacttagtatgaagtgagaggccgcatcatatttgtattgagcaggatgttggacaaacaatataaagctaattaaactaagctaattaaactaggtggacggaaattcccttgttctgttgctgaatttagacttgtagctcaaatgtactctacagaaagggatgcttcttgaataaaatcgaaacagttagcttatccttatttgtagaaattctctcccctttgctatcagagcaatttaagcgggatcacaatgaacacgtgtcataacagtgcacagatgatgaactccagggcacccagtcatagtaagctcaaacacgggcatcaacaaacaaggaatgggcatgaaactatggcaaactacactaaatccagcatgcatatacagatgcacgcattgtcacaatttgcaagttgcaaccaacaaacattaggtgctccatctgcaagtagcatcgcaatgaaaaatgccttgtgaagggcagtcttaacagaaacacctgcaggctgcagcgcaatatttccatgttctaagtttctaacagccagcagtttgttctttacttccttacaacaaaaattccatcgcatggttgtactgttctgcaaattggaccaattcaataatgccagtgaatggacagcgctacaaaacccacactaatttgactcccgatccgactactgcatatgcccagtaaatcccccaaccgcatgaccgcactaaactgcaacccgccgcagtaacagatcggtgcttggtgcttacccgtggatgcggagatcttgaaggtggccggctgcccgctgacgacggggtcagggacgatctccactccgctcaccttcacaggataatcccgcccctgccctgcagcaacaaaccccaccccaccaaaagcggaaacgtaagcttgacacgagacgggaggcgagcgaagctgcggacgggaagggcctcgaagcactcactgcagtactcgacgtcggtggccgcggcggaggccgggaggaggaggagggtgagcagcgccgcggcgaggaagacggggaagcggcggtggtcggtcgccatcgctgcaggtgccaaagctccgcgtgtcgcgactcgcgaggactagaggattcgcaggtggacacgacgcgacgcgacgcgacgaggactcaaatcatcaggtctcaggtgcgtgctgaaatgctgatggatgcggccttctcatgcctgcctatgggccttttaatgggcctagttgctcaggtcta

SEQ ID NO: 65187 - DNA, 30282 bp, Oryza sativa
aaaaagttttgttttagttcttggctgctagtttcttgttgatctcttttattttatgattacatggaagatacatatgcttatattggtgactcgtgagtgtcttcaatacacatgtaagaaatggagaccactgatgaatctgtgatctcactggaatttactaaactgtatctacatgtccgtaattcttcgtgatctctttcatttttccttggatgaaaactaaatcccctgagctagattttaatttactaatatttcctattagtttcttgtttgagttagttcgatcataaagaatggaagagaagactgtacaccaacgttcaattgtttaatgtgatgttacttgtatttttgtatacactgggctaactagattttccttccttcagactgattgctatttttttaatatgttagatcttgggatcagttggtcattgtgagggaactttggagtaaatggagttagttttgtatttctcttctcttgcttgattggccagcttgaagctgaattggatcccgaagtcacatggacctgtactagaataatacaatgcgagtgcactagtgctactgtgctagattatttgttaattatgttttactcttaactcacatgtcatgaaagcttgaaagggactaaatgatcattatcaaccaaagcccggtgccattgatgcaggaattgacaccgacgaagattgtaagggcgactaggtgcttttttggaatacgcaaggagcgcattttgtattaagagaaataaaagttatttacagtcaaaaacaaagcagcaggggagcgactaggtgcttcatgaatcatgaacaaaaataagatggcttctgcagagagctgtatgaattatgcattctgaaccactctgtctgacataaccaggctgcaatatttttcctacagggaatggcaggatttccacctgatgcttcgatttttttttagaatttatttcgtttgcaaagatttagtttgtaatctgcatcacaacgtgcagacattcctttaagctcttgttctccatgtgatcagagatgaacctgaaaatgatcacaatcacattctaatttattcagatattcacaatatatattcgactattccggtcttccggaccaaatctttgcaaatagatctgtctgttcaaatgatgtcatggagtttggtgtccagatttttgcccatgcctaattgtctatcataccaaagagcggcacagtgagtcttttatatcatagaaagactctgcagtgtgcaacatagctgaaaatgattccatagcttctgtggcaggacactgcagatgtgaaggtaatttgcctaattaagttctccttttcttttcctagaaattgtaaaagaaacatctgttgttgtcacttgttagcagaaaaaggcttgatgtagatacgtcttgcactcttgccttgtttaggccaaattagcatttttcacttttgctctcttttcttgaagagcatgcatcatgattggtatatccgttacttcaaagcacaaagtaatgattttggcgtaaactgattgacccagcaaaaacctgggggaaggagcaatgtatctaggggacggccgtatataggttgctgatgtcatcatttgatatgcacctagtagatctttgaattaattcatcaagagtacaatgcatgagtgtttgaactgaggttaatctgtttactgcattccatatcctcatcaacctcaatttctagataatatgcaagagcattaattaaaaggatctattccttttgaaatgtgcatcttcaattttacagatattcatgatagaattttacatatataaagcattctgcaaatatgttcctacttcttactttgtttacactcatcttcgttcttctgcactaagcttgatgatataaaaattagatctctagaaggttcatccaaatttgtaatccatacataatctccctccaaaaatccaaagtgaatcctaattccaaagagaatcctatgccaaactttgtttatatcagaaaagaaaatctactctgaacccaaatttacacccaattaccaagaggaaatttctagtccctatcttgaggaattcttttatgcattccattttgcagaatacacaaatttcatcctcaagtttagttttatatgaataagaaaaaaattttaaaaaatgaaaaccaagcaaagaacctccacgtgtcatgacggcctcgccattgccagcggcgtgacctcggcgagcggcgtcggcaaggggctcggcagcggcgacgtccggcagacggggcaggtcggatgctgccggagccacgggtcgacgcactcccggtggaacaggtggccgcactccggcagcatccggagcacgtcgccgtcgccgtagttgtcgaggcagatcgagcagcagctgcacgtggttgcgccgcccttcttcgtcgccgccgccgacgccgccttcgccgcctccttcctcggctggccgtacaccacctccgggtaccccttgagcgtcgcctcgtcgatgccgagctcgacgtcgtcgtgttcgtgcccggccccgccgccgccgccgccgccgcccccacccccaccgcggtgccgccgcgacgatcccgccgccgccgctgcatcggccgcggtgacgggcgcgcgcgtgcagaagtaggacgcgagcgtgatggtggtgatgaggaggaggatcccgacggacacgccgacgccgtagccgaacccgccgatgcggtcggagctgaacatgccgacggagttgccgtcgcccggcgtcatcatccccggcgccccaggcggcgcgccgccgccgctcatcgcgatcgagcttgatcaagcaatggcgatcgacgccgagccagcgagttggtggtgtcgccgcgcgcgcgccgcggctgagctcgatggtttggtgcggtttttgtttggatccaaagcgagggagggggaggttgcgagtgcgacgtcaacgcttttgcatgttgcaaacacacaacttggacagagagagaaggagacgatgaggttgtgcaatggtttcgaggtcaatggcatatgggcatatggccatggttttttttatttttgaaaaaaagattcaaatatgtttaaaataagatgagtttgtgtgtgatttgctgtggctttgtttgtccttgcgtagcttactatctgtcgaattgtttggtttgtaatggtcaatgcaatcatgtgtgtgtttgggatttgactttgcttcgacaggttgtatttctcttacggtttttattatattccaaagtcgtgtgaagcataccggccattttgaggagtttcgagtccagtttctgcattgcaagccaaggttttatttcagttgcaattatagtagtcctttcagtgccttgagaacaaggaatttctcaaggtggcatgtgaagtactattttcacttttttttttggtgaacggtactactcctgcttcacattacaacgactttgatctaaggcttggccttgatcgccctcgacatccttcacgtcgatgtaacaaactccgtaattggctatttattttttcccctctcttaatgaaattggtcaatcatcctttggccggcccagaaaaaaaaaaagagacaactttgatctaaggcctggccttgatcgccctcgacatccttcatgtcgatgtaacaaacttcgtaattggctatttatttttttcccctctcttaatgaaattggtcggccatcctttggccggcccagcaaaaaaaaaaaagaagagattttcttgcttgacctgtttgcaaatcgttgcttcctttgcattctagaagaatagaagtcacctcttgtattgtccaaaaaatagtttgtttacttatgaatactatagcgagcacttctttacaactgaatatctgattcatcgctaaataacatctttttcgccgggttgagtgaaaccacagatgcttataaatggttttgatcagatacagcgtaaacatgggcaaagataccgacttcaaatttagcaggtttcagaagtgaagttcaatgacagctacatatatacaaagtcatccaaattgacacgaggttttgcttcacacctactcaaatcaagatcaagagaaatggactgctactgcagcaaccttattccatctgaccaaccgactggtacttgagagccgaacaatggttgctcagagacagatgtgttacatccttcttctttttcttttttctgaatctttctcctctgttctgtctcgatgcagattctgaaaaataagttgaaccgccggctagtcaggatggaaggtcaactgccagaagtatataggcatcattttattttgggttaggtttggttgggttgaatcgaatatggataatgcattacttgagcagcctgcctccagtgatgccttccctaaatgcgcccccgtgttttggatcaagcaaagaacactcatgaaaaggtaaaaagaaaaaaaatagtagtcactctctctcatgagtcatgacacagaggcactgcatttccatggatagtttgcttgatggtacaagagtgctttactcggggggtgtttagatctagggttgtaaagttttggcgtgtcacatcaggtattatatagggtgtcgcatagagtgttcgggcactaataaaaaaaactaattacagaatccgtcattaaaccgcgagacgaatttattaagcctaattaatctgttattagcaaatgtttactttagtaccacattgtcaaatcatggagtaattaggcttaaaagattcgtctcgtaaattagtcgcaaagtatttaatacttcatgcatgtgttcaaatgttcaatgtgacagggtgaaaaattttagggagggatctaaacagggcctcagtagattttcagcaaatttaatttaaaattatttatcgattttacaagaacaatagcactaaaaaattatgtaaaccatccaaattaattatcgctcttgttttgatattccaccacataacctattttgttgcaaaagcccactcactcagcactgccaagtccatccccttcacaaacatttgattcaacccatttcttctgacatggattcgcagcggaccatatcagtgtggatagttatatggctagctatgaggttagtttgactcaagctcgtccttaggttagttgactctaacccgatttcacctcacaaccacattttatgagacgatatggctgataagtaccactataaatccacgtatgaagaaaaagccgaatagatattcatgtatgtagagaggcagagataattttgacgtggcaatgttggttggataggcttttacaataaaataggtattttgggatgggggagtaatttgctatggcaaaattgtttcaagcattgaaacgatgtttagctgtctcccaagtcccaacttgtacactacaaagaaaactcacgatagggcagcagcatatcagaaaccatttgattgtttaagcagcattatatatagaaaccattttattgtttactcatatcgcccgtcatcttgttgcagattcatagccgcatatatcaaaaaccatatgattgtttaagcatattttagaaaccattttattgtttactcatatcgcctgtcatcttgttgcagattcattcaaggctgtcaacgacgatcgagggcgtgccgatgtaccagcggccattcatgaaggggaagctagctagctctacatccacttctccttggaaatccctgactcgttgaaacaaaatctctttctgctcttcctcctgtgtggtggtgctgcgttcttgactgctgtgtgagacattgttgcttccttgagatgacgagccgtatgccgtagcagatggcaccacgaatggagctgtcaatgcgcaattgactcggccgtgtaagcatcgcgtcttggccccccggtgtcgcgatcagaatagcaaaagcgttaaattagacttggcaagtgaacttattcctgttctatatatactccaatcggagcagctagtcggccgggacgggtggggagaactagggttttactgttcctcttcgatcgatcatcactcgcctcgcccatgtcaacggcggcgctggtggcgcggctcgcccgcgacgtatcggccgcgcgagacgccgcccgcttggccgcggccgccgcatcccgcgccgcgcgctcctcggcggtcgcgtcgtccagtccttgcgcacgctcggcggccgtcgtcgcagcacgtcgcgcggcacgctcagccgccgccgccgcatctcgcgccgcgcgcgcggtgtcacgcatcccgtcttataacctcgacgactacagcgactacgagccaactcctgctcctcccagcccattgccatcatgtaagccaatcctcccccatcttattacgggccttctgatccgattgccataatcaggttaggggcatattaggcaggataactttaaggaaccaaattgaaacttgcaagccaattcgctgttcttgacagtattaatgttgtgctgttgtgatagatggtcctgagccagctgacgatgagacggacaaggattttgagactgatctagttgacagtgtgacggacaaggattttgaatctgatgaagccatttgggccttctatgagcgctggtgcaaggcttacgataaggagcgtgaccatgctgagatggctcaccggttcaagatattcaaggaaactgcagagcttgttcatagatccaacaaggatgctccagaagaagagaaactatgttttggcccatactgcgatgggttcgatgagcaacagagggctgaatttctgcttaagtttggccattttcacgggattcacgaatttgtagagcagtggaagatcgacttcccaaagccgcggaagattgactccccaaatcaatccccatgaatcaccaaatctatcctaatacgggtagacggaccaagttctacttctctatctttatctttatctcaactattataaaaaataaagatgtttttgtcggtattttggcacgtgatccgtatttgagtcggtttttaagttcgtttgcttttggaaatacagttctgtgtttgagtcagtttttaagttcgtttatacttctaaaaatacaaaagaagtcgtataagaaatttcttttaaaaaaatgctaacttgaaatgaaagtcaaactcctagaaaaatgctaacttgagatgctcgacgccttcgccaccgccaaacccgctggcacgagcaggagcacgggctaaggattggagagaggggaggaagaagaaagaggaggagaatgacaggcggaatccattggttaatagagtggaatgtgaatagtatgttggaatagaagataaatttgactctctaaatttttatcagcctggcaatatagatatttagagagtcaaaaataaccactccgttagaggcatctctaacagcccacaaacagctagggttgagttgagggagcctggagcgcttccacctccagcatctattcccttcgtgcccgatgcccgcttccacgccgccactgaccgctgtccgcgccggcgccacgccgcgtccgctgttagcgccggcgcagcccagtgccgagccacaccacagcgccgacgcccgtgggtccgccgtccgcgccatcgcggcgccgagctgggggccgacgacgttacaacttctccttgtatcgccagtcgccgccttgctgcgggacgtcggccggttgccgtcttgtcgcagagccgccgcccgctgtctcccgtctggcgtggcgtctaccggtgcccgtctccagctctccgctcccggctgcttcataaatcgatttgtgattcatgaatctgagaatgattgagtatgcactttgtaaattgtggttgttgaatgttgatttttatcgcatttatattaaatttgtacttgtgtatcggttttttggtgttagaaaattttagcatgtgttgtgaacctacgaactgaacttacccaaggaaaaaaattcatggctactacactggcagtcaagaacgcagcatcaccacataagaggaagagcagaaagagattttgtttcatggaccagtcggcgcagaaagattgctatatatccactgctccaattttgttcatctactggtcctcttcgatgaagcagtagtatccatgaaacaaaatcggagcagcagaaagattgttatatatccactgttccgtctcggccgatactactgcatattaatgatatatatatatatatactccaatcggatcagtcggccgggacgggtggggagaactagggtttaccgttcctcttcaatcgattatccctcgcccatgtcaacggcggcgctggtggcgtcgctcgcccgcgacgtatcggccgcgcgagccgccgcccgcttagctgcggccgccgcatcccgtgccgcgcgctcctcggcggtcgcgtcgtctagtccttgtgcacgctcggtgtcgaaacaagatttcggcaataataaaagggggtggctatcaagctaggaaagtgaatgggtttggagaaaaagaattttatacaggtttaggccttcttattcaagaagtaataccttactcctgtccggggatgattccgccgagtatgttattgattgtatgattgggagaaaaaagaaatcgtcccgagaggaacccggacccctccttatataggggaagggatccgtaatacaaaatacagtccatatcctaacggaatatgggattacagataaaatacaatcgtaaccgactagaatcctgggtattttcttgacatacaagtttagaatctaacccgagtcctcataaagatattctatctatatttggtaccatatatccagctggaatataaccgccatgtagatatggggtaaccataatctccacagtagcccccgagaccttcgcagttgaccaaaatagtcttctcgaaacaaaaaacaataatctgagtgcttcaattcaacttgctccggcttaccgagtgctagaagactgtgaagggcgaaaataaaacatggtgcatcgagtagatgcacctaattaggtgtaacccccgactatgtgattagttgaaaaattaaacatatagtcaagaaccgagtgatcttatatcgaagcatgcatggtactcaataaaatacccagccgactgcttctcacttgaatatatcaaggacaaaaaatatgaaaagggccgagtgataaacactcaaaggtccaaaaatagacatgtttgataggaatccgagtaagaatctcataaaatgacccatcaaacatgatagaaaatcatggtaattaatgagtctaatagcctaggctgtgacccttaccataaccaaaataagcatataacatgctgggagaatgactactaacaaaccagtcatctcaaattaacccaacagctttcgtagcctaaaaaagcttacaaaaatggtataatacctttatgttgggcaccttttcatgtgcatcataataattccaaagaattattgaatcgcgttaaaaaggatttcaacagcatcgggccgcatcattgtgagcacatattgccaaagcaaaaagcgcctaagtccctagggatcacaacgggccacgctgaaaacataattgggctgaagtactgtacaggccagggcccattagtactcccgataccctaaaaacaccgaagtccaaacgtcgtttcgtcttccccgctgagactctcgccattttccccatttcctgctacagtacaaaattgcgccgggcaaactagggttcatcaatccgctccaatccacccttaaaaaacttcacgaaatctcttcccgcatccaccgctccgattccccatccctttccagccgtatctcgaactaaatcaaatcatcagttctcattcatggcggaagaaagagaaagcttcgagagtcagtgggcgccctccgatgtgacggaagacaatctgaaggagatggtggcgcacgacgttcttccagcaaaagagatcatcgggtggcgaccggcatttggtgaggcattcccgacccccgatacacacgaaatcgtggtatttgctcatttcttctatggcggattttctcttccaacctcaagatttttccggggtattctgaacttctacgggattagcttgcatcatctgaatccaaattccatagtgcatattgccaattttatccatgcctgcgaagcttttctgggcattaggcctcatttcgccttattccgccgcattttcttcctcaagccccagccaaataagagcaaaccatgcgtcgttgggggtgctggtttccaactcaggggaacactaagccaaaaatacttctccatgcccttcaagacctcaaataaaggctggcacgcaaactggttttatgttcaaaaccccgagcctgttcttcccgagtactcctgtcttcctccagtttatcgggatacttggaactcactgctaatgggagacgaagctgcacaagcagtagaactgatggagaggatgataaagctaaaagaacagggccttcaaggagaacagatcacccggcactttatcaaatgtcggttagctccaatcaaagaaagatctcgcacagccttcgaatttgacggcaagcatgacccaaaccgtgaagatccagattctcttgacttcaaggtcatgaaggaaaggatgtataagctcttctcaaacgccatcgttgtcagctactcacacttgctgccagtcgtaccgttcaatgcattcaatcctcctccaccagtacgtattcatacacttcaatctttctcaaaatatgatcttgttttcttgttgaatcagctaacaatgaaggatattacatccaggaatttgctttgatgcagtcggatcccccaatcgctcaacgccgatctccccaccaccaaactgggcaagggagcggaggaccaagaattcggtctgaaactcaacctagtgcttctgatccagtcggccagtcagattatcgaaagaggaagttggttctaagtgacgacgaagccgatgataccaccaggaggcctgaagaccgagagacgaccaagaaactaccaaaacaagctactccaaggaagaaaacatccagtcgccatgtgccaaagatcaggaagtcttctaggtgcaactcatataacgatctctcttgtattgatacgcacccattgcggcaataatactgataatcaaatttgcaggaaaccatctgatatagacccgtctggaaaagactctgacccgactaacatgggcacgaattcttccaaagaaaccgggccaactgttggggatcacccgagtgacaatcatccggcaactgataatgtagaattcggtgatcaacccccaactggaaaccagtcggccgaagccgaagccggagttaatcaggagcccccgactggaaaccagtcggacgcagggccaagccaagagattctagaagtcgaaacccaagcagacagccctcgcagacaaaacgcggacaataaccagagatctggatctcctttaaaggcatccgaatccgctcgtcctcgtccagaaatcatcacgggtaaacactttgtctgaaaccatgttgacccaaataactctgatcgattgtctaacctttgtcagtgaatacattaggaccaatgattggtgatgaagaagaaatcccccgtatacaagcagctgaggattcatgccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatttcaaccatcttgtttgccatttaattcacgcgctaattaaactatcttgcagaggattcatcttaggaacgaagccaaaacagtaaccttagagaggttagtccctcatctcggaaccctcgaagccaccaggaatcaactgcacgaagtgaaagaacttgctaggaagaatgaacatgatctgagggatcggatcgctgagctccaggaatcaaattttgaactgagtggctcatcaaaaggtacgcacaaactctgctcaactgactcatactgttatctttgcaatcttgattaaccgtgatcaatgtagtgcaagctgccaagatatctcagttggagaaccagattcaaattctggaaagtgacaaggcagaactggcaagacaaagagacctggctttaaaggaagttgaaggtatcaacaatgaatacctcaaaagccattatcctccatatgctaacttattaatgtgaatctgttgatgcagaccgcaagatcaatctcaagctcaattcgacgtcctggttggcaagatcaaaaaactcgaaggaacccgggatgaggttgctaacgctgctgccccaattgttcaagcgatgttcttcaataacaacggcccgagtgtacttgatgcttctgaaattttcgacaagctgagagttgctccggatacatatttcaagaacatcaaagaagctggaagtatgggagcaagtctggcgttggcgatgaccaaatctctttattcgagggttgacgttgatgccattgatggctttgcagacgggacgagcgaagaagctgctcttgacctcatcagcaatgcacaaaaagccgctgacaagattgctgctgatgtagttgagagatttcaggacaccgatcttcgaccgactggtcctgataattctgatgatgaaaagactgatactgattactgtaccaatgattttgatgattaatgatgatggaggcacaatttgtacaatactgatgaatttatgctatgcttgatatcttaacttagttcctgatttcttaaaagtttttgccaaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaaggaaaaacttgaagttagcagtcaaagaggagagatacaaacgaaatgcctaagcgtaaaatcgacgaaggtgttcaatattccaagaattgttgataagagtaccgtcttcgcgcttgagtcgataggaacccggccgagtgacttcagcaattatgaacggtccttcccataagggagataatttatgccgatcctgtattgtttgaattttcctcataaccaggtcaccgactaaaaaggctcgcgatcgaacattccgattatgataacggcgcaacccttgcaaatatcgagtcgactgaattaaagctgcttctcgggcttcttctagtcgattgatgtcgtctactcggccctcttcatagccctcctcgttgaagttccgaaatcgtagcgattcaaattccacttcactcggcaacattgcttctgcaccgtaaaccaaaaagaacggcgactggccggtagcccgactaggagtagtgcgtaaagaccagagtacggacgacagctgatctacccacttaccagcatagggacgtagccggtcaaaaactcgtgctttgatcccttgaagtatcatgccgttagcgcgctcgacttgtccgttactcatagggtgtgccacggaggcgtaacaaattttaatactgaagtcttcacaaaagtcttgaaatgctccgccagtgaattgagtgccattatcagtgatgatccgattaggtaccccaaaccgatgcacaatgttgatgaaaaaatctctagctttatctgctgtgatcgtgatgactggtttagcctcaatccacttggagaatttgtcgatagccacaaagagatgcgtgtaaccgccgactgcccttttaaacgggccgaccatgtcaagcccacagaccgcaaacggctaggacaacgggatggtttgtaactcttgggctggcaaatgagtttgtctggcaaagaattgacaaccttcgcatgtccgcacaatcttgtccgcatcggacacagctgtaggccagaaaaaaccttgccggtaagctttgccgacaatggtccgtgcagcagcatgattaccacaaataccagaatgaatatccttcaacaactgtctcccttcttccaaagacacacagcgctgcagtattcctgatggacttttcttgtacagctcagtctcatgaataatgtaaagcctgctgcgcctggaaatcctctcggcttcatttttgtcttgagggagttcttgtttgctcaaaaattttataaacggttctctccagtcagcttcaatcatgcttacgccttgagcatccatggcttcgactgtctcttttctgggcacggtcggtttataaagatgttcgacgaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcagtcatattatcatctagacatgaccactctttcatgacttgattaacaactaactgagagtctccacggacgattaatcggcgaatgcctaaagagattgcaatccttaatccatggagtagcgcctcgtattccgccacgttatgggacgcagaaaaatgtatccacaatacgtagctcaatctttctccagtcggggaaatcaagacgaccccagctccagtgcctgtaagcctcttcgacccatcgaaatgcatagtccaatattccatcttttcctctggcatgttttcttggcactcggtccactcggcaaggaaatcagctaaagcttgtgacttgatcgaagttcgtggcttgaatgatatgttcaaagacatcaactctaaggcccacttcgcaatccgtccatttgcttcgtgattgtgaagtatatctccgagtggaaacgatgtgactaccgtgaccgagtgactttgaaaatagtgagataattttctgacggtaattaagacaccatataataacttttgaacctgaggataccttgtcttggagtcggctaaaacctcactgacaaaataaattggtcgttggactttttgaatatggccttcctcttcacgctcaacaaccaggaccgtgctcacaacctgagaggtcaccgacacatataacagtagcggctcttgtggatgcggcgaggccaaaactggtggagtagtgagaagtctcttgaacttttcaaaggctttttatgcttcgggtccccactgaaaattgtcagtctttttcagcagcttgaagaagggcatcccccgttcgccgagtcgtgagacgaaccggctgagcgccgccatgcaaccagtcagcttttggacgtctttttggaagcttggcggtttcatgttgaggatggcgttgattttctccgggttggcctatatgcctctttgagataccataaatccgagcaactttcctgacggtactctgaagatgcacttttccgggtttagtttcatcctgaaagcacgaatgcttgtaaaagtttcttctaaatccgcgatcaggtcatccttctgcttggtcttgacaactacatcatcaacataagcttcaacattgcgaccgatctgagttgaaaaacatcaatgaatcatgcgttgataggttgctcctgcgttcttcaatccaaagggcatggtgatgtagcattaggctccaaagggcgtaataaacgaggtcttcaagcagtcggattcttttagtcggatctaatgatatcccaagtaacagtccaagaagctgagtaactcgcagccggctgttgagtcaaccacctggtcaatgcgaggtaacccaaaagggtctttgggacaagatttgttgaggtcggtataatcgacacacatacgccattgccccgtctttttccgaaccaggactgggttagccagccagtcgggatgaaggacttccttaatgaagcctgctgctaacagcttggttaattcctccttgatcgcatcctttctgtcctgtgcaaaacggcggagtcgttgcttgatgggtttggcgtcttccttaacatgtaaagagtgctcaatcacctctctggggataccaggcatatcggatggtttccacgcaaaaatatctttattattttgaagaaaggtgatgagcgcgctttcctatttacaatctaactcagcgcctattacagcagtcttatcaggatcggagggatctaagggaatctttttcgtcttggcatcgctttcttcggtcttcgtcagcttggttgcaggcacttctccctcgcttgtcgtggtcgcagccagtcggatctcttcgcgggcgagaatagtctcgtgggtttgggcgatctcgcaactttctttgtcgcatgtgacggcctgcttgatgtcacttcgtagtgatatgactcctcgaggaccaggcatcttcatcatcatgtaggtgtagtgtgggacggccataaatttagctaaagctggtcgtccaagtatagcatgatatgctgtctcgaaatcagcaacttcgaaacagacattttttgtgcgaaaattttcccccgtgccgaaggtaactagaagagtgatctggccgagtggtgtagctgacagtcctgggataacaccgtggaagggtgcattactcggctttaactccgtgcgaggaatctgcatatcgtccagggtcttacgaaaaggatgttgagtgcgttgccaccgtcgatgagagttcgtcggagcttgacattgcgaaccactgggtctagtaccagggggtaccgcccctggtggaccactcagtcgggatgatccgagcggtcgaacttaattgctatctccgaccaccgaagatattggggcgtgttaggctgaaccgcattgatctcccgttctgttagcttctgttttctcttagactcataagccaggggtccgccgaagatgtggttaagttctttgcgatgatcttggaaaccagtcggggcatcgtcttcatcatctttgttctttgatgtgccttgatctccgtctgaaggtttacgtgcgttcttgacgtattgctccgcgaactgtttgtagacgaagcaatctttggccacgtggttggagttgggatgatgcggacattgggagttctttatcttgtcgaaggtgttgacgcgggaacgttgtcaggatgatggagaggtggtcgccacaagttcttcaggcttacgcttgcgatccttgtggttgttacttccactccctcctgcggtcggcgtgtccttctttggcttccaagtggtgcccgactgtttggacgcggtaatagcatcttcggctttggcatactcgttggctttttcaaacatctgcttaaccgtcctggggggtttacatccgaacttgccgactaggtcctcgtggcgaatgcctttagtgaaggcggcgatgatgacgtcgtcggtgatgtcggagatcttgttgcgttgttcggagaagcgccggatgtaatctcgaagggattctccagacttctgaacaacgttgtagagatcaaattgtgtgccggggcgttcaaaggtgccctggaagttggcaatgaagtgatcacgaagttccgcccatgatccgatcgtgccacggggtagtccgttgagccaggattgggcggagtccgctagggccacaggtagatagtttgccatggccttgctgtctcctcctgctgcgcggattgcgagtccgtagacggtgagccaagactccggattagtggtgccgtcatacttctcaattccagtcggcttaaagctggctggccaatccactcgacgcaggtcattagtgaaggcagctactccatccacgtcgtcgtcgtagcgatttggtgaatggcggtgacctcgcgctgcacggcgctggttgatcatgtcgcgaaggtcgacgggacgctggtgaggtggagagtgaggccgtttagctcggcgctccctgtgacgttcgggaggcgagtgaaaagatcgttcgtcgtgacccctgctcctgcgactagatcctgtgccgatgatgctgaggcttggctgatgataatcatgagatcggaagtgagggactcggctactagtcggggtacgggtgcttgcggagttggctggaaccgaggcagcgatcatggtcttcgtctgattcaagatgttgacaacatgatcagcttggttgagtgtgtcttccttgaggagggtgtcgaggagagtgattgctgcaaccgcgttctgctggggggtgcgaaagaccgctgttccatcgacgtcttgttgcccaatgagctctctcgctcggcgcccagattccaaggcgcgttgccgtcgatctttagcctcctttgcaacccgttcgcgatcttgttgctaacgctgtagtcgttctcgctcctgtcactgtcgctcttcctccagtcggcgacgttcagcttcttgccttgcgcgatcttggtccgcttctcgggcttggcgctgttcctccatttcgttgtcagccatgaatacgccgaagaagaggggcgtgtagttatcctcagagctgtcatcgaagttgtcgaggtcgccatggtcatagtggtagccgaaatcgttgtagtcgaggatctcggttggtcgagaactgacgccgggggagctaaggtaaccatccaactcttccgtcgagactgtcccaagaggttggagtataacgccaacctctctggatctagattggatcggggccgaagccggagctctcctagatcttcgagtgggagatgtcttgacagtgaaaacagcggccaaatcatcaggaagtttcatcaggattgagggataggacccgtcgtcttgatctggtcgcggaagagtagattggatctcgtccgagtggtttgaagccgacttgggagagatgatcttggagtaggcctcggccgagttcggaataccgaatggcacgaggacctggtctctccccaactggtttgaatccgagtcaaggagagagatcttgccgaagtcgttggtgatgaagttgaggctgccgaaccggaacgcctgcccaggaaggaaggcgcagtcgtcgatgccagaaacgaaacccatcgcacttagtcggcgagaacttgacgcaacccctacctggcgcgccaactgtcaaaacaagatttcggcaataataaaagggggtggctatcaagctaggaaagtggatgggtttggagaaaaagaattttatacaggttcaggccttcttattcaagaagtaataccctactcctatccggggatgattccgccgagtatgttattgattgtatgattgagagaaaaaagaaatcgtcccgagaggaacccggacccctccttatataggggaagggatccgtaatacaaaatacagtccatatcctaacggaatatgggattacagataaaatacaatcgtaaccgactagaatcctgggtattttcttgacatacaagtttagaatctaacccgagtcctcataaagatattctatctatatttggtaccatatatccagctggaatataaccgctatgtagatatggggtaaccataatctccacactcggcggccatcgcagcacgtcgcgcagcacgccaagccgccgtcgccgcatgtcacgctgcacgcgcggtatgttacctcgacgattacgatccatcaggtaagctaatccccccaatcttattagagcaagtttaatagtatagccaactactaactacaaatcatctatagctaatgtaatagccaattcatataatagttgcttactatactattaatactcggttctacctgtcatacgcacattacgtcttggagtccgtgctgcagctggctacagatctatagcccgctgctcttctctctcttcgtttatctctttaaaatatgtttatagctggcttatagcctgctattgtacctgctcttacgggccttctgattgccatcatcagggcatgggcatattaggcaggatagttttctttagactagaaaaagtgtgcgttgtaacaggtgaagctattttaatcttattattgttcattgaaattcaccgtgagaattgtttagatatatatttttctagaaaatcatatcaagttagcatgcgaatcttttttttaaagaatttcttatacgactcattttgtatttccaaaagtgaacgagattaaaaccgaacttaaatatggatatgtatttccaaaagtgaacgaacttaaaatccaactcatacacggataacgtaccaaagtaccgacaaaaacatctttaatgtttacaatagtagacatttatgctcgcaaattaggaaccaaattgaaacttgcaagccaactcgctgttcttgacagtattaatgttgttccattgtgatagatgatggtcatgagccaggtgcctttttgacgaattttgatgagtctgctgacgattttacggacaaggattttgagtctgatgaagccataggggccatgtatgagcgctggtgcaaggcttacgataagaagcgtgaccttgctgagatgactcaccggttcaagatattcaagaaaaatgcagaggctcttcacagatccaacgagggtgcttcaaaatatgagaaaatatattgtggcccatactgcgatgggttcgatgagcaagagaaggctgaagctctgcttaagtttcgccattttcccagggtttgcgaatatgtagagtcgtttaagatcgacttcccaaagtcgcgggagattgactccccaaatcaatccccatgaatatcctaataagggtagacggacggaccaagttctacttctctagctatctttatctatatctctattattactagaaaaatgcccgtgcgttgcaacggaatgaaaaaaaagaagaaaattgaattaaaacatattaaattctaatttaatgaaatataaattttctgcaatattaattacactatttgaaattatagcaaaattggtcgtgcgttgaaacgaaaagaaaaaaataaaattgaattagaaaaatattaaattataattaaatgaaacacaaaatttctgaaatatttgggtattttttaagtaggtaggtatataattaaattaatttataagtaaagtaagtgtgagaaataaaatgttatggttggatttattttttattaaattttctatattaattacactcattgaaattttcttgaaatttacatagcttaattgctatttttataatacaaacatcatttcagcatttattgaaataaaaatctaaataaaaatccctttatctctatgggcctttttcagcccactttcttcttcagccctcaagcgaccaaagtctaattaatatccccatactcctcctctcgcttgctggaccaccggcccgcgtacggcccaagtggtttggcccaacgctcgatcgatctgagccgttcgttttaatggacggctcggataagttccaaattgatgagaaccctaaccctccccctccccccgccaagcgggccacctcccccgccccggatgccgcctctcccctccccctctccccattggcgtgcttcccctcccctaccctccagcggacccctccctcccagccgagccagccgcctcgcccgcccccgatgccgcctctccccctccccctttccccaccggcgccgcttccctcccctcccctccagcggcgccgctccctctcctctccccccgtctcaccggcacggcgcggcgatggcaggatgcggcggagacggcagaccgctccctctccccctctccctcccgtctcacggcgtggcgcggcgacggcggagacggcggagatggccgtccctccccctcttcctcttcctctccctgtcggcctcgacggccatccctccctccctacctctcggtgacggtgccctcccaacggcggcatccgcgctccctcggcgacggccgtccctaaggcaagcgtcgacggcgacgatggcgtctgcagcgtccgcgggtggatccgttagcagtggcggcgaccgcgggcggatccggcagcggcggcttcctccggcggcggcatctgcggccaccatttttttcttttgcaatttttttccatcgttattgctaaccaaatcggattgcatacagatgaaaacacggacgaaaattagatgtgacgaaaggaaaaatacgaatatttatattagttattagttatagatatagattaaatgataaaatatgaataatactttatgcgtaacttattttttaaaattttttcatatatattttaaataaaacggattgtcaaagattgtacacggaaacccatgaatcaacttattttgggacagcatgtgtgtgtatttttttttaagaaaaaattgaagctcctactttaataagaagggaaaatatcgtgagttcgtgacttgttgcctggtggccctggtcacagtcacagagctagccttatctctatcttcttctcttttttttttggtgagaacagccttatctctatcgctttactctctctgtccctggctttcttcgtctctcttcatgtcgccggcacatatccaccaccggctccaaccctccccaaccgtggcggagccccctccctctaccccggcgcccgtccctccgggctccggcatcctcctgcctatgccgctcggcccgtgcttcgtcgcaccgctgccagggctctcctcctcctgctcagaggcagttcggtgacgagcgggttggagcagcctcgcccctcctcgtctggatccagccgcaggcatggccacatcgccggctcctctactgctcctctcctccatctccctgcgctcaccgttcctgatgagggcacggcgactcgaggcgacggctgcggcgactcggtcttccagactcgtcccgccaccggctacggcctcaacgggcgatgacgggcgacctagccgacggatccatcggcgtggaggtctggggccgtcagatttagccgcatccgacctccatggtgacgggctgacggcgacagcgggttgcaggtgcgacaaatgcccctcctctcctctactttccctcggtggcttggccggtggatccatcggtgtggaggtcggagacaggcggatctgggagatgcgatggtgacgccaccccgtcccgttcttcctcccacaccagaagaaggagcagtgatgataatgaattactcttgtgctttgttgatgtttattcatgcttttttttctaatcttgaggatctgggttgttcatatgttaaaataaggatatggggattattgtttgttgttaatattttcaccttcaatttgaggatctggggcattgtattgggggattggggcattgaggagtcaatgaagagaatcgggctcaataaaatggctcaattcgagccagtcaaggttttttctgtgtgatttttatttttattattcttcctgtttgtagttttctcttcctctgtgttctgtgtccgattggattttgtaccgatctttaaacttgtgcaatatcgcttgtgttcatggcgcgtgggaacacaggcctcgctcgatcggacatacgaacgagaaattaatgtgacgaaaggaaaaatccaaatcttttaattagttaagataaaaagaaatgaagaggtttttgtcggtattttggttcgccaccgctagccaatgaataaaatgaataatatgttttggtggtccattagtctagcacacgcgtgcgtacgtcgtctatcatccgcattccacgcgcgtcgtcgtccgagcgaaaccagataggtttccacttcccaatcggctgcctgtagcacacgatcgcaaatttgattcagatcagaattctcccacgcacgtttgtgccgttaccacgtcagcaggccagcacgcgcgcgatcgtagttttggttggaatcacgatggatttttctcgatcacctaatcccatatattaggagaagtgtaatgccggtctttgtcgtccatcggctctggacacggcccacgtacgggtgctgatcgcgtcggggccgtctggctcgacgtcaatggcgattggcgagatcggcagctgactaggctgtgttcggataccccttctcctaacctatcgtttttcgcgtgcacgtttttcaaactactaaacgacatgtttttttaaaaaaagtttctatacgaaagttacttaaacaaaattaaattcattcatttttttaaaaaaactaatactttattaataacgtgctaatagatcactccgttttctgtacgtagttgcgaacaacccaccccgccacaccggtctcgacaggatgtaccgcgttgttgttcacgacatgctcgtgttctcctttgacccgtccgtaccgtttcccccgcagatgctgatgtgcctaaggatgtgtttggataatgagaaatggggggtgggattgggattgaaaaattaatgaagagttaggattaaatgaaacatggagaataaatggttaggatttaaagataggtgggaaatcatttctctttctcatttgccaaacacttctaagtgtaatgattaacagttcgatgcatggatatgtccatgtgaacatcggagaggacgaagtttatccacgaggaggtgtcgcccgagctgcaagcacgagctagcagcctttgttctgcagaagtttcagccgcggtggcgagaggatggtgccgatcgattctaactttctaggattacctggtgtgtgcagtgtccgtctaggagcctaagcgctctctctctctctctctctctgtctgtgtgcaaacggttggcatgctcatagttcgcgtgcagggcaataccgatggacatgaagaggcaacagaattcacttagaaaaatgctttgcatgcagcatcaaaactggagcagctaacatccagggtctgtttgcatttcgatattttctcctggaaaaatttgatctaggctacgatcacatcttacatttatcgttaattaggatcaaatttaaattaaaaaaaatgtccattggctataaaaagttgtagataattccatgttaatctaaatccattggctatatgctaaaatccttacaatccacaattatatgctaattttgtaccaagtcttactctgcttctatttccgctttcctcacctccccacactacataagccaggccaaccaatagcaaaaagattcacctctgtctctttaaaatccccacagccacgctagctttcgccgttacaattacttttgtcttctcgtggtagggtctaactatatccgtcttcctacatagttggtacccactacatcattaattcctataaaacttgctccaggttggtccacgtcatcagtttttttgaagccgtccgatcaaatccaatgttccagcatcaaatgctatttgctcccaagcaagacctaggcggctaggcccatgccgtttggccttccaccttccccttccgtctccacacggaccacacaacatccaacaagaatacaagtgatcgcgcgacccatcgtcgtctatcccctaacctagccaaatgatagatacgcaagcacctgacaaccgcagcatgacaagctttcccatgatcacccgatgcgacatgcccatgcaagccaatgcgaggaactgatgagacatgaccgagcactctgtttcgcctcaatatatactgacttcatgcgtgagccctagatgattagtttaatgtagatgggtaaaagagttagagtatggtctcataaaggtaagatatcttttttaaaatgaagataccatgtttaaagtgaaattgattaaagggtgatttaaaatggaacaccggtaataaaggtaatcccaaagtgaaatttaatgttatggtagtgtaggtgctagtgccgccttccatctctaagacggagggagggtgttgcatccttttgaaccaggttgccgcgtcatccacctcaatgctggaagttgtagggactaggaggttgtcaccgccgtccacctcaatgttgaaagtccaccgtcaagcctaagttgtagggactagggaggttgtcaccgccgtccacctcaatgttgaaagtccaccgtcaagcctaagagccgttccacgggaggctgcggtgttgtccctcccgagaatttgggagagccaaataatagttgttcacattaccattacttttccatgatccttcttttgctttatggtggatccttaatttgctggatggtacatgagtgctttattcagtagatgttcagcgaaattaatttgaaataattttctttatccattttacaagaataaacgattgttatcccattcttaaaaaaatagctattatctctgtgataaagctccatatctatcgtccgatacaactaaaaaagatcagatgttgcgatgctagcagtaggcccacctccactttataactataccgagccttctagtccccccttatccactctctcactcctttatccgctcgttctatgcatctttctttctctctcgatgatccttgcaggggatcaagcgaaatagctcaccattcgacagcaacgaggcgtcctccccatgcgactatctggcgggcggagtttttgttcatccgaatgatgacgatgactcgggaccagcaacggcagggtgactaagatggctcgggaccggcaacggcggggtgagtaagcctcggggtctccgtggagcggcggctacggcacctcggcggaatagaagagcctcgcatgtcccggtctagatctgcagcggagaccaaaggaaaatgtgatcactggagaagaggaaggaacccaatctagactagtgcatttttctgattttcaatgtttcaaccaatgtaagtatgatgtttcttggggaatcaaaatgtttcgctgagtagtttgaatcttgtttcatcaattcttgcatattcgttgctgttttagcagctgaagctcgatgttccgtttgttacaacggattgtttctatcatcattcacaaatgttttatttagtgatgaaacttttttctgctatcatgattcacaacatttaatagattggaacttttttatttagtggtgaaacttttttctgctagaaatgaaacaacgcacgattttgttccttttaggaacaaattgggcgtctgatttgtagtctctcactatctttgcagttgtagttcaatttagtttaccattgctaagcaggagcctcttctttcatgttccatgttgttagatcccgacaccgggggccctgacacagtgcatgaccgagcctcaacgagttgcaccgagtcaaattgcgcattgacagttccattcgcggtgccatctgctactgctcatctcgaggaagcagcaaatcctacacatgggaagaacgcagcgcactaacacacacaggaaggagaagcagtagagattttgtttcatggaccagtaggtccggttgatgtacgtcattaatacgcagtataaaagaccaaaagtagtatcacatcatcatatgcctaacatggaaaacttgatagtattatcgcccctagagcggaaagaaacaatttgtcgccgccgtcaaagccgtgcagatatgtatgcacggcgctgcttgctgcttactgctgcgcgcactgcacgcgctgggcgccgccgccgtgcatgtcctcgtcctcgtcgtatgcctcctgctgctgctgttgctgccgcctcctcatctcctcctcgatgttcacgtcgtacggcatggtctcctcgcactcgtcgagctccatgtcggtgtactgcgacaccggccttggcgggaggacggtctccagggccttgcactggtcagggttcaaagagtcggggaattccacggagaagtggatgtagagcttccccttcatgaatggccgctggtacatcggcatgccctcgtcgttgacagccttgaatgaatctgcgacaagatgacggccgatatgagtaaacaataaaatagtttctaaaatgaatgcttaaaaaaacaatcagatggtttccaaaatgctgctactctatggtgatctttctttgaagggagactcaccaggcttgacaacttcaccgggcttggacttgataagcagctgcctgttgtccaagtgagtgagaacaaactggaagccacaaagggcctcagtgaggttcagggtgtgctcgtagaagaggtcatctccctttctcttgaacttgggatgctccttctgctggaggacgaagataatgtctccagtgacagtatcgggctgcacaaagcacaggttggtcagtaacagtgttgacaagcacatggagtactacaccttagaaccatgtactgtacaatgcgaggagtcagaacacagacataccgcttcatcagcctcaccagggaaggtgatcttctgtccattctgcatgcccttctcgaccaccacctcaagaaccttcttctcctgcgccaccttctcacccttgcagcctgggcatctatccttgtcgctgatggtctcaccagttcccttgcactcattgcagggatgttgcatttgctgaatcattcctggccccaactggcgaatttggaccttcataccagaaccttgacaaccagagcacttcatggaagcaccagatttcgagcccttgctgcaagatgagcacagaacagtgtgagatatcagaatagtcaaacagtttatgcaatatttaggacccacaaaaggaagctgatgacatacccattgcacttggagcagagcacattgcgagaaagggagagcttctttgatgtgccattgtacaattcctccagagaaaccttcagagggtgaaccacatcctctcccctacgctgtctcctgcccctactgctaccacctgcagaccacaatgagagccagtcaaaatctaagcaaaccacaatcaccaggaggttgaattgagctgcttctcatgtctcgtacctccaaagccacctccaaagaatgaggaaaaaatgtcaaatgggtcatgcatcccaccaccaggacccatcccctccttgagagcatcttcaccgtactgatcatagatttcacgcttctcagggtcactcaggacttcataagcctgagccaattccttgaactgaaatgaaggcaagaattttagtttgccatctcatcaagaaagctattgtccccatcatacagcttaaccagataaagcattggcaattcagtactcataaagcttaaccagtttactcataagatatcagcgataattatgaggtaaaacaatatatataatagaacacaccagcctgtatgccacagtaactaggctcctaactatgacaatgcaggatagatagtacacatggtcacaaactcgcaatacaaaatcaggttggcacttggcaggtgacgatgtaatgtttgcatcagccaaatgaacaatatctcacatcattctcaatactacttatcactagaattggctatcaattagctgaattaacaagaatgttccaagaccctaatctgtcataatcatcagcaaagcccctaaatgtgcatatcaatagttaatgaatagtacagttaaaaacatacaaaaaatagatgatctcaatatatgaacaagtaatggaattgcatctaaggttcacatggttttggttgattggcaagcaattgaggaagggcaacttatcatcaacagctaatgaatagtacagttcaaaccatagatgatttcgatatatgaaccagtaatggaattgcatctaaacgttcacatggttttcgttgattggcaagcaattggggaagggcgacttatcgtgct

SEQ ID NO: 65188 - DNA, 2215 bp, Oryza sativa
cggcgcgcgcccgaacatctcgtcgccctcctggtgggaaaaaaaaaggtcgaaaccctagctgctcgatccggcggggagcgtggtctcgggttggaagcggtttgtgaggaggagagaggaggggtgtagttatagcggaggaagaaacgggtggcggaggagtgaatgctctggaagctgcgtgaagcggatgcggcgggcgtggggccgtcggatctggatcggacggtgggggttgcagcttccagatccttccggggtcttcctgcgagagggtgggggagaggcaatgcgggttccggggaagggaagcgcgtgtgtccgcgcgtgttgacttgactccggtttcgggttgcgtttgtcgggtccggtgcgacgggagcaacccggtaaggagattccctctcttcagagagattccttttttcttgccttggcgatgcttgcttaccttgcgctgtcgagaaaaggcaaggaaagtatactactaatatggttggtttgtttttttatttttatcaagtttccctggatttaaattgttttcgaatactcctataggattttttttcctcacttttttgtgattattatttgtgcattatgtgaaaaacgtttatattcattttttcatgttttttttagaaacatggaataaacacggacactcacaacgcgcgcacaatttcccctatacacgcacactctatctctaagaacacctataaaatattgagattgacgaagtcactatatgcgcctcaccgtcaacggtaacattgcttagcactgaaataataaataatagatagccgtaaatacgatcacccatatcaaatctaggacttgaaccaaactaatagagctacactcacttcgtatctttttcatggttattatatgtgcatcatgcaaaaatggtggctgtgttttttctgtttttaaattctttacaagaaactttatgcttcataagcgacgagataattttctccattgaagagagatttgtgacgctttttttcatttgcacatagaagacggagatagcgacaaatgcctcaccccactaaacacatgttcataagtgtgtaatactcatggacacgagaatttaaaccatgatggttagattataatcatcctccctcgaccccacttgcataccaccaatttttttttcctgtttgagtcactggccttctattcgacctcactgaataaatggaaccttttctaatcacacaattaaatgcaacttttcattttaaatccaatattttcacttttggcttggtaaattcgcatttgtttcgctttgtaccaccataactctgttctcgagtcgcatatagtctctcatatgataaagggttgcttgcatggaaattaccgacatgtagccgccaatacgcttaaaggcattgatgcgctcgagaagaaagttcaagatagttcggagtgtaagaaaggaaaaattacatatctcaagtgtaaagatcaaatatagggtgatccaaagcgaattttttgcgggtaaaaggtgactcacactgtaaaaattacccaatcttatttcatataagtgaaagagcagattgttattcgagctactttcctcatactttaggttcttattggttgcccatatttactaataagccaaaatggctcattagaaaataaaaattagtttttaggtaaaacttttatatatgtgctcttattgacttaaaagttaaataacactataaaagaaactaagttgaaaatatcttaaaatcaattttaaaattaagtttggaaatttaaattttagttttggctttgacttattaaggcaaccaatgaggctcttaacttagtacagtacatagttaaaccagacggagtacgatcaggatggtcattctagcaaaataaatatactatggtccaccacgtgtaaaagaggaagttctacggttatacctcaagggacaatgcacattggattaacaaaatggaaaaaatatggagtttatactgtttaagttaccacactttacagtgttatttgttactctgggtgtgtttagttcacgctaaaattaaaagtttgattgaaattggaaagatgtgatggaaaagttaaaagtttatatgtgtaggaaagttttgatgtgatggaaaagttagaagtttgaagaaaaagttaggaactaaaccaggc

SEQ ID NO: 65189 - DNA, 6201 bp, Oryza sativa
cagaaaaaactgaaaggaaaaacttaggagtatgtttttcagtgaggaagaaacaaaggaaaagattcggtggataaactaatagcttgtcatggtataggacaggtaacatgacactcaatcaagatccttgttctgtagaaactagagaatctctgttcatttctgaacaccggctattaatctgagttctaatgccaacatttccaatttaatcacgtgattacttatgcaaaccacccgaaaacagagttcagcacggcattatgaacatcccatccataaccatcatgcgccctgtcactggtgtcatgtcagttttcggtggtgactcgcatgtagatatcccattttattgccaactgaacccatctacttctaataaattcgcattttgccaaacaacctgaaatcttctcattttaagtgactttaattcgaggcagataaacggatttaattagagatattgagcttaagatcacaatctctgaactttctgaactctgaagtggtcctgcggcctctgcctgtgtagggaagcagtggtagcagttgatgattcagctctcggcttcctatgaggtagcaaaagacattattgaaaagaagtgatactaaatgccatgacatgtttaattgatggagcggtaatggtaatagttcttcactcagagttgaacagttataaaccggtggcactcgtaaaaacctactagtagtaaatgtagaaaacaataaatgtgaataattgtagcagcagcacgaacgtagaactacatgtttcagatctttaacctgacaaagcaaatccatcttgcacagtgcacacttcggtagtaaaatagtaaaaattcgtagtttgcactagtctgaatgactcaattagtccgaatgactgaaattccacggggaaatctccgaatttgcagctttcagctcgaacagtgcgagcacatcgctaattgctgaaattccattgttgcgagtactatactaccaaagaatttctttctctttcagatcataaagatcactttgtccgaaagccaggcaaagatgcagtgaaaaactagagggtaaacaaaagagaacaacagcaatggcttggctttcccgacaacggggggcgcggaaagtgaaacgcaagaaaagcgcggtgctttcttgcttatttttatactagtactactactaatcagctaatcaatctcatcctcctctctgcagcagcagcagcagagcgtgccacactgccacgcacacaagcacaagcccaccgatggcagcaataatgcgcacgcagtggtggcagctgcagctgcggcagtaatggccgggttcccgggtgttggtggtggtggccactactagtagagtagagtagtagcgaggtggcgtgatgatccgggaccgggaggagtagagtagaccacccttgatctgcaaggcgcgccgctcattgggtggccagcgtcgaccaccgttttcttggccccgtctcgccgcgatctggtggtgtgcgggcacggctcttcttgccaagaagaacacgcacctagaagttcttggtgcgtgttctttgggtgattttgttttgcttcttttttgtggagagatttttgaggtttggattggttggttgctgatgagaaagattgcggctttaggtttttgtctcggttgaggggcgcggcgccatgggcatctcggcgaggtggctcaagtcgttggttgggatgaggaaggtggagaagcagcagcagcagagcaaggaggatggagatggtgggcgagtagcacaggttctctcatccattgttctgctccttgtccttctatttttcttggcatttttggttgattttgatgggggtagccgggaattcgactagttagttcgtgttaaaattcgacaacaatttgctgaaaagaaatggggaagtgaatcttgatcatgtcatggggaattctttgttgtagtgatcaacctggggtattcgttctccgctaaattaagactacagttggtacttcttgcattgcttgtttgccttgtgtaaatttatgaagttactgcagatctggatgataatatctgcatcatttttttttggcttctatgccactgacaaaaatgttgaaagatggaaaccactatgtcttttttttttttaaagaaatggaaaccatcgtgttaacaatttagcattgcattgttcgtatataataacttttttttatttggctgggtttgtaataacttgtgaactgtgaaattgcagaaaagggacggtgctaaccattttcactgccaaaatcagcacggtcaagaccatgataaccttggagcaccagaagagtttcctgatgaaaatggtccatcagaaggtgatagcaatgcactttcgtgctcggaacccgcttttagttcacctaacgtgcctgtgcctcagactgaagaagaactcaaggagatctgggctgctacagttattcagactgtgtttagagccttcctggtattgatgctctctctctttctctctctgccaatttagtaactagtccaagtccaatgcaaagtatatgcaaacatagaattgctgaaatggaattatggattttcccatgattcccaaatgtttggttcttcaggctttactacaagtttaacttgaattctcttcaggctaggagagcccgtcgggctttaaaaggactagttaggcttcaagcccttgtaaggggtcatatagtgagaaagcaagctgctataacactcaggtgtatgcaagctttggtgagggttcaagcccgtgttagagcaaggcgagtgcgcattgctttggaaagccagacggatcagcaagctattctacaagagaaaataaatgagacacatgtgcgggaaatcgaggtgagtcgcactttcagtagttttccaggtaggctagcatgcatgctcttctcaattttcacaaggaaataactggcatgaaagtgcagtgatttggcttgagttgtttacttatgctatttaccttaaaaatgcaggatggttggtgtgatagcataggatctgtggaagatatccaagcaaaactattaaagaggcaggaggcagcagccaaacgcgaacgagccatggcctatgctctaactcaccaggtaactttatcaaacattttacaccaggacaatactcagctatgattatccaattaatcatatgaaccatggattatagcgtatactgtagtgcaccaatcaaattggtctgcatccaagtatagcttcttgatatcatgaaagtaatcgactcactgtcatctccagcatgtaacaacaagcatgcttgctaagttgctattgctggattccaaacgttgctttcatggataacagatgatgttgtctctccctccaagttagcctaataattaggctgcttgttgtttccgactttctgtactgttctgcttctgttggttagcgtttaattgtaatttcagtatgtagctaagatgagacctatttgcatgctccttctggagaaaaagaatccaatcatgataaatgaaattatttagacagttcaccgtatgttggagaagtaagaaaagggagcctttttccagtatgtggttgaggtcaaataattttttcatgcagtaaccccttccagaaataagatgaattcatatctctaaaagttttcattggttcaggtagtagattaagaatttttctagtccttcccatcattgatgtcagatacactgtcccaatgactctgtaagaactgatctctcatcagttgtggccacatctcaagtcactttgtgttggtctttggtgtgcttccatactttttgagggcttaattccatttctgataataaaataagacttaaagggaggtcattaaaaaacttgacacctgaacctattttcctcctttcgcagtggcaagcaaggcaacatgcagccattacagcatttcaacctgacaagaacagctggggctggaattggctagagagatggatggctgttcgtccatgggagagccgattcctgggctcttatgcagcagatggaattcctgttagtagtggagcaatgcaagacgaggaaaatgctgtctatactccacataagaaacatgttagaagacaaacttcaacacttcattcaaacatactgaaccagaagacctgcctaccaaactcagagggcggtggttcctcatcgaaccggtctggtggttcggcatcggctaagtcaaaactgaaactgtcatccagagaaggatgtgatgaaatttcgtctcgtccttcgggacttggaactaggtcgagtagtaatcctaaggagaggactgggcatttagatcctcaaggaaataagagattctccttacctgccagctgtgagtaaaaatctcgcatcatctgcatgtgttcatgttaagccttttctcctccttgtgacataactgaccttatctagtatacaatgtttcttaaggctcaaactcatacacttgcaattttctaaccaaatttccctaactctcaggtgtcgaagcaggcaagcgcatgacgaataaatctgcggttaaccggtccctaaaggtcactaaacatcatcttgccagttcaattgagttgcctagaagagttgagctgcagacttgacagccaatccaattatccaaagagcatccatagtcattggcaacattttcacctgagatatcgttcatggatatattggcagccttggactgtgatgatctatccaatatttcaagaaatttgctttgcattcatcgcagcttttcttggccatatagatatgcaggctcaactgaccatctcatgagagatgagaccagttggtagaagtacaaatatgtgtctgagaggagggaaccgtacatatagagttttactatttgtttagtgttgtagtacttgtaaggtgtaactaagactatgtaatagtaacaactttgtgtttttgattggtgtacctatgaatcgtgttggtccatgccatgctactggtacagtttttatttgagaaacgattttgctatatctcactcgaaagattttttcttatctctcactcgattttctcactcaaatttacagtgcattttcttgtaagttacagtgtaatttatgaaacttacacggtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactccctttgagaaattctattgttttgccattgaaaagttatccgttctaagagcaactcatagaatggccaaatggctggccaagttaaaatttagcaagtatggagaaaaaataccctccaacaacctccaaattgcacctctcactaacttggagagtcaagagtcactctgcctggctattcgtgggccccaccactctccctcccaccccatctctctctccccgtcgcacccgcaagaaggcagcgacgggaaccgcacgacgacgacggcacggaggagcgaggcgccggagccaaccgcaccggccgccgccggccgcgcccgccgccgtcgtccgcgacggctaggaaccgcacgacggcgacggcatggaggagcgaggcgccggagccaaccgcgccggccgccgccgtcgcctgcgtcgtccccagccgcgcccgccgccgccgtctgcgcctaccgccgcccgcgctgtccccagccgcgcccactgccgccgtccccgccgccgctgtccgccgccgccgccgtctgcgcctaccgccgcgcgcccgcgctgtccccagccgcgcccgccgccgccatccctagccgcgactgccgccgctgtctgcgccgaccgccgccactgtccccagccgtctcgggagtgtatagagggagagagagaggaagaggaagagggggagaaagatgaggaagaatgggtatagaggctgatgcatgggtactgctgtcatagactcaaaatagagaggatggatgaa

SEQ ID NO: 65190 - DNA, 8157 bp, Oryza sativa
gtcgcgcccgaggcacccaattcgcgccggccatggcggtggcgacgctgtcgtcgaggtcgaggcgcgcgtgcgcggaggcggcgtccgtgctcctcgtcctcctcgtcatcgcgccgtcggtggcagccgggggcgacaccaacggcgtgtacgagccgtgcgcggacgcggcggtgcagcgcggggacgggttcaccttcggcgtggccttcgcggcgcgcggcgacttcttctccggcggcgtgcagctctccccctgcgacggaaggctgtcgctggcgtccaagggcgccaagctcgcggtgttccgccccgaggtcgacgagatttcgctcctcaccgtcaacacctccgccgccggtggcttcgacccggtaactaaggccctggtcgacttttcacctctagaagcttcgtgttttcatgcttaatgtcgatttttatgtcagatggtgtatacacacgaggaaccctaactgactgcacggttgcgtatatcaggaacccgaagtttggcataaacgcataaagaactagtcctctagtttcttcttttttatctaattttatatagacacaattccttttcaataaagaatttatgctgtcagtttcgtcatgcaataggttttagttagaatcaaacaccctaattgcctagtgagaaacagagaaacgaagaacttgccggtgaattgtcaatttgtcatgaacattggcaatcacgacctgcttggggaggatgaagacaaaagttggggggagctggattatgtgtcccatatggattgatacagcaccattttttggactctttgtaggagctctagtaacacagatggaaatggtcccatgaacatgcttctctgtttttctgtgggccaagtgtcggtttatctgctttgatgatgaaattattcaatgggttgtgctctatggtttggaaatttttattctaattgattgaacatagagaagctacagtactaccgattgtttaattaccaacatgtgttaaaatggtttagctgtgcttgacattttagataagggctaatcatcacgatggaggccatcattttctgttttctacctgatttgttgatcgcagttttgttcatattacactacgaaagttactcctattgattggccatagcatgtcaaattctcaattgcaagaataagcagtgctattgcgtaagaatggtttttgttgtactgttagaagattactgtggtaacctgcggttaatggcaaactgttgcgcacatttttcactgtttcggccagcaaaccacacaccatcttttgaagcatttagcattgttgtagtggtactttcttacccataagtgattggtcttcatatgattgtccttttttttaactgtttttagctcaatataatgaagccacttgtgtttctaattggccactattttgctatgtgccaggcaacttctggtggctacatggtagcttttgctgggaggaaatatgcagcaagatcacctccggttttcgtcagtaacagctcatacaccgtgaccagctttaccctggtgcgatccataacccgcaccctgcattctgaacattctatcttcacctatttctccaactgatcattcgaccaactgaattctgtttcttaggtgtttgagttcaacaaaggcacacttcagaacctgtactggaaagccaacggctgctctgcttgctccgggcaaccctccttcacctgcgtcgatcagaactgcgcgatcagcacggcgaactgcacgggcaagggcggcagcgtggattgcagccccgggattcagctcgccttctccggcactgacaagcacgaagccgtcctcaactcgtggtatgaggtgtccaagctccggcagtactccctggttgggctcttctccaacctcaaggactcactcaccagccagttcagcatcttcttctagctccagcatgttcttctagctttttcgagctcgcatttctcttcggccatcttggtgtatatgtcagtttcgtgttaaggtaataatgttatctatttatatatagtccagtggttgctgtttgtaaagaaaaaaaagacgacaaattttgtaaatcagctctctgtgtatgtacctggttttatatgagacgatatatcagttagggcgtgttctaacggaatgattggacttcttagctacaattacttgtaaggatgaactaaatattttatagtactcccttcgttttttaatagatgacaccgttaacttttggcatgttatttaaccgtttgttttattaaaaagaattatataaatgtcatttattttgttgtgatttgttttattatgaaagaactttaagtatgttttatactttaacatgtttatactatttattttgaataagacgaattgttaaacgttattctaaaaggcatcaacattatctcttataaatttgtgcgttcgcgaaaaaattatctcttatataaaacggagttagtataatgctaaaaaaatagctagaacaagttgtataagcaatgctgatgcagaattttctctgagaaaatcgtttgagcataacacaaataatccatatctttcataagttcttttagaacacgccttaaattttcgcctatgactttactgcttttctggagaatgaattgcatcgcacatagtcgaatgctcgaataaaaggataaaatgcagtttcaaatgcaatgatatttagaagaatcagatatgtataataatcaagacgatcaactaatcatacagaagtaattacaatcacgaaagaaaaaacccgacaaaaaaatagaaatctctcactatgaagtatgaactcaacatggactatcatacgaccatcatgccgttggcggcggcggcgacggcgtcgccggcgccggcgagctgctgctgctcttgttgttgttgacgaacttgagcacgatggggaggacgacgacgaggatgaggacgagcaggatgatgatggcgatgcaggtccacttgcgggtgctcttctgatgcttccgcgccaccaccagctgctcgcggccgcggtcgacgaaggagcgcgcgcggccgacatgggtctcgatgtcgtcgagctgctccccctgcgccgccaccagcacggccatgtcgttgaacacctggtggagctcgagcagcgagcgttccagctccgccacggcgccgtgccgctcctggatctcggcgaccacgccgagcacctcgccgcggccctgctcggcgatcgcgcgctgcaggaaccgctccccttccccggtctcggcgaggttgtcgagcgtcgcctcgtcgggctgctcgccggtgacggtgtagtaccgccgcgccacggtctcccggtactcggaggagatgcgggcgcggagggaggagaaggattccatggagtcgcggagcttcttgcggaggccggcgacgacggaggtgcgggtgcggtcggtggaggagcccgggccgcacccggggacggagcggttggcggcgttggcgcggtcgagcgactcgaggcggagcttcaccaccttggccttcttgatggcggcggcgacgtcggcgtccatgcgcgcccgcagcgcgcgcaccgccgccgcgtcgtgcagcgacttgcccccctcgttggcgtcgtggagcgaccgctggatccgctccaggtcgcggagctcgtccttgatcgactccacgtcctcgaagaacctatcaaggctcgcccccgccgccgcccccggcggcggcgccatctccacgccgccgcccgattcaatatccccgtcgccgccgccgccgccgccggtgcgcttccacgagctagagaagagattgttcatggctgcagcaactcactagaacacaagatcggccacgatttgctccggtttcttggatcgggaggagggaggagttaagaggggggaggaggaggagacgcggagttgaaggggtcggaggggtctcgtctcgttcacgcgaggatggagttgaaatggcgacgtgaggtggcgcgggggggagggattgggaaggtgggaggaaggagggagatgagatggccgcggcgcgggcgggtggcgtcgcgactcgcgagcgccgcccagtccaggcctccctcgtgtgcactgcccgcgcggcgcttgatcacgcggtggcgtgtggtggcgcgccgggggcgtccagattgtgctttgtttcaaacctaaccacgcaacctcagaggggccggtgcatttaacttttttttaccactttaaagatgcgataattaagaatttacgtctcacgattttttatatggatccggtgacaaacccttaattaaccatttataagactgacaaatagttaaatatctttctatgaaacggagcacggatttcattttattttgtgaaaaaaaataggtcatgttttgcacaactccagatccacgacatatttgaactttgtacgttacattaaatcataatggtttaaattttaaaattaatttaaaatagaaataaaatgatatatctaaatattagcaatgtaatggttgatttattagatcataaatttgtaaaactagaaattaccggttccgaaaaatcttggaacccgaaccgtataaaaagggccttatgaaagcttatcaggtaactgtaaacttcaaatcatgccaataaatttgtcaagagtaaaaaaaaaaaagctactggtagtattataaaactgctactggagtttgtaagactggagaatggagatgcatggcatcaggatcagccataagccgtaggcgatcattcagctggtcgtttttgaccggatcaaccagagcgagcaagggcacctgtgcatgcaagtgtgcagcttgacttgaccacgacaatataaaaaggacagagaacaaaagaccgaaaataaaaccaagtatgggtgtgtttagttcacgctaaaattagaagtttggttgaaattgaaacgatgtgatggaaaagttgaaagtttatgtgtgcagaaaagttttgatgtgatgaaaaagttaaaagtttgaagaaaaagtttggaagtaaactcggcctatatacataataattccatcagttgcagagttcggtccctttgattcaaaggaaattcataggaattttcttttagaggatttcattcctataggaatttttcctacaaagccctttgaatcaaaggaatgaaccctatgaaatcctataaaattcctatggaatgcctcttcccatataagttttggaggaattttaacaagaggtagaaccttatggaaaaaatccttcgagtctttatctctcctcaaattcctgtgtttttcctgtggtccaattaaacggtcatttctatgtttttcttgtgttttgcaatcctctgttttacacttacattacatttctgttagaatcctatattttttttatttacacttacattacatttctattagaatcctatatttttttattccttcatttttttattcccgtgatttaaaggggcccttcgtttatacaacttgctgggttggtagttggtactggtcgtcatccaccgttggatgtctcagttatcacatgccaaactgccaatcatggatgaaccctcgcaattctgcttgctatgctatgttaccacgctacaaaccaaccgggtcaggccaacccaaggcggcaacgctgaccgtctcaatcgatcacaaggacgtgaacgtgacgccttttgattgattgccccacctcacatgtactataatactccttttatttttccatttcaatataagaattatgaatataaacgacatgttcagatttataatactaagatataataaatttaaaagctgttacatattataacagagaaagtaacacatttggatgtcgacggcgttgacgtcttatttgtttcgtactactaacttcttttaattttttataaggcgttgctttcttcagcagagggagtactaatgacactattattattgctagtactactcactctgggattaccatagtgatgcgttgatgtgctctctccgttgacctctccttgttttgctttacgagctttgcatgctgttgaggattctagcaactgacgcacatgtgcatgcgcaaatttcacttaaagcacccgcaatggttatctatagactctctataagagatccacgtcagtatatttttctatttgcaagatattaaatgaagagatagagcaaaactatctactaaactagagatagtctatagagaaaaacgagacaatacatgagagagctatagatacccatgtagacatactattgaggtggtttactattaatctagtctattgctgagatgtacatgttttatagagagcaccttactttaccattgcgggtgctcttatccaaccctcatagattgtacagagttgcaaggaacacttcagggggcagcactgaattgcacagacacaacaatatatagaaaattgacggataatatgatttttgcgatataaacgaatgaaaattaactactactacagagttgaaattttgttttagaaaagtatttcaagaaaattttatatagaatttcttttggcatcaaatactccgtttagtagggaaacatgcaaacaaaaatctaaaatctaaataatactccctccgtttcaaaatgtttaacaccgttgactttttaacacatgtttgaccattcgtcttattcaaaaaaaatttctgaaatatgtaaaactatatgtgtacatgaaagtatatttaacaatgaatcaaatgatatgaaaaaaaataaataattacttaaattttttgaataagacgaacggtcaaatatgtgttaaaaaatcaacggtgttaaatattttgaaacggagggagtaataataaaaacaacatggccgatgtaaatgcacggagtcttacctgttcaagcagaggtgaagcataatggaggtacgggtggattttgcattcatggctatgtttagatttaaacttttttcttcaaactttcaacttttccgtcacatcaaatgtttagatacatgcatgaaatattaaatatggacgaaaaaaaatcaattgcacagtttgcatgtaaatcacgagacgaattttttgagcctaattatgccatgatttaacaatgtggtgctacagtaaacatttgctaatgacagattaattaggcttaacagattcatctcacagttaacatacggaatctataatttattttattattagtatacagtttaatactttaaatatgtgtctatatacttacaaaaaattttggcacacgaaaacacagcacaagacaaaaaatctctgcatttggtaggacttccactgcatcagctgaacacgaggatacattttgttggtacaagtacttggctgcaaaaaagctggacttctagaggcaaggctacaagaggctgtcgattcataaatacacaaataaaacaagatgctattttgtcaaaggtacagtcacgattagctgaactacttctggaacgtgcaagagtcacgaacttgcattttccggtttcagcttggagactgttagtagatgaaagtatcaaacaagacaaccgcaaatcattttctattatatagaatcttataaaaacatcacaagataatccggcaaacaaactaagccaatggaaataaaataacttcgtatgatctgggattcaaagcaacactatatgatgaacatcacaattagccaggcaaaactgccgcccttggagcgtctcaagtatctaatttcctcaaaagtacaatatgactgaaaactatggacagatactgcatctgcgagttgtctcaaagttgacaaggatttacaagaacaatgtaagaacctataggctacagcaacaatcggcaaaccaaagcttttgttgtctgcatccttcctagcaccaaaatttcaccgacaatggtatacatctaatcgccagaattacccttgaaaagaacttgtataactgtgctagtattgaaactggaatccatgtatattcattctatactcaaccgtgaacttacag

SEQ ID NO: 65191 - DNA, 1831 bp, Oryza sativa
ctaatgcaccagcagttaaggacaagatggatgaaccgcacacatcaacttggatgtcagtagttcctaagatgatgacaattgacataaggtagacaaacaccatgaactgatcaagagccaaccctttagaagcaagaatacagacacagggagactgatgagtgtatagagtatataggtgttctattgctcgccaatggtctgagttatttggcctgaaccctgaagactcattgagttggagggccttagactaaggcactccagttcactatataatttttttaagggagggaagtctgctacagagatttttgtgagaagtgtcttatatataaaatctagttaagaaaatctcaagttacaacatcagtcacatgacgcaggggcatcaaccatcacaatgtacacacaccgcatccaattgtatggtttatatctaagttatgtattgcctatggtctggtataccttcagcctgctggtgcttactcctttgtagattccaattgaaacacttttcttcgttatgttgtctttcggtttatcagtttctggagggtaaaaatgagccaaaaaccaaaagcaaaattagatgtttttccaccatattggatacaagaaccttttttccaaataaaacaaactaaacttgaagttagcaaacttatgttcagttcaatttatcaggagtgtcttttagtttatcaatttctggagggtaaaaatgagccaaaaccaaaagcaaaattagaatgtctttccatcagattagatacgagaaccattttccaacttaatacaaactaaatttgaagttagaaagcttatggttagttcaatttatcaggaccaatctagttctgcagtctgcacaagggcacatgtctacagttattggtaagcaaaacacacatgtgaagtgtgttcttcagaaatatctagtcattctacaagaattccaattacttgttgtccattgtgaatgatttgatgcttgtcaccttatgagcctacttgaaagttgaaatacaagaaactcaaaacacagtaacaggaaaaatgcaggaattgagtgtcatgatcaatcaagtcctacggcagctgaaaaacaaaggaaaacttcaaaaggtgtttagatacaacaccagaaaattgtaggtttggaagagacagaaacagaagcatgagatatggaaatattcctccaaagcccatattgagtagtctaccatattaggagtttcaaaggaaatcatggagtccaatcctttgttccaaaggcctccataggacttttttttcttacagaaggattgtaattgtccaaaattccatatttatcctccattttaaacggggcctaaaaaatgcaataatccagcgacattgaattttacctagtgcacttgtaactgagtaattgtgaaagaaagttctatccaaaaggaaaattcacatgggcatgagaaagggtctcgtaaactttacctggtttctgattgctccaatcaacatatcatgacaaccagatgcatgcacattctttaattttggacactgaagaagcaaccgttctgcgcaaaatatttagatggttaataacgatggctactatcaacatactcaacaacatgaagaaaaggggaaaggacataagacctggatttagatttgtacaggagttgaggtttagatcattcagctctggacaatttagatatagagcctgccatatgtgaaattagtaaaccatatgaatgattatttcaataaatcaaagcctgcaaattccaaaacacttacatctattgctgagcagccccat

SEQ ID NO: 65192 - DNA, 9299 bp, Oryza sativa
  unsure (1)..(9299): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcacataaccaagtagaaacctttggttttcatcacctaagaactatggctaataatactattactaaaagttcacttgttaggaatccttgttgttaatcattttcattttgattgttaaatctcgatattttgtcatttatgttaaacctatatacagtttgctgttttaggctgctctgattgcattttggaatagattggattgcagtgcaaaggtggagtgtgtggccaatctatttcatctgtgtagaattctgacaaatttatttcgaacagccccaacttgtgtattagctgcacattatatgaatgcaacgcgaaagctacttgcatagcagaataaggcacacatttccaaattaaatcattttaaatttctcaatggtgctgatatggactagatttgttccttctccattcttacacaattatctgtagagctggcagggattcctttttcttcttcagatatagaattctgtacagcatgaaagaatgatccttttttcctttaaaatgtttctggtttccctttccctaatccctaccaaacctgaaatgttctcagtgtgacttcattgtatgcaggaggaacttgaagagcttgataaaacggataaggtgtcagcagcattgcaagagtacgtgctagaagaaaacttcaccaattctaatattactttcagacattttatgctctcgtcttcctgcttaaaaagcatcttttgtggtggttttactgttagttactgattgcactgttaacatttaccaggcttatggtaacagcggagagcaaagcggatcctctacttccagtgtaacgacataaacatcctatttctaaatttatccaaatatctctgcctcagaactcttatgccgcttctttctgttaccgcaggactactgggcctgcttgccagtcttgggacagatggtttgaaggtccgcaagatctgcgcagatgcaaatgctggtttttgtgattcttggcaagcaacaccgagggcagacaatgattgctgcaaactgtaaattgtttttggtcttcccagcatgaatgtcattagtcattaaaggtgaggggggaaattcttttactgtactgagtatgggcatcagaaagtggagtagaatgagaagagaactgtggaatacataagtggcagcaatgagttagcttaatctttgttcgacaagtttcttcgtattgaaattttctgtgcatttagtttgattggctgcatttctgctgttgttaaagtatgggatctctcaactgcaacatttgactaaaaaaaatattccctgtgaggctgtgaggttagttctatctgacatttctttagatgtttctacccttgttcagttagttaccatgctgaatcttgtgaacaccatttctgaagaatgatggctgattctatcttgacaagaattctgaatcctgcattgatgtgaaagaaactggctctttcatggatcgcattaactttccactagctcttctggcccattcaagagaagcccagctcacagaggcccagcccaataagcagctggttctctctcttcaactctcataggccacaagtgaagggaccttatccaaaactacacagcaatggcgcgcgcttgctcgtctccctcctcgccgtcgccgtcgccggcgagcagccgtcctctcctcccctcgtcggcctccatctccgccttcctcgcatcccacccggccctcaccctcctgcacacgcaatgcgcctccatggcgcacctccgccagctccacgccgcgctcgtcaagtccggcctcgccagggaccccatcgccgccagccgcgccgtcgccttctgtgccggcgacggacgcgacgccgcctacgccgcccgcctcgtcaggcaccacccgaggcccaacgcgttcatgtggaacaccgccatacgcgcgctggccgacggcccggggcccggcgcggccgtggcgctgttcgtcgacatgctcgggtcgccgacgccgcccgagcggcgcacgttcccgtcgctgttcgcggcgtacgcgcgcctcggccgcgccggcgacggggccgggctccacggcatggtggtcaaactcggcctcggcggggacgcgtacgtgcgcaactccgtgatcgccatgtacgcgtcgcgcggcgccgcggacgaggcgatagcgctgctcgcgcggtgcgaggcgttcgacgccgtggcgtgcaacagcgcgatcgtggcgctggcgagggccgggcgcgtcgacgaggcgcgggcggtgttcgacggcatgccggcccggaccgtcgcgacgtggagcgccatggtgagcgcctactcccgcgactcgaggtgccacgacgccgtggagctcttctcggcgatgcaggcggagggcgtggagccgaacgccaacgtgctcgtcagcgtcctcggctgctgcgccagcctcggcgcgctggagcagggcgcgtgggtgcacgcctacatagacaagcacgacgtcgccatgaacgcgctcgtggtcaccgccctggtggacatgtactgcaagtgcggcgacatacgcaaggctcgcgaggtgttcgacgcgtcgagatcgcggggccaggccaagctctcgtcctggaactccatgatgcttgggcacgcagtgcacgggcaatggcgagaagcggccgccttgttctccgagctgaggcctcacggcctacgccccgacaacgtcaccttcatcgcgatcctgatggcgtacggccactccggcatggccgacgaggcgaaggcggtgctcgcgtcgatggcgagcgagcacggcgtcgtcccgggggtcgagcactacggctgcctcgtcgacgcgctcgccagggcggggaggctccgggaggccgagggcgcgatcgcggcgatgccggtggcgcccgacgcggccgtctggggcgcgctgctgtccgggtgccggctgcacggcgacgccgaggcggcggcgcgcgcggcgagggaggccgtgcggtgcgacccgcgcgacagcggcgcgtacgtgctcgcggcgagcgcgctggcgcgcggcggcgaggcgcggcgcggcgccgcggtgagggggaggatgagggaggaaggcgtgggcaaggtgcccggatgtagcatgatcgaggtggatggtgttgtgcacgaattcgtcagctaaaaatgttgcgacttaattatttcaggtcacagctaaaaagttaagatggcacataaaccaagattgtaaaatgtatagaagcatcgacctgtaaattttgcataattctacttaagagcgaatttctgaatactacagatgtttttgtctaatctattgcaaaattatagatttaataatattttgtactgaacaactacacatcttttttctcaaattattgtaaaactacatgttttattaggctacaccttcacatgcaccattacctgacaagtgggtcttccatgtaaaaacacttgaagtttgtgataaaacattataagggaaatgttgctataagatgctcaaagattgtgaactttacctagaacacgaaaacgtgatacggatgttggacatcaaaaaactagtaattctcgtgagtgcaagtaggactcgtttgtcattgtgggtgatttgtatatagtttaaaacatatagttttatgataacttaagctcaaaacctgaaattctacaatacaaactcttaaatatgtagtctaatgaaattctgacaaaatatgattttctcaaatctactctttatcacgtgataaaatcttggatgtattttttagataatacaaacttggatgtaatggatgggcaattgggcatctaccaacatttgtgaaaagtaatgatcaaacaagattagtgatgtccttgttacatgcctagataagtaatactattattactccctccaccaaaaaaaaaaatcaacttttagagtttgaattttgtccaaaaaaaccaacttctaccattctacctaccatcaacacgtaaaacgagaagtttatacctttaataccctttatttacccatcattcttactattttttcaatgattaagagcattttagtcattctcactttattaatccacctcgggatggaatggatttttcgtgggacgaatggagtacattagatgatgtattttcacatgcaacatagaacatgttacgaaatcagaaaaataatagctcgaattgggctctgcttcccgtgtgttctacacttctaccaacaaatcaagggacgaagagtatgagggccagcccatcacaggaaagttttgctggtccaaaacgtatgcacaattgcagctttatcaacttttcaagaggatgggatacatattattatcctagcccctgcattgtagaatggatatagccgtatcttgttacatacgagtagttacaatccttagctaccgcaaaaaatcgtgcaacattcgtctttaatttttttaatccaaaaattttaaaattcctcgaccatcacagtaatgcatggatggtaaccatacggtaagtggaggtaaccacggtatgttatttagagaaatgaaaattgcagaaaacaaagaaaaacaagtagaaaagattcaggaaattgtataattttagaaaaaataggaaaaatctagaaaaatgtaaaataatatagtaatcatgctaaaaattttgacatgacattttctacactgaaaaatgaaggaatcacattttcctctcaagtggacctaaatgggtttcatgaatagtgctctctttcggtgaagcgcatttgttaattatttttcttttttaagttccaatttacatttggctgcagaatatgatatcaactttgattttttttctcacctaattgtactataaactactcctttcattctgaaaatatagcaattttatattaattagggaataggggtagaaagacttaattatttaacttgggtagatataggcttgtactataataataaaactaaaggataggaggggtagtatgaaagtgatgaaagtcttttacatgtcctaagttgttatatttacgataaaatttaaacctacattttgagatggagagattttgggatagagggagtagatactatcgggagtttccactaccgaagcctcatggtaaacttggttaattaccatgtggtaggaaaaccctggctgccataccataaaactgcaaataatcaaatggagacaaaacttatctaaaataaacacgtaagcacattctaatgttaaaccttctcatatatatgctagcttgacaatatttcctccgaagttattctgaaaaggtgacactcgcttttacatggccgtgttcctccttttcagcaaagtttaaagtcgatgcattatcctgacctaattaggatgtgattctgtggcatatgagtgttgtgtgcatgtgattagcaccacaccttgaatagctagttgagcaagagtaaaacaaatttataaagccttctcccaccaaccatatactacttttaggttaactcttttacatgaaacgagcacgaaaatgtaagtggacctattcgtcgaatgtgttaggctcgactgtgtggttgcgcgtggcacttgacgtacgtccatatcctaagaggggagaggacatatttctggacatttgcctatatgtctatatacttggagcgtattattggacatttacctatgtggctatgcaggtatgtgtgtgtgatatcttgtctcaattaaaatgtgcttatcaatgttatgtacacttgcttttttactggattaacctttttacatgaaacgatgactaaagtgtaagtgtgatgctatgtgtaagtaggactacatgtcatattagatggaatgggatccgtagagcgtagttctgtagggcaagctgttacaaccgaaccaagtgagcaagcgccttagatgttgaagcgtccatcctttttgtttcaaagaaaatctctaaaagggtaaggatttctagagttaacccaatttacgagaaaacaatgtactaaaactttacaactgcacgattttttttagataatagaatataacatcccggcctttgctcaaaacgagctacaaccaattattataaagtagcactcaaagaaatagtatagttcaaattaaaaagaacacaccaaacaaaagcagaggaaacctagccaaaataaagagaacacatttattcaagtctatttgtgaacctccatccataattaggaaaaaaattgcataaccatcgactccaatttgcggcatgcaacctttagaaactccccatcatcatcacacctttgtagctgtgcacaaaaccggagccagtgtgttgccctgaaaattacctgcatataggaagtagatgatgatttgtcaaaaactataccatttctactcaaccatagagcccagcaaatggcagaagctccaacaagtatcaggttacaactgcacgattaattaagggaaaaagattagaattaatccacatgaagaccctacccaattcacacaccaccgacaactagcaccctataactacttttttgaacaaaaacatcctataactactgagacccataaaaaaaatcatccttgctaagcttaaagaaaatgaccaagcagctccaacttcaatctctttgatttagccatgatattgaagtccacgtggcatatactgtagctagctaggacagtgatatagtatcagtcccaattttgtcctgtggaggacaactcatgagtcaccagactgaagctagccaactaactgaatctcttggccgacactgcatatgtgttcctgggaaaatcagctcgtgtcatacgaaaatcagtcaccatcaacaggcctggccggtctgtgtgcagcgcattatgcagaattgtcaactttaatttccaagttccctaatgtactatcatatatatagtacactccctactaatgccattatttgtccttgttgtttaactgtagtcatgcagggatcgactagctgtagggccaaatgcagacgctgacgagacgcataccaacataaaacatttagaaaagacgaaagaatccgattgacccacacagccaatggcatggctgcccgtgatctcttgctaatttcagcgatcgagcattcgggcccaacaaatctttctttctggtgctgcaggtctatctgtctttagtttatgtgtgagcatgtacgatcgaacgagcgaggtaattggagcaacagttttcaggttgctaataacttcctgtagcaaacaatggcgatgggctccatttagatattagcacaggtgctcaggcgatgcgagccacaaacggcaagattcctcttgcttcaacggtcgacagagactgccacacaaattcatgcatgcatgtctgcaactctctgcgcatatattgcgtttatagtctactacagctaactttcgatcagattttgcttttggagaatcgtaattcagcctctgttaaccccaaaattcatagaccaaacttcgtatattaaagctcatagactagtagcaattatatggtggtcactatctagcaactgtatataaatgtatatacaattataggatggaaaaaaatctcatatataaatgtctagcaacaattatatatatatatatatatagtgggcttgtagcctacactaatacagaaagtatttttacgggcgggccgaaaggcatcttcccatgcgaaaggctggcccgcctatccgagatggtctgcgaagatcaccatcttcgcgtgcggccaggctgcccaactgcacgcgatgtggctgcattattgcgtgtagtcacttaagtgggtcacacgcgataatgcatatttgcgtgcggtccatcaaccggcccccgggagaccggtttttcctagcgcgaccacttatgacccacatggaacctaattgcccccttttatagaaaaaccgattttgtagtggtacaataataggatagtcaacatagatcgagactaacaagcatatcatcagcttataagcagtgtacccataccgaatttctcagttttttgaatttttttacggctatctcgttgaattacacgtcacctcttgctgctttcggttcctcatgcgggtgagcttgactgctgataagcaattctccagttagcctggatgttcaacaatttccaagctttgcctcgtgtccggtgccatcaaccaggtgtggcaggnttctgcatnctatgncgttttttttcaaaaagacacttaatactctagaaatagcaaaccagtccttttaaattaagattcatccttatcataaattttacaaaaaaaaccatatctttatatatgaaatacaatctgaaggagagaaatttccatttctagggacagtgttgtatcttaaaaagtatgagggcattctcacaacaacacatcctaatccaatcccatctttctctctgctgcctacccactcccaacatgcaacctttttccgtcccatccgccattcttatccgtgcgccttcctcctccttgccggtgccgaggccttcccttcttccttccggaccaaacagcgttgacggttgacctattctcctccaccgccctatatcctctaccctcaccggtgtattcctctcccgcatcgatgccatagacctggtcggggaagcgtggaggagatgggcgatgaagtcgattgccacagtgcaacgtattatgtatatgtactctttcgtggtttaagccccagcgtgatgcagttttgatcaaacagatgtaaatatgtactccctctgtttcaggttatacgacgttttgacttttatcaaaatcaaactgttttaagtttgaccaagtt

SEQ ID NO: 65193 - DNA, 2092 bp, Oryza sativa
tttgacaaaattaaaatatcttatcatctgaaacagagggtgtaattatttgacacgtctctctcaaaatctcaatgcaccaactgatcgagccggcatcattattagtacctaaaggtaaaaaaaaagctaattaaattgcaagttgcaaatctctggccccttcacttaattggaacaaacaagctagagaacagctcaacaaatcaagacaaaaacttaaacgtagtaacacaggatcagcactagaataataatgtactatcgcactctgtacaacaacccctgaaatatatatagttaatccattggagtatatagcagtttttagccgatcttaattagactcaaaagcaaggtcaattctaccatcaggggtccatattgtgcccatcgcgtcgagcataaactaacgtcctgacagcgaatggcgaatctgaacctagattttcctttcacaggcaatcactatcttgcgatgcatgccctagcacttaggtgtatttatgcctaattaatctaggggcactagcttcttaatttactgactatttgtcactgtcttacattaggttagggttttacaggtagcttcaattattgccgtccgttggttaatttgcttaattccattttagcagccttttgatcgcggtagtgtgctttagcatatatgcatatatatatatatatatatatatatatatatatatatatatatatatatatatatatatatatatatatatatatatatattactgctgctgctagtctagaagcatctaaaagaaacatgcgtacgtactggaagaatacgtacgaccgagatatgattaagatgagtagatatatggtccaaattgctgataactactcgatcgtatataattaatcgtgactgacgaaaaccctaggtttatataatacgtcgtgatcttttgatctgttcacgaggtcgaccactcgaccgctggcttcatggtttctgattattatgcctgcaagcattaagatgaatgtcttctatctcctgacgacatccatttttctctgaggaaagctagctgaaaatatcaccaggatcagctccattgcgtggcatggtgaaacttaaaccgaaactattaatgttttaatagaggattttggaccccactaaacagggcttagctccgcgcgcccctaatttttcttaaagattatatatatgtgtacattttcttaactgaaatatatatatctataattaatcacatgcaaactatgtagtgtacaagaagctcaagctagctagctgcaaagctgatcaacagagtgaagtgtttattacaatcttcaagcagatccagttaggtgtgtgtactgaagaaattaaattaaagatgccatttgtgatctgcggttatatataaggatgaactgtgcttgtcatgcatataacacgactattgcgaataaatacactatagtgtaaaaaacaaatgcaaaaattagccacctatatatgcgcatttgtagaagacaccatgtacgtataaaacaatttcaaacagtacatactcccttctcctcaaactggatgtagaacatgctgccacacccaactctttacaagagcaaagatacacagagcctcgtcggttacccatatcccctaataagccaaaacggcttattaagaaataaaaattaatttataggtaaaactatattatatatttattcgtagtgatttaaaagccaatgctaaaaagaaattacattgaaatcatcttacaatcaatttcagaataatcaaatttgaaaattcaaattttggcttttgcttttacttattagaccaaccgatagggcgcgcgcgcacaaacatggaaattgtggttttcaatgtcttctctcacacaactttattatatttatataaatgttattaatcgtatttgattatgaaagatatattgaattaacagggctgatctgctggaattaaaaagaattaaattgaaatataaagtcatgaggagggcaaggattctgacctgagtataacatatatacgtactgtagctatcatatttcgtatatacca

SEQ ID NO: 65194 - DNA, 5756 bp, Oryza sativa
accatgatgaaaaaaaagccttcaagagatagctagctttaaaattaatgatattgatttaatcaatatacaatggatgagcaatctgctagctattttcatttaattactttgattcatttacaaaggtatacatatttaatttgtatccggttcttattttgaagggaaggaagcatgcataaattaagaataatggtaccatcaaaatatcaatctgcagcagtacgtcattcagatgcgcatgaagtgctagatttatgcagaagctagctagctaccaagagaagaaaattaaaacagtcgtcgcagttaggtgatgtggagccggccgggcggctatagcaatttgcaaaaatatacagtgcatctgttgacacagcaaaatctgttcctttcttgctagtggttccccgggaatctaaatatgatatggcaccttccatggccccacccttgtttaatatgtggacaaaccgaagcggctgcaggtatgcatgcatatatatgcaaatggtagcaatatcatgtatatgtgcaatatgcagattacgtacacatgcaacgacacttaaaaatactaattgaccgatatattaattattaccttcatctaaaaataattgtatttctaccattcaaattttgttccaaaaatatatccgtagtaaggtgaaatacatctaattagttagatggggatatcctgctcccctatatatatcattccatctttgtctgccttaacctatctttcattttatgcatgtggggtttattgtggtctttgtatgtcctattaatatgtctaaagatttctaaaaatataattattttaaaatggaggtagtagcatgcatgcatgaggtagtaatacacaaaattatcgtgcctttttttttcaaatatataattttcatacgaactcgaaccattaattaatctctatatctatatatacaaaattattaattttgtaaaactcatgcatgcagtgcaaattaaggagtcctgactcctgaatatgttgggagaaacacctgatctaacacacacacacttgctatttcatcacgacaatgccttgacaaacgccaaaaaatggcaaagaatatcttagagaaaaaaaggacagctaatgcaggtcaagttaattaagtttatacaaagcatgggttatgtcggatatgtgaaaactacgtacgttttctatgtaaaatatatatggcttgcctaaaacaaatgaaagtgatggtacatgtactgatgtacacaccttcgaaagcgacttttatttagggctgtcgtcgtgaaaactacgtcaattcgatgaagggacaataattgatctataaatcatctgagtccgatctgatatatttgtgtcactctcttgattttgcgcttgtccgataatttataccggtcaatatcttgtataagatcgatatcgagaaatacttggaatcgtatttaattagtgcatgtcatatcatacttacagagccccattaattcttcaaatttatttgatttttgaagcgcatagaaagggccctttacttctttgcaagaatgtaattaataaataaaattacaaataaaataaattaactcattatcatgagaatatctatgtatggtctatttcatctctggcaggtgctagatcgatcgaggagacatttttaaccaacaggaacaaggcagatacatgcataatatgttgatcccgcgccgtccacgcgagggcagctcgagggccaaccctatcagccaccgccgcactcctctcccctcccctccacctcgtcgccaccggagcatgccgtaggaaagtcgagcggtgagccgggatggcagcgggccatcccccggtggagctccgcctttgacacaggaaaggcggcgcgacagcgtgcgtggcgtagagaaggcaacgtgatagtgcaggcggggagagaggcggtggacctggtgccaccgtgttcagatctggagcacccatggcaaggggcagtggccggcgccgccacgaccggatctggagcccccacggtgtgtccttgccggatctgaaggttttcatgaggcgatagcctcgagcggccagcgcgcggtgacagtctcgagcagtaggcgtgggagatcgacgcgaccagcgacgacggagagaggatggcgtggatgatagcgggaggatggcacgggcaatgcgggagatcggcgtgaccggcaatggtagggaggtcggcggtggctagtggttggtgcgttcagcgacagcaacagtctaccatttgtgaggcgatggcatgagaagcagctggcggtggccagcggcaccgacgatggccgagctagcaaccggtgtgggaggcgtcgttggccgcatggaagacccgacgaaggctagtgcgggctggtccacggtgggacactggtgctgtggtgaagctttgggggggcgatgataggttttggtaagggtgctgcaggtgaaagtccagtggatgggtgacgatggcgcctctagtgtcatggccttcttggaggtgtcatctaggagatctcttgttcctcaacatcaccgtcttttctcggtttgatcgtcagagtttttttgttgtcgtcatcaagttggagcaagggatgagtgaatctccttctctctcaccctctccctcaagtcctcaactcaacccctctatgtgagtcgttgttcttttgtgtggagtcagtgtttagcacggcgtttgcaacccccttgtaggtctagcggcgttcggtctcgtttagtggcgatcggttcggtgctagcaccttctccgggttgtgctgttaacttgtggtggtgatgtgcttgtgtttttctctttcctgattataatctctagggttgtaatcttttttttattaatttctatgtcaatatgaaacattcgcaatgtctgatgggagttgtttcatgataaaatatataatagtcgatgtagtatatatatgcgtcgtcgctgatcaaaagttgattgggatgtgccaaataaaaaataattaaaggtaacactagtaaaatttacttcaatatataccattccaatcaattggaagatgccaacggcggtggagtaataaactggtgccactacgccagatcctcacacctttgacggcatacctgtgaaggcataagtgttggtcagtgataagagtcacctttgatgggttctacgggatgccgtcatcggtgagccatccggcaacggcccgtcacagatgttatgaaaccatctataatttgtcctcttttttttctgtcataggtggaaaccacccaacctgtcggtgatatgggcccgggggtaccatgtttagagagaggaagccgcccccaaactcgagtggcatcccctgagaagggtggcgcctgggtggagcggcggccaccccctcccagcttagggtcccaagtttggagggaagaggctgcccccagacccacgtggcacttccccgagcgggtggcgcccggggtggagtggcggctaccccctcctcgcttgggggtcgggcccgtcccgaccgagactagagggaggaggccgcccctggcgccacgtggccctcccccgaggggggatcgggcccgaggtagggcggtgcccgccccctcctgtgataggggtcgggctcccccctcccccgaccccctctgtaggtcgccacgtgcgatggattaggtggacgcctccaggcgcccacctacccgcattcatggtgacctgagcggttgcgccacaccacatttaatgcagcgtgcagtgcactcaactgatctgtgaccgatccgtgaccggttgaatgaccgatgggacgacgactgtgtgccttcgccttgtcagtgtgtcaggcgccgtgcggcgtgccccatcccgtcccatcataatgatgaggggcttcacagcctcttatctcggtcagagctggtctaaccactctgaactgacccgggtacctttttcctggagtgaacgggaacccggaagtccttaaccattaaacaacgaatgacaagggcgccccgcatgatctgatgggccccacgcagcagccgacgcgcagatagcttttgggctaaggcgcaagacatgtaattaatatagagaatattttcccttctccctaggtagcactcgtagcatatgtgggatccccttagagtataaaaggaggaccatgcctagtgagaggggggatcggactctggatcccaaactaaagcttctctaaccctagcttgtacttgggagatttagaggctttgcaagcatagaagaatcatcatacacacaggagtagggtattacgcttcatagtggcccgaacctgtataaatctcttgtgtctcttttgtctcgaggaaattcagatctcactcgctcccccggcggaactcacaaaagggggatctcacgatctcccgctagagaggatcactccttgacacaacccaatccttatctatcacccaccgacagtccgagaccactcatctctcgttttttctttcttccttatacatccctctctctctatcgttttttcttctttcttcctcctccacacgcaccgagcttgcacgcgccgagcaccgggtccaacggcggcctccgactccacgcgcaagtagcggccaccgccggttgcttcctcctccgccttccaatcgccggccagcgccgcctcccccgaccgccggccgccggatatggcctacggggcgcggatccggccaccgtgggctgcttcctcctccgcctcccgaccactggccggccctgcctcccccgccttccgaccaccggccactggatctagcctatagggtgcggatctggccaccgcggcctctgcccccacagcccgaccgcttcctcctctgcctcccgactgtcggccgccagatctggcctacagggcacggatccagccaccgcggcctctccccccaccgccagccacttccttctctgcgtcccgaccgctggctgccgccgcctcccccgcgtcacgaccatcggcctcgaaacgtctgggggacgcagatctggcgcctctcccccgaccgccagtcgcctcctccgccaccccaccgccacctgccagatccggcagcagcctcctccaccgcactggcaacagttggatccggcggcctctaccccaaccgccgacgtcgtccaccgtctccttcacccgctagcttcaccggttgtgcaaattttcattgccaaatttcagattgggttatactcatggttgcttgtgtggatttgtagtttattactcaaagttgtgtggatttgtgatgtatattacttgtgtgaatgtgcttcatgtgtcaacatatctgtgaataaaatgcaaagttattgtgtcatgagatcttgagatgttcttcatgtcattagatatggcctaagggctgagagctaagagctagctagaggctgagggcttttgaaattttttttcgttgattttccacacctgtgacgggtggtgagttgaacatgtcagaggtgtttgtcacctttgatgggctgaaaagatccactcgtcacaggtgtcaatcatcattaacgggcttttactcatttgagatgaggttgttgacgaaaaaaatcgaacacaccggcctaggagatctgcttagctcctgtgcaggtccaaatcttgatgagatgtgggcgtgc

SEQ ID NO: 65195 - DNA, 1157 bp, Oryza sativa
tatatgtatatgtaatccttatgagctgatgcaacatccagataactcaccggctgaaaccccgatgaaacccttattggcaatcaagaagcaggtaagagattatggttctaagcacgacttagtagatcaaacttaaccgatgtagcactaagtatgaaacgaaacataatatctagataatcaagctgttgattgagttttcagggtggtagatgtctaagctaatctaatctaatctagcaacacgatttagccgataccggcagaaaccctaaaacgagaagcagccgatagagttaaattgatatgctaagactagattaacatagacatatgataaataggtaggcaaatgtgtcatccaaactagagcaatccaagaggtcgaatgtattgatgcagccttaaacaacgccgacgtaaacaatacaattgcctgggccgacggaacattggacttaccctttagccagagatcgaacaccgatgcacccccgtgtcaggtgtcaagtcccgtcggacgataaaataaagtagaaaaggtaaaaggtggcgatgcgccgaattatattgatcgtgaagataaattacatagaccccaggtgtacatatttatacccatgggtagatactagtccttgtacgacaagaaagaaactttcctaaagataaagggtgaatagccaaagtggtcctccaagtctcatctgaggctcagtttagtccttgatgtttcaatctatccatattagtccttcaagttttcattttagttcaaacttatccttgaaccaacaactcttttcataaatgacacttatacccctcatcatttacatatataagagagaaattgcatgcttaaattttttatagataatacatagtatattatgtaaaacgaaaaaaaattatgtactagcaagtgtatatgatagcaattgcttaagtttcatgtgtatatgttgaaataatgggaagtagatctgtaatattgtttattcatgttggctttctcttttctagtatatagatgtatacaaattaagggcaaaattgatattttctaatagaaatattgcctagaaatagccatatggcatattaagtggacccaagaatgatttcaagccaaaacaaatatttgaaggatc

SEQ ID NO: 65196 - DNA, 23767 bp, Oryza sativa
cgtcgcctacacaaccatgcacgaggtacatttcccttaatgcacgcttaagagatccaaaagatgaaataagacaaaaaataatgtgccctgatctattatcgcggtggctcattttcatttaaattacgttcaatagtccattttacggttgagaatatatagtggctcgtttaattatacagagtatataaggccatgcatgacggtttatttattacagagcggactatggtcacgggctcaatctgtttctgttgcatgtggtgagcaatttacatgtgcacgcccgcacagacagagttagttgtagcactattagttagttactaactactaagagcaagtataataggaggctgtaagccgacaaaatattgaggtggaggaaaaaagagaggagagagaggagaagcgaactgtaaacttatagccggcttagacataagaaccaataaactctacgagagaaacaagtgggccatatattaattgtaattagctaactgttatataggtgggctgagagaaaactgtaaagaactttatagcctggctgtattattaatcttgctctaagtaacggatacaataagagtaagtttaatagtatagccaactactaactccaaatcatgtatagccaatataatagccaattcataaaatagctggttactacattattaatatccggtcccatctgtcatacacatattatatcttggagtccgtggtgtagctggctacaaatctataacatgctgctcttctctctcttcttttatctcttaaaaatatgtttatagctggcttatagtctgctattgtatatgttgtaaagtggtgtaaaccggctgtagagaagaacaagctagtataggcctgtgtcataagggcaagttttatagaagaggtggatattgcatctaatcttgaccacatcatcaaccaataaatatagaggtaacatgtacaatatatcacatctatactaattctaatacactagccccaatggttgtttgcccaatctactcttcctctctcttctttgtcttgaattttgtgtagcagttgcctcttacatgagaggtggctctttatctctctcatctcttctctcctccacctcactatttaagcttacgtggcacctagaagattgtgcttggatgtccatagtacttgcactaattcccaggtcggcggggctagcttaattaattcacagatgcagtccagctgaggtagcaaagtatcccaccccgtgtaccgtacgcgttccaatcggtaaggttcctgttgccggcggggacgggaacacgatcgaacgcgcgcgcaccgtggccgtgcacacaacacatgcatctgaaaatgaaacgagacgaatgatccattgacatatctgagatatatatatattgatggcgccaccggctaatagctgcataggatcggaggaggctggagccagccgcgccatacactcatccattctcctttcccacggccacggcggtagattcatcgatcgatcggagcattgctttcgattcgctttcgcgaccaaagggagggaaaggaagttgcgttgggtcgctagcttagctgcaccttagctatctcctcctgatatttttgcacgccccctcccgttccttcctccctttcccgctctccgcgtacacctgggatccagcataacccatactccactactggactactacttgctgctagctgccgcttataatttgttgccctgtctcattgtccctccaaaatatcaagggccaaagaggctttagttcatttattttatttagaaactagtttaattaattaattaattaattcagtgatacatcattattcaagaaataagtcaatgtgttgtatgatcaaaagaattattcctggtattttgagcatgtgtaagaaatggtgttctcctaattatcaacgaaatgcatgtctgctagttcgtgcaagcagaactaaaattaaagacctaaattgaataaatatcgggatattaatgaaacacaatcagtgggttgtatttttggcagttcacctctcatgttcattcatttatcaacggtatccaaaatttgaaatagttaattttgagatatattcatcatagatacaaaagtttatttataaattattcctattgtactttctttattttttaagggcttattagccgtagaccaaaaacgagggattttcacaagaatacgcatagtaacatgccagtgtttagagttaatacggggaaagatgtataagtatgatttatgattgtgcttgaaattgcaagaagaaaactaggggctagtttggtttggttccaaattgtgccctaccaattcattggcaatttttaatagtgtttctggttgtttggattggtgccaaattttaacaacacatctcttagatagtaaaagttttggccatccaaatttggtagtactaaaagttacctaaactttggcactaccaagattttggtatggcactaaaccaaactggccctaggttagattttagttaagaggttgtatctaaggaagatggtatactatacactcattgtgtaactgttactccctccgttttaaaatgtttgacaccgttgcctttttagcacatgtttgatcgttcgtcttatttaaaaaaaaattgtgaaatttgtaaaactatatgtgtacatgaaagtatatttaataatgaatcaaatgatatgaaaagaataaataattgcttaattttttgaataagacgaatggtcaaacatgtactaaaaattcaacagtgtcaaacattttgaaacggtgggagtattcaacaatttacttgactttaattatttttttctcttattataaatatttaatgtttgctgtcgaataaaatttagttaaatatttataattttaattatattaatagtttttgaaatgcttagttaaaaattaagaagaagttatgtgtagattggtcttgaaaagtatagtcatactatcgtaaacttaattattagattttataaacttattttagtacaaaagttatggtcaaacttttaaaggtttactcggatcttgttctaaatgtaaaatatatagggcttgatgaattgagtatgtatatctcatccatattttatatttctaataataaaatataacactcctagtacttaatgtgtctaaattcgtactgcccaataatctgtctatttgaatatcatgtccataattgagatggaaagtgtaataacgagtgatgcataagcattaaaaaacgtttaccaaacagcattacaaactcagcccggccggcttcccccttatatacccagaccatacaaccaacaccaccatagtaaccagctgctgctgctgccgccctcttctttgtgttgccttgttgttggtgtcgcgcgcccgccatggccgccaccaagagcaaggcggccaagaagggcgctccgctcctcggcaagtacgagctcggccgcctcctcggccgcggcaccttcgccaaggtctaccacgcccgctccctcgcccccggcgccgaccccgtcgccgtcaaggtgctcgacaagcccgacctcgccgccgccggcgccggcatggccacccgcgtcctccgcgaggtcgccgccatgcgccgcctccgccaccccaacgtcctccgcctccacgaggtgctcgccacgcgctcaaggtgtacctcgtcatggagctcgcccccggcggcgacctcctctccaggctcgcctcgctgccgtcgcgccgcctccccgagcacgccgcgcagcgggtgttcctccagctggtgtccgcgctcatctactgccacgcgcggggcgtgtcccaccgcgacgtcaagccgcagaacgtgctcctcgacgcacacggcaacctcaaggtctccgacttcggcctcgccgcgctcccggactcgctccgcgacgacgggcgcctgcacaccgcgtgcggcaccccggcgttcgcggcgcccgaggtgctccgccgcaaggcatacgacggcgccaaggccgacgcgtggtcatgcggcgtcatcctttcgtcctcctcgccggccacctgccgttcgacgactccaacatcgccgacatgtgccggaaggcgcaccgccgcgagtacgcgctcccgcggtgggtgtcgcagccggcgcgccgcctcgtgtcgcgcctcctcgacccgaacccggccacccgcctcgccgtcgccgagctcgccacccacccgtggttcaagcgctcgctcagcctcgactcgcagctcggcagcctcctcggcggccagccggagcgggagctggcgttccaggcgccgccgccactgaacgcgttcgacatcatatccatgtcgccggggctcgacctgtccgggctgttcggcgagagcaagcgccgccgggagaagcggttcgtgacgacggcgtcgccggagcggacggtggagcggctcggccaggcgggcgccaagctcggctacttcatggtgggcaagaagggcgtcgaacgcctgcccctgggcggcctctcgggcctcgtcgccatgtccatggagatgtcggaggtgtcgccgtcgatgatgctcgtcgagctgaggctggagggaggcgacgacggcgacggcgacggcggtgccgaggagttcgggtgggaggagctcagggcggagctcggcgacgacgtggtgatggcatggcatggctgcgatggagggaagaaagacaaggaagggattcttttgtaggacatggactttgtcacatgtatgatgatgtatattagtaggattttgtggcattgttgtgtcaaagattatagattgttagttcaatctaattacgatgttttgtgactaaattgttggtaggaatggatctagatcatttgtgaaagcttgaagttagtgttaatacttcatatattggccttagtgatgaacacgagttgcccatgcatgaaccatggtactctcgattattaactcattctaattcaactaaatttaattttattgaaccatggtattcgattctcgacaattctagttttagttcaactaaattttacttttactgattggtcttatgtatttatttatttaataagttcacttagctcaacaagattgttgtcaatggtacgtacacacggatcgtcccatccctactggcctaaatcaaaatggtcatttaggtttttatacttttcaagtgttcagaaggtgataataattactatagaggttattccctcacatcgtttgcttgttgccttatcaatcgaggaggaaatttgatttttgaaagttaatcttagagttgattttgaggggttttttttctcattacaatttgtttttcagcattagcagaacttatacataaaagttctacctataaattatttgtggtaccagaagtacaaaggtaggctgtataaaacagcaatacgtaggacttaaaaggctatactgttagtaaaccacagttttcctgatagcctagcgcatgctgtttcctataagcacacaaaggtcattaactttaagtgaatgctgaacaaaacagtgtccaactcaaacagatctctccattctgcattctgcatgcactgtcattctttttccctgatagctactgaacctgaagaaaaatcatccaattgcaactgttaccacggaatcccacctagacacagttctctccaatattgagagtgactctgcgtgttccttatttaattggttattagagagctatttatagagctaataattccccatgcatatatatatatatatatatatatatatatatatatatatatatatatatatatatatatatatatatatatatgagtattactatatattaataccataatcaagtgtttaatttgcttctctaggcttgcaaagtgaacacaaggacttaaattaagttcctgtttcaccgatgttaatttctgccataatattttattttctgtattatattagctagtttccaatttttagttcttttgtgcctgtccattagtgggcactaaatcattgtccatggacagaatcattttcatccacccaacaactaaggtggtagtagtgtacgtacctatatctgtatatgcctatgctttcctgaaagaatatgccatctaattgattaagctaaagttagggaaagttacatggttgctgtttctaatgttccatgacaccaccaattaggttggtggacagatcgacgggccgacgagtaacatcttggtaaagtggaagtcgcgatcaataagagaagcaatcgattccgataagtgattgcctcctcttcaaagtggaagaaaatgcaaatgagaaacggaaatggagaagaaactgtgccaaccgattcagatggttcatagaatggttcatcgcaactctggattgatcaattggaaggaagatatgatgccagcaaatttggtctttaacagtgactggcagctgaccatattttcaatgtagcagcttctttcaatttcttatcaaaatgcttgatagaattgtcatcgaagcaccaagtcaaatgaacttgacaaaacttcagaaaacatatgaaagttttgcttataatcgttaaaatatcggcacatccaatggagtatctactctctactagtagctagctagatacacagggatagatggagactagggctaattaatggggtaaaaatccagggaagaaaaagctagtagtgatattgacatgcatgcatgaacacatcgatcagggaaattcaggaacagtccagcagcttggtgacaaaacaagcaagtaacttgtatgggcagtctatctcagctaaattatttgtctaaaccatgagctagctgttagctacaagcttcctatgctaacctcattaaactgacctgtaaagtgatgaaaatgagcaggtatttgactgaattttccggttaggccgtcagaagggaagaaaaaagaagcagcaggaaaaaacggaacaacatgcatgtgtgcaggaaaaagaaggcaaacatttgtgtttggtttcttatgatcggatgttttaaatttgaaccgacagatattgcaaaagagagcacacacataagattgttatttttgtatcggacttatattaatgtgctcctcactttcattttaactttttgaaagaaattatgtatccactactttcagtagtgcttaattatctcctaccacttttaatgagaggttacaataagttcaaacaatttaatgtaagtgttgaagaatggagactttaatcagttagatagaagagaaaagaaggaactctaatgatgatgataagctctgtagaaaggagataagcccataattaagcacgagggaatgatttgatgaggagaaatattattcctggtacatctttgtgtcatactagctacaggagccctgcccggataagtcaccgatacttatcaagttagtggtatcaccttctttggagtgtcaaagtccaacaacaccatgaatgaagaggaagaagaatatcgaacacccctattactccggaatctctttgtccatttgcttccggacgtgcaccttagtgaagattcgattcaaccctggtgagcagtgagtgatccataataatatgcaagaacaggggtggtcataatcacagatgaacatttgcagaggttttggtatcccaagtctgaaagcaagcacacattgaatgggatgacacctaatgcaaatgcagtactgtagactgtagaggatgtgtcgagcacaaaatatacattgctataagctaacagtatcagattactcgataaatcatgggtggacttgtcaacattacgtttagagttgcgctggttttttcagtacactttaactccttggaatggagaaattttacatgaactgtacaagattcgaactactaattcttacgtctcaaagaagcccttatttcctttcttttctagattggggaatcaatcacaaagcatttcgtccatgaagtaacaatacaagggaataatttgtactgctaacattagcaaagattctttctaacctcacaatctcgggaagctgagaaaagctgaaaatcctagcttctaatttttgcaagccagctttttcagattgtacaagaaactggtccgtttggattagatggagaagctaggaagtaatagagggagcttgtctcagctgcagcttttcccaaaagctgcttctgctagaagctacctcaaacaatccacagcttctaagaatctgtagttatagattctgaaaaatgaactaagaagccagaagctggagaaactgtgtttcagagcttttccagattctcagaagctggctaccaaacagctgcttctcagaatctaaagctcccccaaacaggaccatagaagccccccaaaattccaaagcacttcacaaatagcgcaaatactagctaggccacacctgtccaacaacaaggatttttttcttttttaatttttttaaatatttacagaaaaattatatcgacgaaaatatttaaaaaatagaccctaccgcctaagtggaggacggaaaggtgacgtggcacacggcgccgtgcccttgacgccctctgcacgggcagcaagtgggtgaaatgcaattttcgccgcatgcacctgctcagcggcctccagcgccggctcacacacgtcaccctgccgtcttggggagggctgcagggtctatttctgtaaatattaaaaaaaataaaaatgaaaaaaaaaatccaacaacaagagcccatttaggcctaaatctgtatgggccgggacccatatgcgtcgtcctcgcagctaacggcaacagcccatctggaccaaacggggcagcccgcgtcgcgtcgccgagcgtgagagacgacagtgacacgtggcataaaacgacgctaagcctatcccgtcgaaaatatccgcccgcggccgctgcttcgccgcaatccccttctccgcctccgcagctaagctaagctcgccgccaccgccatggggatggctccggtcgcgacctacccgtcctcctcctcctcctccaccctcgcgcggcctccgtgtgcggctgcggggagggcggcggcggcgggccgggcacgcgtcgcggcggccgggatgtcctcgagggcgtcctccttcgtcacgggaggggcgggggggctcgccgtggcggtggccgcgcggacgagggcggggtcgggggcggggtcgcgtgggggaggcgcgatggggtgcaagtgcctgttcgggctcggcgtcccggagctggtcgtcatcgcgggcgtcgccgcgctggtgttcggccccaagcagctgcccgagatcggccgcagcatcggcaagaccgtcaagagcttccagcaggtaagcaatcgctgatttaatgcttagagatatatgaatttaccaattaattgctcccctattgcttgacacgatgaggtctcaaggttactccgagcgaaatttctgttagcgctaatttgcaatgttagaaacgagaaccatggatacaattctgatgatttgaaacgattcttgtgattagagaacatcactactctgccatttgaatatgcccatacgcgaggtttagccgttcaggtcacttttcagtgcactacgtgttttcgtctataggaagaatatcacgctagctcaaagatttgtgagtacatttttgtatattttgaagctaatctgggatttgtaggtttgtttatgtgccactttttccttgtgtcagaagtttgtggattgtccaatgttgtgacagcacaaaaggtggcatttggctcagggaaatacatgggtttatgaatgaagaatatgaaattatgttatgtgctaccttttgtaggctttgagttggaaatgtgggttctacaagataagtttgtgtttcattgttacacaattgtttagagctacagtaacatattattgtgcatttgttttagctgtttcattgacacagttgtttagaaatagatgatcatggatttaatgattttgaaatacagtttattttggttgttgaaattgggcataccttgatttagcaaatttaggacctgctacagcatttaagatgattatagtactgaattgtttccttgttgaatccttgacaatacaatagaacagtcaatcaaaagcatagcaatcagtaggagcatgctttaacgctatttttatgttggtcctaatcaaattgcttgacatttgatcatttgggttctccattatctgatcagctacccctctgtctggatccctctgatgtaaaccacttgtgtctggtgaagtagcgaaagaacataactaattccgagtagcctacatgttcacttgaccagttctgtctacatgtttagatttctttttgcatttttgcaatgtcatcagaaatgcaatgtgaattatagatgaaacatgtaaggctgcattcagggagcatttggtgaactttaccacttgaacaattagaacatctctgatcatccttagatataaaaaatcactagtgttgagaggtatccacagttccagatttctactgttaggttgatataatttgttaagtacctgtctaagactaatagactattaagccgcattatcacttgccaatagctcaagctacttttcatgctccaagggcttccagtgttgtactctgttgtgcagtactttatcaagttacggtgtgatactacccttttgaaagcagattatgctatttccggtttgtaactggttcactgacccatttacacaaattcactcaggcagccaaggagttcgaaacggagctgaagaaagagtctgatgatggtggcgaccagcccccgcctccaaccgagacggcggttagcgacggtggcgaggagaaggagctcgaggcgtccagtagcaaggagagtacatgagggccagtggagaatggcgagttagaattgtgtatgtacaattgtatggatggtgtgttcctttgagtagcggcacatttctccctctctttttgatgacgatcttgcaggtgatgtagcgatgttatttgtacccgggaaaaagaagaactttatgtgaaaataccattattatttatgaggataattgtgtacatcagtttggtatgacctctatgcactaactcacattacagaaggatgagctattattgattaacataagttcaggtgggtttctttcttttgtgcaaatttaagtgccttcttggctaacctgtcgactataatcctcagctgattttgaattttagaatttgatttttattgactaatttatggggtttgttttgccacttttgtgcttatctcgttttccaagattgctctcaggacaaggaaaaatgtacatagagttattcctaaaaaccaaaccttaaaatttaaaaccttttaagctgaaacaaacagttccttagtttggaatgtactaagaagaaagggataagaaaaaaatgcgcagaaaaggggaaacaagagcataagctcggatttttttttactgttttttttattattgaaatgcaagcctcaacgaaatgacgaatttcggtaaattttgttcaaaatccaatacaagtcgagcagtttggaggagctctgaattcaggtgaacgaatttgtgaaagtgccatttacgtgggccccacattgtcagtcaccgcagcttggaaaataaactcacgtgctatatccgcttcactctcccaggccagtgggtgaaagagggagaaatccaaacgcccgaaaaatctagccatggttctcctcgccgccgccgccgtcgggccacacaaaaccctaaaccctaccctgagcccgccgagctccggcggccgccgcccccgcctccgcttcccgctgccccttccgcggggcggccacctccgctgctccgcggggtaccgcgaggcggcggcggcagcggcgtcgacgtcgtcgacgacgacgacgccgcggccgacggagatcccgtggagcagggagctctgcaactccgttcggctcatcgggacggtgggcaccgaggtggagctgcggcagctgcccagcggcggctccgtcgcgcgggggcgcctcgccatctggaagtcggccaccgagaccacatggtaatcgccccgtgatatgccgtagcgctcgcctcggttccatctatgcgtctcgttttttcagtttctctgtcgttggattggatgccggcaacgtgttgggccgtgtgcgccagtgtagcatgtggccaatgaactcggcattctggcgatatatgcagaagaggaagattttgtatctgttttgcccaactctccataattaaatggggtttgattttttgcattataaataggttgttgttatacaatgtgcaagagtctgtgtatggttgctagctgcacgtttggtgaaattttactaagaattaattgaactaaattgttatctacaatgacttgaataattgaaattgagttattgaaaagagcactctatttgagcagcagcaaaggtttaagatagatgtcccatttagcattggttttctgtctgtttggttagctgtctaaaggatataggagtaaataacgtcacaagattttgaaacacattggtcaacaaatgagttgtggcctcttgaaaataattagccaactaagcatgagttggaggtttggagctgtacctccttcgtgctatgtaagactagttctttagcagtcgtttcagagtcatacaccttaaatatttgtggttttattacaagtttcattattactataaattgtttccgagtgcttaatgattgtagtgatgctttagggtgactctagcattttgggatgacctagcggttgtggcttctgagcatgtgaagaagggtgaccgaatatttgtttctggacgccttgtgtcggacactgttgatgagggccctgagaaacgacaggtttattataaggtataatctctggtaatatttctttctttgagttattttgattcctttccatgcttttataagaagaatcatatgtttcacaggttgtggttcaacagttcaatttcattgagtcctttcagcaagtgcagttatatgagccagaggcaggcctggataccttaggtatggatgttatgtagcctgtaacatctttgatactatcatgtgtattataaaacggcgggtttcaaattcttgtgatggagtagtgaactagttgaagaataccagttccagaaggccatactatcacatatgtaaacaaataatatttcaattaatgttatctgttttccctaaaagtaaagaaatagcacagaacattgcaggccttagttcagtctttgaatactcttgaaaataatgaaaggtttgttgcattctgaatttctggcaatgcatagcataaaacttcctttcccaaatattttgtgcggaagtttcagaaaacccacatataagcattagttctcacacaaccctaatggagaataattgcattgtgggttgtctgtgtggtctaatgtgtgatacatggtcaattaatatggaattttctacaacttttttcattaaagatgggattgagtggagctcttgcttatactgggtttctgaaactcagaacaaaatgtatggtggaaaatacaagttaacttacttacttttctgtatgtaagttcttcaaatacaagttacttcacttatttggctgctatgtagctgtttaatactttagtgatttaagaaatatagaagagaagttaactcttttctgtataaccaaggtggaaagcatggagattatgttggttctacctctggctcgagtgagggtaaaagtagggaccatgttgactcatcctcccgttcaactgaacagttgtggcaagccttctttgctaatccttttgactggtgggataacaggacaaataaggtaactttcttcttattgttcatttagacattcaaatgcattatcttgtaatatatattacatgataaacggactaatggcttctgttcttgggtaaaccatctacctccttttaggagggtcatatcctactaagtactgctgcaaagatttgagagcacttctaatagtccaaaacttctcagataattaaaatactactatatgaagtattaatggttcatggagtttggctgaacattgtaaaacagaaacattgaaggtgtcaaatactcaaatgtaatcatgaaggataaaaaaaaaaggaagttgcaacatagtcagcatagcgatgtggctatattgttatttgagtcatgcaattgttttttggggttatttctagtgtcttgtaaaattgtagaaaccacccaatcctgaatttataaacaagttcagtataaatgaaatatttatctggttttccatcaagccagcatatatgctgtaggttacttgaaaaacctgcttgtcatatacatgggtttgcttcaaaccataaaactgaacatgctcttgttgcatcagaataagtttcaaagtattctttgttattccctccaaagaaagtatttttagttgtgtggcacaactagtgcagactaattaatagctagatgcctcagtgcaaccatgccaaccacttttggtcagggcactagtggaacaaagaaattctaaaataagtagatggataatctatagtgaattgtgaagtaaaaaatttttgtattaggagaaacaaaaggagtttgctgtgaattgtcaatccttagtttttcctttatttagtttgtcagaatttagctgtttgtgtttctcctaatttttttattgaatttaattttgatatctgtatggtggtctgacctcagtactattttaaactctttttaattttgctttccagattggctgaccaatttgaattcattcttacagtcaactattgttttgcattaaatatctgtccaggaattatactccctcttttgccttttcactctccatttatgatttatgaaatattgccatgggagtaatagggactactttgtttgatttattactggagaatctccaaatgaagctacttttcttgcatttgtctcgcgataacttgcaaaagggttaccatgctgtatcaggttgtgaaatcccatgccctctttcttccacaaagctttatcatggaagttggttgcagttcttatttgtgcatttatttgtttggtcaataattcaggttcaatacatgtctttttcaagatgttctggagatttgttttaataatgaatacgtactatttatggctacaatgtccctcttatgctacattttcactgattggtgtgcatgtatgaacagaagaacccgaggtatccagacttcaagcacaaacacaccggtgaagcattgtgggttgatgggaggaacaatccaaattgggttatctcccagttggcaattctggactcgagaatgggttctcttcaaggcaatgataggaaaccagttgcctttatgtatgctgatgacttcatgacacctgacaccgacactgaagcccatatgtgaaaggaaacctcccattcaccgatttatcatagcactatgtattagatagaaaatgtactactgcgatagtgcacctgcgctccttcaattttgttgtacataggtagaatcgtgaagtttaccatagaggcgtgcggccatctgttgtagtcagtagtaatgacaaatgcagatgtagtaaagaatcggatggccttcccttaaatttgcctgagaaacggtgtacatcacttggtgtgtttgcatcagctgagcctcaactgacaagtgacttaattacattggcatgctcattggcttagatggtgcaacaatgcaatcatcatcatatctgccatgagttgtgacctgtaaaaaactatgagctctcttttgtttcacattgcccgagtgctcttatgcttccctaagatgaaaccacatatccaggtacaacagatacacgatcctgcttgtttttatccgtatggcatatccatatcttgctgcgctgtcgtgtgtattgtatatctgactgctaaggcatacgctgaaccatcgagatatacatctctaccgcttttgatacccttctagttgaaacctgacatcaaatcagaaatctcacaggaggaaagaaaaaaaaaatctctggagagggacacaacatttttgtttaatgtccaccagcacatggagctgccgttccaagagctccagcaaccaaaccaccgcagcagcatcctggaaggcagagctgaagaaagaggttagcattgcatagtactaccttcaatttctttttccttgcatgcattgatttatattttcctgtaggaaaatgacttgtcatcaatttgttgtgtggattaaaagacttgatgaacaatcagttgactgactgattgagtgatttgataatgcatatcatatatattcatatatatggtgccaatggatggatgcttctgtatacagcttttgatctctccctcatatgcatgtgcaccacatgtatgctgtccgcccatagttcgaccattgcatgtgttaacaaacagaaatacagggggcttgagtgctctgcatgggctgtgcttagtttcttgaccggtcttgatgacccatctaattaagctatcaattatccccatttctttgccccctctgactttactggtctaggtcagaattggtattggatccagtgatcatcaggcatgactaaactttaactaatcttgtagcacatggtatatgtagtacttaagtagttttgttctttggaaacgtcgtagtaaagttaatcatttgcttagttaaggcttttttagttcaagtcaatttgttctaacaaactgagctcaaagattcagatgcaattgcaagaagttgattgcaaagttaatcgtccatgtgtgctacgtatacaaagtgaaacatatgtgtcttctcaattaacacaagtgaagcaaggaaacaaaaaggaaattaatttaagctgcatgtcttgagtcttacgaagcttagcttccggttgcaattttcttttcccgttttccctttgtatgatcagtttaattatttggactcataaacggtgaatcatatcaaccacaatatagtacacaaatcttaataacaaccgatatgtatagtacaaaagcattgaagcgatagtaaaatccacaattaggagacacaataatcaagggcaagggaacgagaaccagttcatctttcccggcctcttgttgaaatgatttgaagtagtatagtagtagtaaccaacaatcaatatataataactgtttcgtttgtacatacacatggagagttgaacccaaatctccacatctcctttgtgctgctaaaatcataaaattaaaacctactagtttttaaagatggaaacaaagcagaagcacatccatgtgtttgctttgatgcccccaagctcatctcctttttggcttgggaggaaaaaaaataaaaagaaatgaaaagttgatggaatgcatcgatcgatctcttgtcgctcttagattagatcttcatttgccttggtgatcctagccctgtggcttcagatctcttcatgatcctcaacttcttgcatgtgctggtgaacatgctgcaaaatcaaacagcaaatttaatcagtttgactgcaaatatatatataagcaaattactaattaattaagagatttgttgagatgaaaagtttgtgaagaacttactcgaaagggacgtcgccgacgagcatgaggtcgccgtccttgtcctggtaggtgatggcgaactccgacgggttggcaccgtcggcggcgccggagaagcagacgaacatggcctccagggcctcgcggagctccctgtagcccttgtacatcctcaggtcgatcttcctcaggtacggcgccccgtccatgctcaccttcaccagcgacccgccgttggccgccgccgccgaggaggctgccggcgccggcgccgcgttcttggtgatgggctcgtctttgttgttgcagctgctcacggcggccttgctcttgctcgccgccgctgactgttgctggaagcagctcttcctgtacgacctcaccggcggccacccgaccacttgagccctgcagggaggaggaggaggcagtcgccatgtcagaactcagaaccctagctagcttcatcgtaaaagtcaaagatgatctctggaaaagctagctactcacttggctaccggcggcgcggcctcgacggcgtcgtgctcgtcgtcgtcggcggcggcggcgttggcgttgttgtcctccgccgcggcggcgcgcttcttgcccctgggcgtggagggcaggtcgtcggctgtcccaggcaggcccagcctgagctcggtggccttgatgaggctgtcggcggcgtaccccacggcggcttccatttctcgcttcctctctagctagctagtcgtacgtacgtcggcttgccggagacgatcgatgtggttgtgagctcgagagccgatctatcgacgacgaagaaggaagacgatgcgttggctgtgatgagatgagggggtagggtttggaggagtgcaagttttatagctaggggggagagagagagagaacgccatggatggaggtcggggtgggcaggatgccgggtggggcggagacaggtggggcccgggcggcggcgacgcggatcccccggtcgccgggccacgccgcaccggggccgtcggatccggtggcagcccatgcgttttttcttagtgtggggcccacccaccacggcccaagccctatgctaggctgtagtaggatctcgcgttacgcgcttttccgggttcatattctattccccccgccgcgtggccacatgccaatgttaactggttatcggctatttacactgttttctttttctttttttaaaaaattaactttatccggcttgattataagggtgtggagtattttatttaaattattatgtcccatggaattggctttaataaattagtaatgtggaatttttgtgttcgatcaagcgaattagtcgaaataccacaccccgtcatagatagatccggtaacccggaaaattgttgatacagagacatagtgatcaggcatgtaggagaaagaaagaaaactagtgtgaaatgattagtaggatgagctatacatgaatgaatgatgattagggtaatgggggagcatctcttgcacattcggtgctgttccctttcggccctattgatcatatggaataatggagctacatatacatatagatagatagatatagtcatgagtggattgtgtgggcacgtatattgccggcccgttgcttgatttctggtgcaccctacctcttcttttcatttcattcttgagtgtattacacttgactcaatcgaacagtggatccatctatattttgttctgtgtctagggtttcaaacctatcggaaaaatagtgcaaaactcagtgccggcaaaattccgcaatacaatgtcgaattctttcagaaattttggacttgcagatattggcaaaatttagcaaggaggatattctctatggagggtatgtaagtggttcgcgggagggaattttgttctgaaacttcgagctcgagctattttgtgtcataaatatccatcactttaagcttttttttaatattgtaggtatccacatatatacataaggtgccacaaaaccacatgaaaaactactaattaagccaaaaaaaggttattaacaattttaattaacaaagcctccctatgatctacaaacaagatatttcaaaatgacaatggaggctttgctgaaatttttaataaactccatacatgcgggttttctatgtggtttataacactctggatatgtggtttataacactctgcaatcgatgcaggctagttcacttacaaacaaatataagtggtgcaatgggagaaaaagttgttgttatacaataatatctagttacatatatgtgataccgtcatgactctagaaggcgcctcacgatgaaaaaatcgaaaagaataaaaccaacaatgcaactttagacatatactccctccgtactcgtaaaggaagtcatttaggcaatgtttaatcaaatattgggaatataaattatgaataactctcaagttattgagtttgaaaatgtaaaagttatatgaataggtttgtcttgaaaaatacttttataaaagtatacatatatcacttttcaataaatatttttatagaaacaagaagttaaaattgtgttttggagaccgtgtcgctgtccaaaacgacttcctttacgagctgtacggagggagtatatataacataaaataaaatttgttgtacacataactatcattacttaattcctttcaaaaactatcattacttaagccctctcaatataatcccccgggccttgatctcctcctcaacaagttgtttcactttattcccctttccctctctccccactcactatgtgcatcgcattactaaatgagatacttctgtttggatgatcccttttgatcttgttcttgcttcttttggttgggaaagggtccaacaaaaactagtgggagttgtttgtttcaaaacctccacacaaagcattgatgcactgtgttacatcctaattaaaaaaagtgtgtattcacacatatgttagttaattgatgggaaccaaatggtcccccttgctacgtttttggctagctagctaattaactcagaagatatcatggaagttgcattgggacaagttggagcaagatatatcttttcaaagtcttgtttacctgacacattctagaaagctaaagtgcatgggatgctttcagactatattatgaaactcaaaaaaagaaaaagaaaggaaaccactttgccctgggtcaattctcctgcatattgccattaaacaacagttacagctaccaaacttgctagttacggaagatacttaaaaaaaatgtaatactacaaaagttacaaattcacgaatttagcgtagctcagctgcttagatttcttgtgatgaaacctgctcgtctagataagagttcaagttctaaatttgacatgagtacgctcatgtctgtagctattaattgttttagtggcaggtgatcgacgtgcctgttgatagcgagatgactgcggtgactttgtcaatattaaaatatgttggttaagtttctcggaggtgctcatacaagtaggattatgtgtacgtatttatagagtgtgtgcatccatgtacgtacatgagcatacgttagcgtttgtatactaaaaagagaaaaggtcctaaatccaataaaatggactaattaattagaaaaataaaattcataataaaattctagtggtgcttgcaaacagtgtccttccactatgtattttttacagtatttaagcaagtaccatgaagtactatgttacttatatatttctagtattaattaatttgtgaatgcatgagagttttcttttaaggcagcaaatcaaacactagcaatttgcatagtatgtgtacatcatcgaggagcatatgttgatgatcaacaataacaaatcaagcattgcagttgtagcatccagggatgtcaaagcagtgttttccattcgctttccaagacaatatcgattggctttcttagctagttcgtatactcaacaataatcaatttccccattggggttttgaaatgaaacttcttcattcactatatatatgcttaaaaatatgtatacattgtctgaatctcatatcaagaacatatacatatataaaagcctaacaacagttaattaaggtctaattgatgaagctaattatggagaagcaagacaccctatatatatggagctaataaccaatacatttatatatgagccatatatataggccttgacctagtatatacatgtatctaatctaacctcttctcttaattctttatatgctgagaacttgagatgttcctgccgatgtcgacacatagtaatatgctccatgatcaaaacaattaatttgctatttttgcatctgggtgtgtatgatatctttcctattgtcagcatcaatacagtccaatctagccaataagctactagtattttattggtggtaaacttcacccttgatctgataaacttgttcaacaaacgcgctagaatcaagcttgattccctgtcacaatgctatcgtccatacatgcatgattggttgcatcaatgcagagcttttttttttttgtcaatagctttgctatagcatttgactattgcgagataccttctgttcctgcaacctcctgcagacacaacctaaaataacaagccagtgcttgtgctgatcatgtacactcgagtttgtaaactatatatgtgtttttcaactgcttctctttttctttatggaatattgttgttgcctgatcaatgttcaagcttagcagtgagatgcattaatatgtgcatgtactaccgtccatgtcggcccacagaaaattaattcctcggattctagatatggtctgctatgcatatgagattattctgataagggcaccgactagctgtgcacggtgctttgtgctgatgcagtgcaatgcaattagacatgttgtgtttgatgtactaaatactacatgcatcttggttcccaaataaattagtgcatattatagcaagtttcaattcagttaatttgtatgctgtaacaagatcatgcatatgcatgatatgtgttgtagtgacctcctgctacatcacaagcatttgtatattataataaggatgttgtatcctctttgaaggccggctttgcatcaagatcatgctccatgctttgggtgtttggctgttgatactgatcttcataggaggtccgagccgcttgatcattacctagtgataagattagaaccaatggcttatgatggatctcggtatttgtgccgtcacaaccttttgtttttttttctcttcacatggtttttttttcctcgatgaaccatacagttgtaaaatttttggacccgattttctccataatcaaggttagttctttacttcttaattaaaagtgagaactcgctgccatttttagaggtactagttatatataggcccacgtgttgtaacgatttctttatttagtttagtgggaggatttagactaagtgggatttttttttacaatggttggttttttgataaatcagtttaaatttttttgggcggtttttatgggtggaaagagatttaggtggatgtggaggactccctcttttaagtagtagagatatatatctttgaaaaaactagtgcatttgcccataggaacttatatagttttgtttgtaatctagttcaaattaaataaaagtatgaattacccctaaactattgtggttgtctgaatctcccctaacaattgcggatttgtggtcgtccgaattaccccttgaactcaaataccatatatcttacatcctcaactattcaaag

SEQ ID NO: 65197 - DNA, 3938 bp, Oryza sativa
tgcgtgaaacgtacgtacaccgatcgatcgacaaactcatgcctttaattatcatcttgtcgatcagtcatcgggaaaaactagagctgattttttttttaaaacacagggcagagcatagaccgcttataagcatgcgtacactcacctctctctatatatatacacatgtacacgttaccctataagtttatttgaaaagtgatacatatcatgagattcacaaagttacaacatacgtcttcgctatcaacaagcatgtcgtctattattgaaaaataataattagttataaatacgagcatatacatgctaaatcatgaacttgaacccagatgaacaaattccaccatcagaaattaagctacgctcatttcgcaactgacacaaattaattaactacacaactaattgactcaatgaagctatttacttagctttcagccacagcttattttctttgttctttcaactatgcctcggtccaaaaccggttactaccggtccctcaaatatattagaagagatttgcttcggtctagtaaaaagtacttcaaattgccggtacctcacggtgctaaatcgttttcgaactttggaactaactaggtaggatgggcattggtagatccaacgatcggaaacgatttggcaccgtgatgtaccggcacttttagatactttttgttggaccggggcaaatctcatatcagaaacatttacatttcatccttgatgagggcaccacgtggtatcctagttatcaaattaaaattttgaaaaagaaatatatgaggtggaaataagaggaaaaaaggcgtgaagatgacacgtggattatactatatttttgttacttaattattattaattggtatagtagtatgtttgctatttgcccatgtacgtatactatatttgctattcagatcgaaaatcacctttacttgagtatatatagggatgaaatatgaagaaaaaattcgatatatagttgagaaaccaatagtaaacggatttactatggtaggaaaaccagaccaaggccatttttgagggaccaaaagtgaatgtaatcccaatttttaccagtgcttaattaattactattccgtcatgttaatttcatgaccctagctagctagattgggcctagtgacggatctactgttgggactgttggtgcgcaagccccacgtccatttcctatccctaattagccattaatgattctcattaagtttaattagtaattaatataaaattgggatcccgtgatgatagttgaagtgcttagtgcctaaaattgcaaaacactcagaatagactataccaatttatttgtagacttttaatacatatattaatgtagatacaaattaaagtggagaagataatatgtttattttataatgtgtatttggatttcatctgaaaatgctaagctgatattcctctgttcgtcaaccgtggaaacgtagggttgcgcccattcgctccacgccattttagaagaaataccaattaagccccggatcatgagatcaaagacaatgctatcccgctatggccgcctactcttccatatctctagtttgctttagcgccattttaatttacattctggattcgcggctgagagtgagagaggacctatttaagcatatactgctatattattcatcaccggccattccttaccatttcttctccctctgcatggtcagtgctcacaaacgaccaatcccccaaacgcagcaacaccaagcaaaagcaaaagctatagtccttcactagcttagctagccaagaatcgggagcttagctgaaacctgctgctgcattggagaagatcgaatatggctggcctcgggttcgacgagaccgagctccggctcggccttcccggcgccggcgagctggcagcgaggagctccggcaagaggggcttgccgagaccatcgacctcaagctcaagctgcagccggcggcgcctgctgccgtctctggggaagagggtgctcaggaggacaaggaagatgccgacgcggcggcggcggccgccgacgagaagatgtcgatgaagaggtcggcgagccagagcagcgtggtcaccgcggagcccgatcccgacaagccgcgcgcgcccaagtacgcactcgacctctcctctcctcgttaattaatctccatttttgttgttattttcatgaacttgtgtggtcttaattcttgtataaagacagtttaatccttgaagagtttatgtttgctctttgtttcatcttcttgaaggatattaaatccacatagtagataggactgataaatggaaagctagcgagtagcgattcaaaagtatattggcaagtgttttcaagaagagccattagttagccctgaaggaatgaagtaaataaatttctgcagttttgggaaaagactgtaatttgatatctaagttttttttttgaagaacaaatttgacatccaagttaaaacgaaatgaagtcggagaatttttcaagtggcagctaggcaggagctagtttttggtctctgtagttttgggaacagagacattaggatcccaagttggatactctggcaatgatggatacaatattcagtcaaaaaaagatgatggatacaataaacgaacaagaacaagctttccagtatgtagcagtagagtactatccccgttctgaaatattactacatagaatagtatttgactcatccaaaacaatgaatctggatagaagtaatccagattcattgttgtgagatatatgacgatagatcaaatctcatcctaactactccctccgtctcagaatatagcaatttagaatggaatgagatccattttaggataatgtatccgaacatcccatcctaagttgctatatcctaagtaatatttagggaaggagtaagttcacgatagcttccgtgcgtacacagaggagcagcagtagaaaaatggccatctgatctgaaaccaacaagccattggaacttggaaagccgtttttctaaagaaaaaacatttttcatttatgtagtgcacagtaactggcagagacatggcagtttgcttgtcgcactaatttacacaaagcttgcaaattaaaataaagcattgtacaaaatggagaaaaggtgtcagcttttctttttctatattttttttacgaggcgtagctacagatgcttcgtttatcattgaaagaaaaattagtcgtaataacatcctctggtgtgaaaggatagacgagtgttcaaagacagggagcttcacatccctcaactagcggcaaaaatcctgaatgaaatccatatttggatggcatgtggtgcaaagaatcttgcaagaatagcaccataacatcctctgctataattttttcttcttttttttctgctacccctgtcctcctgctcttcttcttaaatataaaactagctcggctggctcagtttttttaaaaaaataaaaatagtcgtaataagcatagtacttcaatccagattagatagatctcaccattaaaaacctaactagttgagcgacgatgatgtcaacttttcattgattaattaattaatcagaatgcatatatgtcgatcagggcgcaggtggtggggtggccgccggtccggtcgttcaggaagaacgtgctcgccgagaaatgcaaggcggcggcgctggtaaggtgagcatggacggcgcgccgtacctgaggaagatcgacgtcgccatgtacaagagctacccggagttgtccatggcgttccagaacatgttcacctccttcaccatcggtatatatatatatacactagctatatatatatattcaactatatatgcatgatcacacgatataataagtttctctttgtcactgtaatagaactaataaaatcaa

SEQ ID NO: 65198 - DNA, 2375 bp, Oryza sativa
gcctccatgcccagctctgcccactttgagggatataataggttggaatgatcctatatattgtttggatggagggatgaaggtgggatgcctggatcaatatattcgcatatgcgcatggtaagttgatcaatatattcttccacaatatagtagctctctttctatcatttttgttgcatgaatcctaaaataatatatgcttaatcactaaaacacatattgttatttttattgttttattttcattatcagatatcgccgtagcgttagcacgggcgtattactggttgcaattagttggggaggttaccccctagtatacatattgcaaaataatactccatccattccataatataaggcacaaccacttttttttagatgttccataatgggagaatagccactatggtccctgaagtttcgctctgagatcattttagtccttgacctttcaaattgtccaagcaagccttaaactttatcatgtggacatatacagtccttggcccatcgaaaattgccacgtgggtatgccatgtcatcttccaatgcaaatatatgatgaaatacccaatttgcccttacacatatcgtcatagggaaataagagagaaagaaaaggagaataataataataataaagaagtaggtgatcctgcatattaaatatccgttagagttttaacattgaaatgcaactactcacatgaaatttatttggcatgataattatatatttagtggttgttgctaatttaactttgtattagcataatccggtgaaaaaaagtttgccatatatccagtcgcattgaataaagtttgtaaattcttttcattatttttgtatggtacatggaagggtaaattggacatttcaccatatattttgcatgagagcataacatggcatgctcatgtggcaatttaagtgggcccaaggactatattagcccacatgacaaattataaggactcgtttggacaatataaaaggttagggacccaattgatcctagagcaaaacttcaaggatcatgttggctattctcccttccataatataaggcatgcatgcatgcatgccattaactatgacatattctccattaattactacttttttaaatccttcactctcacgttctctaactctattggatgtatgcattatatttattaggatgatccaaactacaagatgataattattatttcttggtttttggatgaaggatggttgtgccttatattttggaatggaggaagtacttagtcatgaacaccacactatttgcaaatataaagtgaattgcgtctggtaacaaacaatcaagctccataagttatatagaaaatatgagtcaattgtacccacggtacaacaacttagtaggtgggtgcaatataatgcaaaaacttgagaattaaatatctgagtgcaacaacttgataagtgtgtgcgttctactacgagaacttgacaatttaatattttggtgcatcaacttggctaagcatatgctatgtgagttttttcatgatgtcaaaatgccattgcataagaatcctacggatattaccttaaatattgaatttattctttaagaattatgctgcatatacaattttttttcatgggcttcttcatcagactaatcacttgcttatacactcaataagcgcattagtcccttaatcgtttgtcatcaattaaccaaaacccactaggagcatagatgatctttcacaaaccacatataataatagcaaagatgtattaagtcttttttcctattactaagctaagcatgtattaagtctttgattcatgtaccaacgtcttgattccaattatttatttattccgttcgaatttcaatcatgatgtttgatccttcgttcactgccacataaatgatttttttaaggcccatatacatttcaggctgaccgtaactggtggcgcctgcaaaaatcgatctctattttcgcaatatggcttcttaaaagtcccgcatgcaactctatttcgcaagtggacctcttaaagagccatatgcaaaaataagcctatttttctaggcgggtctcttaaacaaccacatgagaaaatgtattttcggaagcccggcctcttaaaggtctacctagaagtcggacttacctcctccttttccttccgacacttcattttttttagggtaatttggaaccatgccattataattttgcaaagtttgagatatgacatcggtatctcaatgacatgtaggacccacatgagttaatgacacgtgggttaggatggcatatctcaaattttgcaaaataataatggcatggttccaattttccctttttttaag

SEQ ID NO: 65199 - DNA, 818 bp, Oryza sativa
agcgccaaatagcgtggcgctgaatatgtgttggcacgctctccaaacacatgcaaacacagtgaggagggctcacaccgaaaaataacaccaagttcacagaggggaactcaccttgcctcccatgcagacaaccacaacaccagcaaaaaatttcacaatttgaccctttgcaaaaactatttttacaaaagaaccgtcaccaaaacttatttcaaaaataacccttggtgttgaatttagacacctcagcgccaaatagcgtggcgctgaatatgcgttggcacgctctccaaacacatgcaaacacagtgaggagggcccacaccgaaaaataacaccaagttcacagaggggaactcaccttgcctcccatgcagacaaccacaacaccaacaaaaattttcacaatttgaccctttgcaaaaactatttttacaaatgaaccgtcaccaaaacttatttcaaaaataacccttggcgctgaacaaaaaagtcatttttaaaataagttttggcagcggttatttgtaaaaaaagtttttgcaaagggtcgaattgtgaaaatttcagcaacaccaaggagcctatataaacaccaccacagccatgcacccctccatttttctcctcccctccctgatcaagctctgtaactaccaccactccgttccctcgcgcattggctgccacctctgcgcttgctccgccgtggccgggtccggctgggcctcagttgagcaagaggacaggaagtccgccgcgccattgatcagtgtgagaatgactaactttgaacgactaacccctaacatcta

SEQ ID NO: 65200 - DNA, 1136 bp, Oryza sativa
cttgcttgttaataatgtgatatggccgggatatccgaagtgaaaattattttttctcgatcgacacgatgtcatagaggtataggttcaaagtgaaacttatttttgttctaagcgatgtggaagtatatattcaataatcacaaagtgtaacttttctaaaattaattaattaatttgtatgtttcattttacaatgtgttttgatttttttataaataaaaattttaaagtttgatgaagtttttcgaaaaaacgtactaatcctttttaatacaactagtagtatgcacgtacgtactttgcaacagaccatgcccatataagtggataggtagattgaggataaagcactggaagcatggaccatacccatataatcggatgcgtggattgaggataaagaactggaaatacggccaatcatgcataattggggattggattgaagataaagagtggatcctgcaagggtaactccacttttaaagtagtagagaaataaatatactatcaaaatataattaacttggatttagtaaaactaatttggtattgtaagtgtttttacgctttctctatatatttaatcaaacatcgttttttaatataaaatggaggcatatcaattaacatatacttagtgattatagctagggaaggggtaaagctgcttgaacatgcattgtgtcgataattggggtgcaacctaggaatatatagccgtcggacatccatagccgactaggctattgaccttaagtacagaagatcgagagcaactttcagtcaaatcaagtcacgcacggcacgattaacaattatatgtgcatgcacgtgacttagaccacatcttttcattgattcaataatacaattaacagtggacacttttagaatctctatctagctaatctctaccccctctctcaataaaaactttacaacttgcatgaacaataatcgtatcgtttcaatctcaacaaaatagtatgcatatattaacagtggccttaaaccaagagtcaatcaacaatctacaataccccctagagtcaaatttgtttgaaattctttacacgtctattttttttatagaggattaactatttcctcacatataaacttaagtttcg

SEQ ID NO: 65201 - DNA, 17235 bp, Oryza sativa
cgttttccatcggtgtcacgctgtcaattttgcaggcctgcaaaaactactagagtacaaaagttaaaactattttttcaccatggatggatggatagattatatatgcaagtcctccaagatgtataccagtccaaaccaaaaactccaactcgcaatattaattcacactgaaaaatttggggaagattcaatatataatttccactcttttaatttaatttcctatctaatcttgactgattcccgtttcaactggagaggagatgggagtagatgcacggtgccacaatcgcgaaacgtgaataatgaaacgagcgaagaagttaggcagactgaaggccatatgagtatatgacatacacacgtgacgtcgggtacaatatactccctccgtcccaaaaaaaaaacaaaccctgtgtttgcgtgtccaactttgactgtccgtcttatatgaaatttttttataattcgtatttttattgttgttagatgataaaacatgattaatactttatgtgtgacttgtctttttaattttttttcataattttttaaataagacggacggtcaaaaattgggcacggaaaccagggtttgtctttttttttgggacggagggagtacaaagtaaaatttgacgagaggcaaggaccccacttgtcatacactaaatccaccctggtatacatgacactaaaagtaggcaaggaccccacttgtcatacagtaagggctcatttgaatcgcaggaatgaaaaaacacaggattctgataggaatacaattgtaaaacagagaatttgtaaaacacaggaaaaacacaggaatggccgtttgattggaccacagaaaaaacataggaatctgatgggagagatagatagactcagaggaaatgttccaagaggttagacctcttgctaactttcctccaaaatatgcataagattacccattccatagaaattttaaaggattggataggattcaatcctttgtttcaaagaccttcgtaggatttttttttccataggattgaaatcctccaaaattcctacattttttctacaaatcaaaggtgccataaatccaccctggtatacatgacactgaaagtatatattaattatatgatagcaatagattttctatcgttttctttacaatgtcatggaggttgaactttcaactaaagtgatattacctcgtcaaagaaaaagtgatatcacctccatctcaaaatattgcaacccggatctggacagatatctagatttattatagtaggaacaaattacatcctaaattacaatattttggaatggaggaagtaataagagtaatttgaaagtgtgtggaaaaggaaactttagctctttatgtgcggaacgcagcctaactacctaagtagacactacaggaatattggcacgcatgttcaaaaaataataaatatggtacctgtgaaaaacagacttttaatagacaatgagagagataggtaactgagtcatctctaatttctaactcccatggaattactagagaagccaaacaaactgcctctaatgtcaatcagtttcgctttccatccttctcatgctgtcaatttatcagtcaatcacactacaaaattaacataatctcttttttttttcttcaccatggacgatggatatatagatagatagatatatttatccgagtcctccaagaacaccaaacgagaagctccaagctcgcaataattcaccaagaatcgcaccacttttcaccttttcttctcctcctccatttccatccatggcgacgctgctgctgctgctgcacacggcgcaacagtgagctatagctagagctcggcaccacgggttagcaatggcggtggcggcggcggcggcggcgaggcggcgagatgtctcttgtcttctcctcctcctgtgcttcagctcgtcaatggcggcgaccggcggcggcggcggcggcggcgagcaggaggctgacagggtggcgcggctcccggggcagccggcgagccccgccgtgtcgcagttcgccggctacgtcggcgtcgacgagcggcacggcagggcgctgttctactggttcttcgaggcgcaggcgtcgccggcgccggagaagaagccgctgctcctctggctcaatggaggtctcgatcgcttctgctttttttttttctaaaaaaaaagaatttgctgcagtaaaagctctgttaaatgttaatcggttaaaaattctgttagttaagtaagtaattactcctagtaaaaactacagtttctgtttgttcttttgtgtgtgcgatatgaaaaattcagatattttctcttgggtatttgttctgtggagtacttgtcgtttatgtttgtttagttttgagatgaggtttcaggttaaatttgtgatcattggttaatctgaacttctgaagagctgcttattgattttttttctttcaactgatcatattgcataaatataaataaataaatgattgttgcatgcaacatttatgttctttcttgatggttaattaggaatatttttttttctaaatggtttgttaattttgttcttggttttgtcaggacctggttgctcttccattggctatggtgctgcatcagagctagggcctctcagagttgcaagacaaggagcagcactagagttcaaccagtatggctggaacaaaggtgcagagtttattttgtttcctttaattcctgaattatttaaatatttttcatgcttaacatcactgacatttgtctttagtataattctgaaaacattttttttgtgctataaaattggtctttgccagaggctaacctcctgttcttggagtctcctgttggggtcggcttctcctacaccaacacatcctctgacctctccaatcttaatgatgattttgtaggtaattaagctgattgtaaaatgatactctagtttgcttggccatctacaggtgatctgaatttcgattgccttgtaataatgattagaagtgtaattttgtggcatcctttttttttttgttgcagctgaggatgcttatagtttcctggtgaactggttcaagagatttcctcagtacaaggacaatgagttctacatctcaggggagagctatgcaggtaaactcatttcagaaatgaaaccggtaaattttctaatcagttttgtatggtctaacattcagaattcttcattttcatcaagaaattaaaagatttcctaaccgcaacatattacaaaatctggtgtgagacatttttctcatttgttctcatgtggatgtaaacatgtccaagatgccttcctttcaagattccagttatctaatcaaaatggaaggcagcatcccaatccttgaccaaaattttcttatcgtttgctttcacaatatctcaaggattgtatgtatcgaattatgttagtgtcaccatcttatctgaaaccagaacttccactgaagaaaaaaatcatcactgactttatagaactagctgacacctatcatgagttcatgacagctcttagttcagcaatcatccccttagcaagcaaacaaaagatcatacttttaatggtgaaagtgtcagatcaggaaccaagtctctaaaataatataaggtttagtttcagccttctcaaatattcctgaagtacaatattctcagagtcatctgattgttcagaattcagaagaaatttatgtagaattcagtaaaagatgacctgcttaaacaaaaggtagaatgatttcagttgttacttgcatttatgtattgaggacagaaattataccgatgccatccgaactgatagattttctctgcttgaaacaaagtttgagtttttggattgtaatattggtccattagatctctgaacatatgtccctgaaagaatgaccaaagcatcagtggtaggttcacgggctacattgggcttctttcacaatccacatgctgtggaccagaagatgctctgcaaaaaaagcttttgttctgcacatcatgcaagatgaatctcaatctgaacttttcctgtgcaatgtccctgttatacaggtcactatgtgccccaacttgctgaccttgtctatgagaggaacaaagacaaaagggccagcacatatatcaacctcaaggggttcattgtgagaatttcttgaattgctttcagtaattattgttatggttttgccaaaaagttcttttatgtgaaatgtgctcatgtataagaaaccatatacaaacttagaaagtagaaagaactgtttactctcaccgtttcatattgcttgtcattttagctttgtcttaagtcaaacattccttacaacttacgccataaacttttactcataagatttatgtttttagattgaacaaaagaaatactttcataatatataattcacatgttcttaaactatatgaatttacagaaattgatggtcaaagttaggtatattcgacttaggacaaaactaaaacgacaagtaatttgaaacggagggagtattttgaacaatagtttctcagttgtaatgctcacaggaacacccaattggaacacgattaacttccatttaaaccatcctaaactcataaaattggttcctgcatgaacataacagtcaaaaaatctgcttgcaggtaggcaaccctctcaccgatgattactatgattcaaaaggtttggctgagtatgcctggagccatgcaattgtgtcggatcaagtttacgagcgcatcaagaaaacttgcaacttcaagaactccaactggactgacgattgcaatgctgcaatgaacataatcttcagtcagtacaatcagatagatatatacaacatttatgccccaaagtgccttctaaacagtacttcagcatcttcacctgatcgtgcattcttcgcaaataaccaggtaaaactgatccatatgcaaaaaaaaggataaagtttcattctggaccctcttctgaaattcatgcatttctgtgttttgacaggaacaattcaggtggagaatcaagatgttttcaggctatgatccatgctactcatcctatgctgaggactacttcaataagcatgatgtgcaagaagcattccatgcaaatgccagtggactgcttccagggaagtggcaagtttgcaggtgaattagcccaaagatttttcagttttatatttcaatgtattagccattaattcttttagcttgacaggaagctgagctcatccatttctttttgcagtgaccaaatcctcaactcttacaatttctcagtactttccatcctacctatatactccaagctcatcaaagcagggctgagagtttggctctacaggtttgcctcatcttaatcttagacctgttcaattaaatccatttttcagttttttttatcattcacctcagatcttccccattatcctccatactacagttcttgtacagtttctctgaaaccttgaaattactgttcaaatatattggtagtaatatgcatctacataaaaaatatgcaacaatgccctacaatttacctgaatcagtctctgttcatcaaagcagcggtgatgctgacggcagggtcccggttatcagttctcggtactgcgtggaagcactcggcctaccgatcaagaccgattggcaatcttggtaccttgacaagcaggtctgcaaaccagaagctgaactgaacatcaatacatcatgtgatttgacttgtatacatgctgaaacatggagcaaaatatttcaatttgcaggttgctgggaggtttgtggagtaccatggaatgacaatggtgactgtcagaggggcaggtcacctggttcccctcaacaaacctgctgaagggcttatgctgataaatgcattccttcatggtgagaagcttccgacaagcagatgatatgcgctgctgatgaagctttggaggtacaagatggcatgagatacaggcatggacatcaattttcattgaaaggcgccaatcggatagatttgatatggtagtatccaaatcaatttcaagtgcgccgtaaattcagtactctgttgaacattcttttaaatctgttgttgactatgactttcttcttttgtgttttttttactcaccttttccatattataagtcgttttgggtttgtcctataatcaaactttttaagtctgacagtttatagaaaaataaagtaacattttcaacataataaaaatacactataaaaacatattcaatggtggatttaatgaaactaatttggtattgtagattttatttctttctgtaaacttggtcaaactttaataagtttgacatatatcaaagtatcaaaccgaaaatgtcttgtagtataaaacagagggagtgacacttagtgaattataccgatatgtattggcagaattcagcaaagtttaggtgacaccagggaagaatgccccaacaaaagatccaaaagacaacagtaagtcgagcaagtaggatatcacccgtttcttctgccttgaccaaattctcaactcttgaaatttctcactactttccatcgtacctacatattccaagctcatcaaagcagggctgagagtttggctatataggtttacatcatcttaatcttagatcagtcaattgaagtcatttttcagttttttttttatcatgcacctcaaatcttccccattatcctgcacagtacagtttctgtacagcttctctgaaatcttacagttaactgttcaaatatattggcaatatgcatatataatccaaaatatctaacaataacatacaatttacttgaatcagtctctgttcatcaaagcagctgaaatgaacatcaatgaattgactattagtattcatgctgaaacatgcagcaaaacattgcaatggtgacagtcagaggggcaagttaccaagtttataggctgctttcttctggaacggttgcgatcttctcccccacacacgcaaaacagagcaagtaattacgcatttgttataaacagctttcctacagatttttttttgtgcaaaaaacacaacgtttagcggtttgaaaagcatgcacgtggaaaacaatggagtagatggcatgagatatactactaggcaacattgtataggtggcaagagatacaggcaagaacacggggacatgaacaccaaacttcgttcaaaaaggaccaatcgggctgaatatatatgacagtcgttcatatgaatattagcagttcagccaaaattaggtaacatcctaggttaaacgccccgacagaagtcatcaagtcaaagaacactcgaattacataacattcactaaattatcctctccaggtaacttcagtcttgctgtacatcctcaagccatcctccgtcaggcaacctaaaattcaacacatttatcgctgcttaaggggtaaaatctaggtattaaaacaagcaaagtagaacaattgtacaatagtttagagaagtttacctttcctgagctgactttaaatctaagggtaaggtaattgtctccttgcatgtaccttcaatgtcatgtacttccaactacacaagaaaagtaattttgctaattatttttccccaattttgtaaaataaataagtaatattttttgttattatataatatcagaccttgagaaccatcgacctcttctcacccaggtatctccgaccaagatgaaggagataatcttctatctgttcacgaattttaaaaatagaaatcacaacacatttgtattattcttgcataatattgattacttgagacaagaattcatttcacctcaggcaacatagtcccgcacttatcctcaaaaaagatcacgtcaccccgtctaacaccgagattttcaagagcagaatcattggctatgtgttcaacaataaagccaccttcgatgttatgtttcagagagagctcctcccggagtgagaaactagctagttccacactttttaaatccatgtcaaacacagggcgggcaacacagctacaaataagatggatttagtctattagaagaaaatgagtgctagtgataagatggatttactctattagtagaaaatgagtgcgcatgttggtgcgccgaccactttatagcccttgtatattatttagcaaattgaattttaagacttaattttaattgattttaggtattttttaatcatggattactttccagcatttgctttttcgaaccgctaataacatagatataaaagatttatccataaaactaataagaatatatcgtgattagtgggtttacgtgctagataaactttttaactttgagaaattgctcaagacgatattatgggaaaatgacatctaaaaagttagtgccatttccataatatagatagtttcacatgtacataacataatctgtattaggaggaaatacatatcctaaaacaaatgtcttagattgccaatttctatccatcattttgtagtgaaattacatgctactacttacactgctcatctagttccctgtttattgttttcttcatacaggctactactatacccgtatgtagtgtagtggttttatccaaatatttttcaatggttgcaacataatccttgcttccaattttcttttggcatttaaacatacaatattatcgtaatgaagttaatttcttcgattttgattcaaacggcggtacattttagtactgatggaataaagaaatttaatactgatggagaaagagtatatacctaaattgctcccacatctcatacaaggcatgaataattgagattgaaatgattgctgcacaagggccgtctctgtatactacagcaatgatactaccacagtagtcaaccacaggccctccttcaccaccctgcattaattaaaaaaataaataaataccactaagtagaaggtaaaataaatagcaagtgtgaagaaaaggtatttacctcaggaacatcacaatccagaaacatgtaatggtttctccacatcaaagaaccatccgaccaggtgattgctccacgcctcgccaccagggacatattttcatcccgagacaaggcaagaatttcttggccatactttgctgctgacccaaaagtggggacctgcaatggtaggtcagacgtgatctccaagatggcaagactgtagtggcgattcacgaatatcaaccgtccctgcacgatagacttatctgggagatgaacccatagctgaaagatagagagagcaggcaatgggagaaaaaaaaggttaatgccatattgttactcattttaagcacaagaaacagaattaatactaaggatatacaagaaaaggcctgacaatgaaaatgtttgagaattgaaatcagagggctgagtaaagttcgcacaaagcaaatgcacggcagcccagctaccgttagcaattacttgaccatacttaataaaaatggcaatggaactcggatgatagaaacatggggattagctaatggaaatcggtgttctacacttggaccaagaaattaaagaaactggcaggcatgaagagtcatttttagcaattgggtttgcccctacttaacaagaacaataatggaactcggatgatagaaacatggggattagctaatggaaatcggtgtcctgcacatgccccaagaaatttaaagaaatatacaggcattgtaagagtcatttatagaaactgaattgaacatgatggttaataataacagattacacacatatagaagccacagtatatatatacagaagctgcaggaaaagaagcctgcacctcgggttggggctcatgcggcttactcttgaagtcagtggagtagatcgtgaggatcatagcacgcttggtggctccatcccaactgatgacggtgccggtgagaggagagataaattttccctctgaaaaacatccggttgattagcaggtagctacatacatagctagaagttgatataaattcatattttgtatcgggctactactaaatacatattttccctttcgttgcaattcgaactagacattgtctatctcgcctacagctaattaagtttgatcgatgactagattagcactacatccatggttaccatgggagtagagagcagcaataattttctgattttgactgcataagtagatcgatcaatctatcagacagtaaagtgggttgactcagttgaattagaagtagatgttaattaccagtcggtggagatgaaacacggacgattgagcgagacatgcccaacaccatcttcttgtcagagggggtgggcatggcggccgcggtggagggctcgtcttccgcatcccggagagttgccttccgaagtcgatcaactgaagaagatgaagaagagaaaaaaaatataggtactcaaaaaaattggggaagaaacagtggtggggatggatggatcgaaagctcaagaaaacctttgcgctgggcgatccaggagctttctctgccgatgcgcggtgcggtggagtgcggctgcggcgggtggatcggccggcgtgccaaggtaccaggctcccccgtcgtcgtcgtcgtcggaatcactgtcgcccgcgactcccccgccgtctcctcctcgatccttctcttcttgttgttgttggaagagattcccggcgattccaccgcctgaatcggaagaaccagtccaatctgctttgctcgggagcgagtcaacctccccgaccacgatccgggattgggaatgccgtcgtgcgagcggagatcggaatccggcgttgatttcgaccgtgccgacatcgccggcgacgatttggggggcatgtccgcctcccgccgcaccaatcgccgccgccgccgcgcgttttttttttcttcactttttagctactagaaaaatgcgaagtatatttcaatcttattactactatatttattactaatgtatagtactccctccgtttgacttttttaatcaacgtttgactactcgtcttattcaaaatttttatgtaaatataaaaatacttatgtcatgcttaaagaacatttcatgataaatcaaatcacaataaaataaattataattatataaattttttgaataagatgaaaggtcaaacatttatcaaaaagtcaacggcgtcatacattaaaatacggagggagtatatagtttagttaggatgaaatttggagtactgtacgttcgcttggatatatattacctccgttttttaatagatgacgccgttgactttttctcacatgtttgattttttctcacatgtttgaccattcgtcttattcaaaaaatttatgtaattataatttattttgttatgagttgttttattactcatagtactttaagtgtgatttatatcttatatatttgcataaaatttttgaataagacgaatggtcaaacatgtgagaaaaagtcaacggcgtcatctattaaaaacgaagggagtatatttttagaaaatcatgatctacaggaagtccgatcgtcttaagttagcatatgagtttttttaaacagatttcttatatgagtatgattccttatgtattaccaaaagcaaacgaacttaaaaaccgacccatacacaaataccgtacaaataccgtagagatatagattaaaaccaaaacataaaattaaaaccgactcaaacacagataacgaaccacggaaacatcttcaatttttataagcgactcaaatatggatgacggaccgcggaaacatatttaatttttataatagataatagattttcaaccacaccaaaatttaacaattttactatatatttatcggtaaattttcttttaaaaatttgacagatgtaattacattacatagtgtagcacaatgtaacttgtatataactttcatccgttagattttgtttcaagatttgtgcaagtgaggaaggaaaaaagtcagagcacgtatttatgagaggattcgttcccacgaccttctatttcaccgaaatagcatgttacggagagatttttttaaattacatacaagttacattgtagttacatgcaaattacagtgtaattattttacaattatactataattacatctgtcaaatgtataccctctgtcccagaaaaaagaccaatcctatctacgaatttagacacgtgtatccaggttcgtaactagaatttattttttccaggacggagtagtaggtgataccaaatttaatgatagtaaattttagcagattcaaattttgatagtattaattattgtgtttagtttcaaatgccatgtgcttctcgagcgactttttgaaaacaaagcaatcctccagagaatgtctatctgttttgtgtatggggcaccatgatttctttgtgtcgctgccttgtgggtccgggcgcttgggagggttcgcgtattctgctgcgaggacttccgcttgagctttccttttcccgtttttgcgatttttcttcttgctcgactcagatgtgtctgcggctgacttcttctctcccccagtcttcggtttgtcgttcttgcgtcttagtgcgtcatcgacgtgggcacatctttcaacgatctcgaataatcttcgagtagttgtgatgcgccttgttgccaactcctgggtagtgtagcgatctctgacaccagacttgaaggcgcgaattacagaagcgtcagtgatctcggggatggtgttcctgcactcgttaaagcgcctaacgtattccctcaaagattcacttgagttctgtgttaacgcgtgaagatcgtcttcgatcgcgtgacgcttgtatgttccttggaaattggcgacaaactgatgccacaggtctgaccacgaagaaattgagtaggggggagatgcatcagccacgaacgtgcagaacccttcaacgcggttggtaaatagtttgccaatgcattggcatctgctccagcggcataaagcattgtcgagtagacttgaaggaattcttccgggtcggtgctcccatcatacttttcaataactctaggtcggaatctctcaggccatcggacatcacgtagggaacgaccgaaagccctacacccagcgcttggagcggtgggttgtcggtggtcgcatgaccttcgtggatgtcggtctgacgatgaagaggacgcggatgatgacgatgatgacgatgggtcgcttggttccggcgtgcgattacgagggtgacgacctggatctcgggaatcttgtcttcatctctcgttgttgtctcgacgctgatctccttcatcttcgtcgttacggcgacggccgtgaccagtgttgtctggccctcgccgatcgcgatcgtcatggtctcggttctcttttgggcgacttcctcgatcatggcgtcgtgaggagacatgacgccgggagtggttcgcgtcatcccgtgtgcgtcgtgcttctcggcgtccgttgatttgatctcgaagatcgccagtgccacgaggtggaggggtagcttgtcgaggtgattccctccgttctggactttcaccgttagcgtcgccgactggcgatcggttttgttgtgctgcggtgatggcttcttcgaacgcattgctgaggttagtcaccgatgcccgtactcgttccgtccaacgctcgaggtcgttgttcagaacgggatcgtaaggtgtttccctcagtatggcttgaacagccctgatgtgttgggctggggtagtcgattgattcgccgccaccgcattggcttgtgctgacgtgccaacgtcatcgatagccaacacctcccgcgccgcgtctgacgttgatgacccatagtcttcgaggagatgtaaaacagatggttcatggggattgagatcgattaccccaacgaaccgatctagggctggagtcgctccttgttccttgctgttatcccggatggggacgtatgacttaggagacggagttttcatggcgccgagtagaattttgcaactcgagaggtcgtgattctttgtcttatggataggacaatagacgttccgagttggagaagtacgctggatcccacgttctttgcaggcgcggatttcagcacgagcgttgacgaatacccagtaatcttgaagagtatgtttcttggttttatgaataggacaccaagacctgatagtttcggaagtcatctttgctggcccgcggtttgtgtcggagggacaaggcctggccgcatcagaatccttcacgaacttggatgtagtcggtaatccgttctccgtttcaacgggtggatttttcgacgtggaggcgtcttggttcgtagccaccgcgttctcgttcccagtcattgggggaccggttgagatcggcattgtggtgtaaaccgggtagacgatttcgccgacttgagtccataccagcattgttgaggtaggaagaacttgagcggagctggtgttggcgttgttgtcgacgaagcttgatggcatagtagtagaaccttgaataccaagtccccctacctggcgcgccactgtcgacgggggatacccgtagaccggatatagagggtattggggtacgctggtataaggatctacgtagtacgacatcaagcaaccaaaagacgagaattatactggttcaggccccttgataggtaatagccctaatccagttgatatgggattatatggtggaaaacacagattacaaaggaaaagacggaactcgggggattcggcgagattgtagtcgagatgattcgactagctctcgtcgacttggctccttgcaggctccgacttcataggctgtgtgggttatgttgactctgagattcgatgatctatgccctccccggggggtcccttttataccgcaggttgggtgctctccgagtaggactcgaacataccagacctgacacgatacgtaggtaacccaattcttgtccgagaaggtctctccccgtccattgatttcacgaagagtttccttagatgccaaaagatctattcgtgtacacgtggatatgccatgtcgatacatgacgtatatcgaggggtagagggtatgcctgacccgtaaccctgacaatttagtagaatttttaagattagaaacttctagattattaatttaatttagtaaggtagtattggtaagagtatgtttggtttgtaataattaaaaaaaatggtaaggatataaatatcaacaaagttaacaagctcgtatatcttcgtcccactcatatcggattccttttatttttttttaacaaattttataaaatcacacctattattatctaagttgtataaaattatagggattttagtacgtgacatgtagctatataggtattgtggttttaaagttcataaaatcacaccgttaaccagtttaacatattattatatcaaaattttaaaatactactcctcccgttaaaaaaaataaatctagaacgggatgtgacatattctagtataataaatctgaatagagatatatccagattcgtaatactggatgtgtactagtttaattttttatggacggatggagtatataacaattaaacgatggataaaaaatttataaattttagatgtgatcttagaactcacggtactactgtgtgtttggcaaactgaaaataaataaatgtctactagctccaggtgatatacatggccgtattactgatgcctagacctacgattcatgtaccaacatcttgattccaattgtttatttatttcgtttcttatatatacaagcagccgttcgaatttcaatcacgacgtttgatcgttcgttcactactacataaccaatttatttttacgagggcccctatacattgcagcacaccgtaactaattgtgcctataaaaatcaatctctattttcgcatatggcttcttaaggacccaagcaaaaatttattttcgtaaacggacctcttaaaaaaccatatgcaaaaataagtctatttttctatgtggatctcttaaaccgcaacatgagaaaatatatttttttagacgggtctttaaaggtccgtaaagtctgacttaactcctttactctcagcacctcaaatttttttaagtcatcatcctcgtctctctcctcgtattattgcaaactcctctctctcccctctcattgaaaggcgccaatcggatagtatccaaatcaatttgaagtgcgccgtaaattcaatactctggtgaatattattttaaatctgttgttgactacgcctttattcttttgttattttactccccattttcatattgtaagtcattttgggattgtctagtcattttttttaagtttgacaaagttcacagaaaatatagcaacattttcaacataacacaaatatactataaaaacatattcaatgatggatttactggaacaaatttggtcttgtagatgttatttctttctttaaacttgatcaaactttaataagtttgacatagatcaaaccaaaaatgtctttagtataaaacggagggagtgacactaagtaaattatactgatatatcaacgatatattggcaaaatttagcaaagttgaggtggcaccagggaaaaatgccccaacaaaagatccaaaagacaactgtaattcgagcaaacacctattgagatcacccgtttcttctgcagtgaccatacctcaactcttataatttctcagtacttaattccatcctacctacatattccaagctcatcagagcagggctgagattatcatgcacctcagattatccccattatcctccacggtacagtcctgtgcagcttctctgaaatcttacaaataactgtacaaatatattggtaatatgcatatataatccaaaatatccaacaatgacctacaatttacccgaatcagtctgttcatcaaagcagccgaactgaacatcaatacacatcatgtgaatgtcattactagtattcatgctgaaacatcagcaaaacattgcaatgcaggtttgtggaacaaccataggggcaagttaccaagttccgcgttcgtttggaacagttgggatctctcacacgcgcatgcataataaagcaagtcattaacatatgat

SEQ ID NO: 65202 - DNA, 1257 bp, Oryza sativa
tagtctcccatccgcggtggcacggcattcagcgccagttgacatagcgctgaggtgtctaagttcagcgccaggtgatttggcgctgaccaaaagagtcatttttaaaataagttttggcagcggctcatttgtaaaaaaagtttttgcaaagggtcgaattgtgaaaatttcagcaacaccaaggagcctatataaacaccaccacagccatgcacccctccatttttctcctcccctccctgatcaagctctgtaactaccaccactccgttccctcgcgcattggctgccacctctccgcttgctccgccgtggccggctccggctgggcctcagttgagcaagaggacaggaagtccgccgcgccattgatcagtctgagaatgactaactttgaacgactaacccctaacatctaacccttttgttgttctgttgcactgactcactaacccgctgactctttactttcagttgtcctaacctctgactcactgactcactgacctttccatttttgtttcgctaacccgctgatcctttcagttgtgtgatcctttgttgttggcaatcgaaagcgtagtgtgcgaggacgatccgcgagccaatcaccgacgctcggcgaccatgcacggtgtgccgctacccggctgccgcaaggtgtgcagcttctcctccggctcactctccccatcgcctccttccctttccaaccgccggcctcctcctctccacccctgtcgaactccatcccctcattgtcattggcctccgccactgaagccgccatcatcgtcgtcctcatcccagccaacccccaactccgcacttcacgtcgccatggcgccaggctaccgccatacgccaccctgccccgccgtgcgcgcggctgcgccaagccgccgccgcaccgcggtgcctccctcgcctgcgcacagcccaaccgctgccgcccgcgacgacaccccgacctcctcctcccaatcctcctctccctcgcgccgtcgcgctgagccgcacgcggcctagccgccttgtcgactctctccaccgttccccacatcaccgagccccctcccctctgtctgctgcgcgccagccccgccgccgtcgcgcctgaccgccgccccgatctctccagggccgcgccaggaccaccgccgcctccctatttgatactggcatccatcctcaccatcaagctccacccctccgcggaccctctccccactgcgacaatcctcccctccccat

SEQ ID NO: 65203 - DNA, 16070 bp, Oryza sativa
cggttcaaaactcgtcttcagatccaagtcgacgacatggcgaagcaaaacgagggattcgagaagactctgttggagattcaagcggcgatcggaaccatggtcgtcaagcaaggagagacataagagatgctgctcaaactggacaaatctgtggcggggtggcgacctcaagttgatgctgctgtacaagggttgcagcacgacatggaggagctgaagctgcatgtcctcaagttggagaagcagagcgaggagggcggcaattcgtcgaacacctcgcaggcgtcaaggatggcggaggaagggagtcaccaaactcctctgcttcctacgcccagcacgctgccgttgttttccggaacagcggcgagcgatctcggtccagatggccatcgcgtcacaaattttcaccgggggaaggcatcgggggtagttcatactctcgggccacctccggtcaagggtacgttccagattcccactaaattttctgttcctcatggggttgagtttggcgcaaattcgagtcggggaaatcgggatttgcatggggagcaagggttcaatcataggctaccgaagttggattttcctcagtttgatggttcggatccacagagttggaggatgcgttgtgagcattattttggggtttatggaactcatccaaatttgtgggttcggatagccaccatttacttcatgggaagggcagcgtcttggctacgttcatctcgtgctcatgaagtttttgtcgattggggtcgattctatgaagcgatgaaccgaaaattcgacagaaatcaacatcggcaactgattcgacagcttgatcagattaaacaaaccggttcagtgagcgagttttatgaacggtttgatgatctgatgaatcagttgttgacgtatgatcctatgtataacactttgaatttggttcaccggttcatagaagggttgcgttttgacattcgcgaagctgttttgttacattgtcccgaggatttggagtctgctctggttttggctctattacaggaggagttgtctgagcggaatcaagagcaaaggaaatttgtggatggatcgcagaagtttaaaaatgcatatccattaccattgccaccaaccaaggttttgaaaactgaggagaagaaaggcggagagctcaatcggggtactaatctttctgacaaggttagtgcacttcgatcgtttcgtcgtgcacaaggtttgtgttacttatgtgccgaaaagtggtcgccgacacataaatgttcaggaacagttcagcttcacgctgttcaggagctctttgcactatttcctgacaatgcaaatgaggatcaggctagcatatcttctgaagatagtgattcttccttgttagctatgtcagttcatgcagttcagggtactgattctcagtctaccattcggttacaaggaaaaattcaggggttgaatatactgatgcttgtagattctggtagtttggctagctttatcagtgatcaattggctgaccgtcttactggagttcagttcttagctcatcctctgtctgttaaggtggccaatggacaggtgttgcattgtcagaaagaaatgccttctgctgaatggtttgttagtggtcagaagttcttgaccacatttaaagtggtggccttgggaggttatgatgcaatcttaggcatggattggttaactaagtatagtccaatgcaaattgattggcagcttaagtctattcacttgacagttatgggtcatgaggttttgttgcgtggggtgcagtccgatacttctgattgtgccttgatttctagtcagcatttacagcatctgcacagtatcgactcagtggcaggtttggttcacttatgtgcttccctcagtgactctacagaccagttatcctcagttccagatgttgtctagtctttggtacatgaattctctcatttatttgaggaacccagtggattacctcctgctcgagattatgaccatacaattcctctaattcctggggctgtgccagttaatgtgagaccttaccgttatacacctgcccaaaaggatgagatcgaaaaacaggttaaggatatgttacaaaaaggaattattcagccaagtgctagtcctttttcttctcctgttttgttagtcaaaaagaaagatggcacatggaggttttgtgtggattatcgccatcttaatgctatcactgtcaaaaacaagtatcctcttccaataattgatgagttaatggatgaattggctggtgcttgctggttttctaagcttgatttgcgttcggggtatcatcaaattcggatggcagttggtgaggaggctaagacagcttttaaaactcacaatggtcattttgaattcaaggtgcttcccttcggacttacgagtgctccagctaccttccagggtgtgatgaatacagttttagctgatcaattgcgtcaaaatgtcttggtctttgttgatgacatcttggtatacagtcgcactttggaggagcacaagaatcatctgcgtcaggtgtttgagactctgagtaagcatcagttacgagtcaaattgtctaaatgttcttttgcacaaactcaactgtcttatctagggcacatcattagtgctgatggagtttcaacagatccagaaaagattcaggtggttcggcaatggccagttcctgtatctgttaaagatgtgcgcagcttcctaggtttggcagggtattatcgcaagtttgtccgacattttggcatcattagtaagccattaactaagctattgtgtaaggggcagccttttatctggacacaacaccatcaagaagcttttgacactttgaaacagagtctgatatcagcaccggtgttggtcatgcccgatttccagaaaatgtttgtggtggagactgatgcttctgatcgaggtattggtgctgtgctgatgcaagatcagcattcggtggcatttttgagtaaggctttaggacatcggactcaagttctttccacttatgaaaaggaaagtctggctattattcttgctgttgatcattggcgcccgtatttacaacatgatgattttttaattcgcactgatcaccgcagtctggcctttcttgataaccaactattaaccacctcttggcaatataaagcaatgactaagttgttgggtcttcgttatcgtattgtgtacaagaaaggattggagaatggagccgcagatgctttatctcatagatcctctgatggtcttccaattttaagtgcattatctgttggtttaccggattggttacaggatgttgtttcgggttataagtctgatcccgaagctcttcagcttttgcattcttttaaggaaggcacatgtcattctgctcattttgagttgcaaaatggtattctttatttcaagaaacgtgtttgggtgggcaataataggcagcttcagcagcaagttctggcaaatttgcacactgctgctctagggggccattctggaattcaagtaacttatcagcgagttaagcagctgagttaagcagctgtttgcttggccaggtttaaggcaaactgtgcaggattttgtgcaaagttgtgcagtctgtcaacaagctaaacctgaacatgtgccttacccagggttactacaaccagttcaaatacctgaacatgcttggcaagtcatatcaatggattttattgaaggattgccccgttcagcctcttataatagcattttggtgattgtggataagttcactaagtttgcccacttcctgcctttatcccatcctttcactgctgtgtctgtggcgcaattattcatggacagaattcattctatacatggactaccgcaggccatcatttctgatcgtgatcgagtgttcaccagtattttttggaaggaattgtttcggcgttctggcactcagttacaaatgagctcttcttatcatccacaaacggatgggcaaacggagcgcgtgaatcagtgtttggaaatgtttctgcgctgttttgttcatgcctgtccatctagatggagtaagtggttatctcttgctcaattttggtacaacacttcatttcattcaaccttgatgttgactccctttgaagcaatgtttggtcataaacctcgtcattttgggctctcagtggattctgttggggtgcctagtgcattggatagttggatgcaggatcgtcataatatgcaaagcttgatttatcatcatttggttcgagctcaacaacgaatgaagagtcaggctgattctaagcgtactgatcgcgtgtttgcggtgggtgattgggtttttatgaagcttcaaccttatgtgcagcaatctgtcatgactcgtgctaatcagaagttggctttcaagttctacgggcccttccagatccttcagcgcgtgggttctgttgcctataagttacaattacctgccaccagtttgattcatccagtggtgcatgtgtctcaattaaagaaagcagtagctgcctctgaagttgtttaatcaacattaccacgtttggatcctgattctgggcatctggctactccagtagaggttcttcaacagcggctacgtcgtcatggtgataaaatgattgttcaagctttagttcactggtctggtacttcgtcatccaccacttcttgggaagatctggaggagttaaggcatcgctttccttctgccacagcttggggtcaagctgtgtttcaaggaagggggaatgttacatccggcacaactgatgacgaacaggaacaagtgtccaaggtcgttggctccgttctgagtacggcccagcaacggcctgttcgtgtaactaggcccaacccgaagtataagggtggaaactgggttaactagctgtatataaaggagagagagaatcgggagtcatgacatgtaaagacagaattcccaactcaatacaaactcaatctctctctctctacaactctgtctttctctctgcttctcttcctctattcctctcaaactctctctgattctctgaaaatatcttacctctcttccaagttggtaacagaccccttcctgccacatccccacagccaaccgccggcagcaccaactccttccggcgcccctcgcccggagcctcccccacctctccgccctccttcaccgccgcgacagccgccgtcgctgcgccgtgcggttccccctctgtctcggctccggcgtgggtaggagagaagaagaaacgggaaacgagaggagagatcgagaaggagagaagagaaacggataagagagaagaaaggagtgggacccactaggggccgctgatccgcgaccagtcgcgcggccgcgcgcgcgcgatcaggtgcccccctctagtagtctagtctgatctcttatcctatggagtactactatttatatgtatgcacttttaatgtataaaagatacacatgtatataaagtttgtgtgtatacatataaaaaaggaataagtctacataaccccctaatgtactgttggttgattacttagccccctgacctaacaaaccaggtatttaaccccttaagtttgttaatgccgtttacttaaccccatacggtggtttttaacctgattttgccctgctggcactccacgttggacagatgggcatgcataaaagattcgagcggttcgccaaacaaacatacccccacgacttctcctcgttctctccggcggcgcatcctccgcctctgcctccccggcgagacgaagcgagctgatgttaagaagtggatccactttatcggattgcagagccgggcaaaggtgagtgtctgcaactcgtttttgtgtttttttttcccaatcagatcgttgtcactccaaggattagggctaatactacaggggtttttagtattgatattttgtattttctctctgcagtctagatggtgccatattgtgggtagtaaggctcatcgatttcaatgaatttcttgtggtaaattaattaggtgacttgacgattttagtgtttaggtctttatgtatccccgcgcgcccatcgatctgccgtggcaggcctatctaacgtggagtgccagcagggcaaaaccggacaaagaaaccactataaggggttaagtaaacggtattagtaagcttaaggggttaaatacatggtttgtaaggtcagggagctaagtaatcaaccatcagtatgttgggggttatgtagacttattcctataaaaaaatctaaaatatacgtgtatacaaactttgtatacgtgtatacaaagctggtataagtatgtataaaaaccaaaaaatacacgtatacaaactttatatacacgtatatacaaaatttatatacgtgtatacaaaatttgcatacgtgtatacaaaatttatatacgtatatacaaagtttgcatacgtgtatacaaaatttatatacgtgtatataaagtttgtatttgtatgtatacaaagtttgtatacgtgtatacaaaatttatatacgtgtatataaagtttatatttatatatatacaaagattgcatacatacgtattaaaaagggaaaacagaaaaatatacgagaagaaaaaaaagaaaaaaaagaaaaccgaaaaaggtacggaagagaaaaaaaacaaaaaaaaaggaaaccgtacaccggaaaaaacggaccgtacgcacgtcgtcgccgcctcctctccacgcgcgacacgtgtccagtcgcgcgtgggagggtgagcgcgaatagtcgcgtattagccgtttcgcccacgggaggacccacgttctagccccttcctctctgagttgacttccccctagaagtctacatcaccaccctatgctttagtataaaagccagagagatttttcacctactgaagtctacataatacccttcgcagagcctaccagtagccacctcatccactaaagtccacaacacaccctctatacaacccagagccttctcatgaagtctaaaccacctccctacccgagagtgcttcatcctccgtttataagtccttccaaacatcgaaaatccatatatttccaaccgtaactccgattgcctccattcaacttccataatccctctaaaatcgagatctatttaatggcaccattagttgtattgaatgttgctttattttatttcttttaggattgtgcgtggttattctttggttatttatcgaacgtaccggatatttatcgatcgtgggaattctagttatctaactgaagcagttatctcgaagacattaggaccgatagcaaggcaagtcactacgctcgaacatatcgatcctatgttacaaatgtgttgttttgcaaataaattgcatgctatttataaattgcatacctacatttgattatagcctgcccttgatattgattacttttatacatattgtacgccttttaatgccggagtcatttatttatatgcggtcaattattgaaaacgcttagcaatgctattgtagacatgcgtacacttcatatttacgctagatgattatggatgtgagatcactcgatgagagtgattgatgatttgcgggtggagacatgagtgccacccgccacacacaaaccgtttgcgaaaaccaaaacttaatacaacaaaacttcgactagggcggcaagaatagaatatgggtggttctaggaaacggttagtcgccgaccctggtcaattaaggaccgagtcaggaaactatgcaagaaacgaaccgagtacgaccacatttcaggtatgggcagacccgttagattaggacactctcgcaaagcggtacctcagtcatggcaagtgctgtatgtgagcgttgagtatagtgcagtgttggaaaggtaaatgacgtcaagaaatgaaattttaaaacacaccatagacaagtaattaggtaccccttatccctggagcgccaggactcccctcactatacggcagaggagttaggagtgcccgggtgcaatgggggttcatagtccttggagtaggtaccgaagagcgagagtgactgaaaaaccgggccgtggcgagtttcatgtgttgggactaggctcatgtgttgggcaagccacggagtgcgggattaaaagcgtacatccactgcaatgtgagtaaatcaatctattcgaatagccgtgctcacggttaatgagcgttgggacttgtattacacttgactagactcatagattttaatactgcatagagtaaatatgagagacatctgaaccttgcccaaagagtgggaaggttagtatagtagagttggtataagatgaaatgagagggtaaaccgaaccaagcggggcttggaaaggtggatgatgtaggaccgagatgtcgactagaggggggtgaataggcgatttaaaaactaaatgacacctaatcaaaactaacctaagttgctaggctcggtgagggttaagtctgactaagcaactaagttatgttttgcaaacctagggtgatagtggctcaattaattctctaggaaagtaaatcacactcctatgtcaatgttttgcaatcctagggtgatatgatttcaagaaagtctctaggaatgtaaattgcgcaaatgtaaatgcgacaatcaaatgagacaaggagacaagagatttttcaccgaggttcggaaactcaccggtttcgtactccccgttgagacgagcccaactccaccactcaaccacgaagccaccgcacgcccccttcgtcaaggagtgggcaaggcgggagccggcccacggagaggactacccaagcctcgatcactcggggtagttcttcctttactccgaaggcggtgaactccaaaccactcacaaaaccggcaccgggcctcctccacaatcttctcggagaggtcaccgggcaactcctccacaagccgtctagaaggcggcaacctccaagagtaacaagcaatgacctggtgtggagatgatcaatcaagtgccacactagctctataaatggaagcaatgcacttgactgtaggctagaacaacctcaaccactataatggatgaacactaagctcaaaggtgtgtgagagaggtgcaagggtgtatgcaattgaattgggtgccaagagagcccccttgctgctggagggggagtttttatactcccaccaaccaaaactagccgttgggggcgaaatcccccaactctgtgctctaccggtctgaccggaggtatgtggccggtcagactgtgctactctgcaacggctagaaaactagccgttgtagccctgtcagagggccccatcggcctggccggtcagaccgacatggggtggccggtcagaccgccctcggctcggtcagaccgccctcagctcgatctgaccgaatacgactccgtcggctctgtatcccccaaaccagagcatgacactcccagtctccagggggccggtctgaccgcgcatgtgccgccgttcagaccggccttatgcaccggtcagaccgccgtcttgtggtcggtcagactggccagggcacgccggtcagaccgccactatgcgcccctggtcaggccgaacacagtgaatctgtgtgtgatatgaaaagtgtgtgtgtcctctctaatcccattgtaattaatcatcaaaatcattaggggcctagatgcactttcaggtataccgttcggacagtgtgataccggttaggtatcaggtatcacgtgatacttcacaagtatcacctggtagcctgatacctgaacatgtatcatcccgtccgaacaggatactgtcatgtagcattttcgttttttatgctcatttaaaaatatttttgtcatttgtggttgtctaataaactaatttctgatggtgaagagcattttatcatttgactgtcatgcacacacatgtcatcccagacatatatcgtcatcactaaatatcgccgtagctttagcacgagcacattactagttgttattgggccgcaaacgcgctaggttaacgctacggagcacattactagttgttattgggccgcaaatgcgctagctctaaagcccaacatgcccgctggagccactaaaaaattgacgtgtacgtgtgctggtctcgccttctccattgcttcatcttcctctcaaatttccccttcgcgctcctgcgattgcttgctccgctcctcctcgctgaaaatctagggatatgatccccacctttttttcgccgcatatcttcgccagatctccgccacactttgtcacggtcgcttgtatctccatcctccaccaaagatccctaaatctcaaccccaatctatccactaatgactgaggagagagaagtcgagatcccatttggggaatgagcagtccaacatcatgaagaagaagtggaaggaaatggtgaagtatgacatcctccccgccaaggacatcatcatctagcaccctacagttggtgagggttttccgactcccaactctagcgaaattgcagtgttcaaactctttttctatcggggatttgggctcccaacccctggtttcttcccgtgcttgttatctttttacagaattcgactgtaccaccttaatcccaacactatttttcaactcaccatctttagtcacctctgtgaggcttttctccgcattcttccccatttcaatttcttccatcgttggtgcttcctaaagccacatccttgcaaagatcgaccctgtgttgttagcggcgcacaaaccaattgtggtctgacttaaaaagtcaatacttttcacttcctttgaaatctttcaacaagggttggcactccgagtggttctactgttcaaatcctgacctctctcttcctggcttcattgggctccctcctatccatagttcttagtggaacttgttgccctcagacaaggaaatggttgagtcaatgccatcattgcgaaactcacggacatgaggagtaaagggttgactagggtagtgtcgagggagtagatcccgacacaatattggtagagtatgaggatcattgataccaaggtatacacgagattaaggtaaaagagaccggagataaatatttttatacaggttcaggcccctgaactgataggtaatagccatactcctgtttaggggtgaaaatggggcggatatttcctgccggaccgaccgacctgaggcttgcgggaggaatatgggagagaaaatgggataccctatattatccgagttcaaacccgaatccggaaaaaaatatgggttaggatacgagaagagttatatccgcccgtatgtcctatattataaaacatatgtgaaaatctattataaactcacatataaacatgataaaagattagttaatcactatttttatgagctcacatgtaatattatataatttgttccttgatgtatcttttttagcactttaattgtcttcttacattaaatatccatgaattcgacatacaaaaaatatccgtacccgaatccgattcgaagaaagtaatatgggacaggatacgggatgagtgatgtgttatgcgacactacctgtacccgattccgaatttaaagtaagatgtaggttaggatatgggaatgttgtgatccgaccgtacccgtcccgttttcacccctactcctgttcgatcatagaagccggtgttgctcttatatatcagtatcaaatgagtacaatatttgggataacctattctagtcatcatcaacttggcggcatggatgtccaacacgtagttgacgacatggtagtcttcttcgtcgaatatgaactcgagattagaggttgtgttaggtccctcatgtcagcctctatggctccagattgggtctacctagacttgtccctcatgttggcaggtgttggtctgtgttgacgtctcccctctcctcctagggggtcttgtatttatacatatagatgctcccttgtccaagtagaattagggagacaaatatgtatatgattcgagtagcccttgtagcttccaacttgaactctacttctttcttatctggaacactttcgtatatgagacataattccctataagacttagtatatggtgggtcccgtcgagctcaatccaagactattgggtatgccttacctataacactgacaggtagatgttactcaagacatttccgcaacctataaaagaccgagtgcatcgaaccgttgattatgcaggtattgaagaccccactcgggagatatatggcaagtggtgatagccctatccgtccttcgtatccctccatattcggctacgtcatagagctacagaccagacttagcttgacagataagtggagagccggtgcccgaaacaatcaataaagttttacctttaactcaagtatattaattaatccatagaaatcctctctagcctaatcttaccattagttgttgtccttggttgaatcatgtttttagattatacatacacgttccacatagttcgatactcttttgaatactctaaggtgaagtgctacagtggtatcggtgcgcttgcggatttatgtgtgaccgtaacaaatacaaacagtcctgcgtgttgacttggctagttggaccaggtcaataagccacatcagcaaaaacagctaagggagtacaagtcaaacacagttaagggagtcaaattacactgactttaatagttggatcaagataatccggttaaaggatacgagtatacgagaggactgaaagtggacttattctcaggagtagatgaatagtactcgaattcggcccaccaccactacaccttggcctactaataaatactcctacagtatataagaggcaaaagaaaagaaaaggaatccgactcgagcggggtgaggatctaaagaaaaccctagcggcggcgattggtgcggcgggaggcggccatgtcccccaaaccgaggaaatcggtggcggccttgagcggtcccaaatcgtcgccggcgaggtcgactcggtccaaatcgaagccggattctgatatcgccgagcacgacgacagtcccaaatcgtcgtccgggaggttgactcgctccagagcaaaggcgattgaacaggtggggaatcggactgtggaggagtcggcgggagtgtcttcgaacaagaagaagagaaggattgaggaggagacggcgggggagtcgccggcgacgggggctccggaggggcatggcaccttggcgtcccggccactcccgccgacccacccgccgcctacaccccgcgtcagaaaaagctcctgcatcgtccggctcgaaggttttagctttcgatcccctccccaccactgttaatttcttctactttcaattttttgtatacctatcattattaaccatgttaatttctccccatttctcttcttcagttgctcgacttcagaagctaactctccggcgcgataagaaagatgatccctccaccgcggccgctttgcctaccccctccgacaagaacatggtgttgggcatgtctcgctcaattgtccgcgtttcatccccaccttctggtaatttactccatccgtcccaaaaatatggacacatcttagtacaagtttggaggcatgttcagattttactgcctgaatctactgtatttactgctaacttagctactaagtgagccatgtgctaggctgttagcatgccacgtgtggttaattgcgttgttttacgcattccctatctagcattacatcagaaaatcatgctgcatctccacatgggaattaccgtggattttgtgctaaactagctgcagatgttaagggaaaagccggtgatataaaagaaagctaccgagatagacatgtgtagtccaacaacaaatggaaatatgtgttgtttagtgtatttagtagcccaatacaaaatatgtatttatcggctcctagctatgtagctacctgctaatcaactgaatgtttttcagagggaaaattgatctctccgcgcaccggattcgtcgtcattgggatggagccaccaagcgtgctatgatcgtcacgctctccacttacttcaaaaagaagccgcatgagccccaacccgaggtgcatgtcttagctaatccccatgttaccatcatccgagttccataactgttcttattaagtaggggctaacccaattgctaaaaatgacttttcatgcctgccaatttctttaatttcttggtgcaagtgtagaacaccgatttccattaggcaatccccatgtttctatcatccgagttccattaccatttttgttaagtatagtatggtcaagtgattgctaaccgtagctgggctgctgtgcatttgctttgtgtgaattttaatgtgccctctgatttcaattctcaagcgttatcattgtcaaattgatggccttttcttgtatatccttagcatgagttccgtctcttgtgcttaagatgagtaaccattaacctttctttttctcgcattgccttctctctctatcttccattaacctttctttttctcgcattgccttctctctctatctttcagctgcaggttcatcttgcagataagtctattgtgcagggacggttgatattcatgaatcgccactacaatctctccatcttggagatcacgtctgacctaccattgcaggtccctgcttttgggtccgccccaaagtatggccagaaaattcttgccttgtctcgggatgaaaatatgtccctggtggcgaggcgtggagcaatcacgtggtcggatggttctttcatgtggagaaaccattacatgtttgtggattgtgatgttcctgaggtactgatacatttaccttttcttcacacttgctatttgttttaccttctacttagtggtatttatttattttttaattaatgcagggtggtgttggagggcctgtagttgacagttgtggtagtaccattgctatggtatacagagccggccctggtgcaattatcatttcaatctcaattatttgcaccttctttgagatgtggaagcaattcaggtatatactctttttccatcagtattaaaatatactacagattgaatcaaaatcgagcaatttctatgtggcacgtaaacccactgaatcacgatatattcttattaattgaatgtttatggataaatcttttatatctactatgttattagcgattttaaaagccaatgctgaaaaaactacgaaaaaacacctaaaatcaacttaaaattaagttttaaaattcaatttgctaaataataaacatggcctacaaaagtggttggtgcgccaacatgcgcgctcattttctcctaatagactaagtccatcttatctgtagcgctcattttctactatagactaaatccatcatatctgtatgctcattgtctactaattgactgaatccatcttatttgtagctgtgttgcccgccctgtgtttgatgtggatttaagaagtgtggaactagctggtgtgtcactccgggaggagctctctgttaaacataacatcaatggtggctttatggttaaacgcatagctgatgattctgctcttgagcatcttggtgttagacagggtgacgtgatcttttttgaggacgagtgcgggactaatttgcctgaggtgaaatgaattcttgtctcaagtaatagtttaatataaatcaatatttgtcaaaaaatgtgttgtgatttctatttttaaaattctggaacagatcgaagattatctcctatctcttggttggagatacctgcaggggatgaagtcgatggttctcaaggtctgatattacacaataacaaaaaataccactatttttttaaaaaaaggggtaaaagaataattaacagaactgcctttcttgtgtagttgctagtacatgacattgaaggtccatgtaaggagacaattaccttgccctta
